United States Patent 11,602,557 (BUNYAVIRALES VACCINE) - sequence listing, part 5

SEQ ID NO: 6067 - RNA, 702 nt, Artificial Sequence
  derived and/or modified CDS sequence (opt3) from BATV(804922)__FJ436805.1__N
augaucgaacuggaauuuaacgacguggccgcuaauaccagcuccacauuugaucccgaggucgcauacauuaacuucaagagaauauauacuacgggccucucuuacgacaauaucaggauuuucuauaucaaagggcgggaaauuaagaccucacuugccaaacgcagugagugggaaguuacacugaacuugggagguuggaaggugacuguauucaauaccaacuuuccuggcaaucgaaacagcccagugccggaugacggguuaacacugcaccgucuauccggauuccucgcgagauaccugcuugagaaaauccugaaggucucugaucccgagaaguugauaaucaaaucgaagauugugaauccucucgcugagaaaaacggcaucaccugggccgacggugaagaaguuuaucugucauuuuucccagggagcgagauguuucugggaacuuucagguuuuacccccucgcaauuggcaucuauaaggugcagcggaaagagauggaaccuaaguacuuagagaagacaaugcgccaaagauacaugggccuggaagccaguaccuggacggucuccaaacuuaaugaggugcagucugcuuugacuguaguuagcgggcugggauggaagaaaaccaacguguccucagcagccagggaguuccuagcuaaguuugguauaaguauguga

SEQ ID NO: 6068 - RNA, 702 nt, Artificial Sequence
  derived and/or modified CDS sequence (opt3) from BATV(8627-11)__FJ436802.1__N
augaucgaacuggaauuuaacgacguggccgcuaauaccagcuccacauuugaucccgaggucgcauacauuaacuucaagagaauauauacuacgggccucucuuacgacaauaucaggauuuucuauaucaaagggcgggaaauuaagaccucacuugccaaacgcagugagugggaaguuacacugaacuugggagguuggaaggugacuguauucaauaccaacuuuccuggcaaucgaaacagcccagugccggaugacggguuaacacugcaccgucuauccggauuccucgcgagauaccugcuugagaaaauccugaaggucucugaucccgagaaguugauaaucaaaucgaagauugugaauccucucgcugagaaaaacggcaucaccugggccgacggugaagaaguuuaucugucauuuuucccagggagcgagauguuucugggaacuuucagguuuuacccccucgcaauuggcaucuauaaggugcagcggaaagagauggaaccuaaguacuuagagaagacaaugcgccauagauacaugggccuggaagccaguaccuggacggucuccaaacuuaaugaggugcaaucugcuuugacuguaguuagcgggcugggauggaagaaaaccaacguguccucagcagccagggaguuccuagcuaaguuugguauaaguauguga

SEQ ID NO: 6069 - RNA, 702 nt, Artificial Sequence
  derived and/or modified CDS sequence (opt3) from BATV(G-20217)__FJ436806.1__N
augaucgaacuggaauuuaacgacguggccgcuaauaccagcuccacauuugaucccgaggucgcauacauuaacuucaagagaauauauacuacgggccucucuuacgacaauaucaggauuuucuauaucaaagggcgggaaauuaagaccucacuugccaaacgcagugagugggaaguuacacugaacuugggagguuggaaggugacuguauucaauaccaacuuuccuggcaaucgaaacagcccagugccggaugacggguuaacacugcaccgucuauccggauuccucgcgagauaccugcuugagaaaauccugaaggucucugaucccgagaaguugauaaucaaaucgaagauugugaauccucucgcugagaaaaacggcaucaccugggccgacggugaagaaguuuaucugucauuuuucccagggagcgagauguuucugggaacuuucagguuuuacccccucaguauuggcaucuauaaggugcagcggaaagagauggaaccuaaguacuuagagaagacaaugcgccaaagauacaugggccuggaagcauccaccuggacggucucuaaacuuaaugaggugcagagcgccuugacuguaguuuccgggcugggauggaagaaaaccaacgugucaagugcugcaagggaguuccuagccaaguuugguauaagcauguga

SEQ ID NO: 6070 - RNA, 702 nt, Artificial Sequence
  derived and/or modified CDS sequence (opt3) from BATV(MS50)__JX846604.1__N
augaucgagcuggaauuuaacgacguggccgcuaauaccagcuccacauuugaucccgaggucgcauacgccaacuucaagagaguucacacuacgggccucucuuaugaccaugugaggauuuucuacauaaaagggcgggaaaucaagaccucacuuaguaaacgcagcgagugggaaguaacacugaauuugggagguuggaagauugcgguguauaacacuaauuucccuuccaaccgaaauaacccagucccggaugacggcuuaacccugcaccgucuaucuggguaccucgcuagauaucuguuugagaaaaucgugaagguuucggagcccgaaaaacuucugauuaaaucaaagaucauaaauccuuuggccgagaaaaacggaaucacaugggcagauggcgaagagauuuaccucagcuucuuuccagguagugagauguuccuggggaccuuuaaguucuauccccuggccaucggaauuuacaaagugcagaggaaggaaauggagccuaaguaccucgaaaagacuaugcggcaacgcuauaugggcuuagaggcuggcacauggaccgucuccaaggugaaugaaguacaggcagccguuaacguggucucuacgcugggguggaaaaagacuaaugugagcgcugccgcgagagaguuucuugcaaaauucggaaucgccauguga

SEQ ID NO: 6071 - RNA, 702 nt, Artificial Sequence
  derived and/or modified CDS sequence (opt3) from BATV(ON-1/E/94)__AB257761.1__N
augaucgaacuggaguucaacgacguggccgcuaauaccagcuccacauuugaucccgaagucgcauacauuaacuucaagagaguuuauacuacgggccucucuuacgacaauauaaggaucuuuuauauuaaagggcgggaaaucaagaccucacuugccaaacgcagugagugggaagugacacugaacuugggagguuggaagguaacuguguucaauaccaacuuuccuggcaaucgaaacagcccagucccggaugacggguuaacacugcaccgucuauccggauuccucgcgagauaccugcuugagaaaauucugaaggugucugaucccgagaaguugaucauaaaaucgaagaucguuaauccucucgcugagaaaaacggcauuaccugggccgacggugaagaaguguaucugucauuuuucccagggagcgagauguuucugggaacuuucagguuuuacccccucgcaaucggcauuuauaagguccagcggaaagagauggaaccuaaguacuuagagaagacaaugcgccaaagauacaugggccuggaagccaguaccuggacgguguccaaacuuaaugagguacagucugcuuugacuguugugagcgggcugggauggaagaaaaccaacgucuccucagcagccagggaguuccuagcuaaguuugguaucaguauguga

SEQ ID NO: 6072 - RNA, 702 nt, Artificial Sequence
  derived and/or modified CDS sequence (opt3) from BATV(UgMP-6830)__JX846601.1__N
augaucgaacuggaauuuaacgacguggccgcuaauaccagcuccacauuugaucccgaggucgcauacauuaacuucaagagaauauauacuacgggccucucuuacgacaauaucaggauuuucuauaucaaagggcgggaaauuaagaccucacuugccaaacgcagugagugggaaguuacacugaacuugggagguuggaaggugacuguauucaauaccaacuuuccuggcaaucgaaacagcccagugccggaugacggguuaacacugcaccgucuauccggauuccucgcgagauaccugcuugagaaaauccugaaggucucugaucccgagaaguugauaaucaaaucgaagauuaucaauccucucgcugagaaaaacggcauuaccugggccgacggugaagaaguguaucugucauuuuucccagggagcgagauguuucugggaacuuucagguuuuacccccucgcaaucggcauauauaagguucagcggaaagagauggaaccuaaguacuuagagaagacaaugcgccaaagauacaugggccuggaagccaguaccuggacgguguccaaacuuaaugagguccagucugcuuugacugugguaagcgggcugggauggaagaaaaccaacguuuccucagcagccagggaguuccuagcuaaguuugguauuaguauguga

SEQ ID NO: 6073 - RNA, 702 nt, Artificial Sequence
  derived and/or modified CDS sequence (opt3) from BIRV(ArB2198)__AM711131.1__N
augaucgagcuggaguuccaccauguggccgcuaacaccagcuccacauuugaccccgaagucgcauacgccaauuucaagaggauucacacuaacggccucucuuaugauaauauaagaaucuuuuacauuaaagggcgggaaaucaagacgucacuugcgaaacgcagugagugggaaguuacccugaacuugggagguuggaagguggcuguauauaauacaaacuucccuggcaaucgaaacaauccagugccggacgauggguuaacucugcaucgucuaagcggauuucucgccagauaccugcuugagaaaaugcugaaggucuccgagcccgaaaaguugauuaucaaaaccaagauaaucaacccucucgcagagaaaaauggcauuacauggaaggacggugaagagguguaucugucuuucuuuccagggucggagauguuccugggaaccuuuaaauucuacccccucgccaucggcauuuauaagguucagaagaaagaaauggauccuaaguacuuagagaaaacuaugaggcaacgguacaugggccuggaggcuucaacauggaccgugagcaaggucagugaagugcaguccgcacuuacgguaguuucuagcuugggguggaaaaagacuaacgugaccgccgcugcccgcgacuuuuucgcgaaauuuggaaucaauauguga

SEQ ID NO: 6074 - RNA, 702 nt, Artificial Sequence
  derived and/or modified CDS sequence (opt3) from BOZOV(ArB13529)__AM711132.1__N
augaucgagcuggaguucaacgacguggccgcuaauaccagcuccacauuugaucccgaagcagccuacgcgaacuucaagagaguccacacuacgggccucaccuaugaccauauuaggauauuuuacaucaaagggucugaaauuaagacaucacuugcuaaacggagugagugggaaguuacucugaauuugggagguuggaagaucaccguguauaacacaaauuucccuggcaaccgcaauaacccaagcccggaugacggguuaacccugcacuuuuucugcggauuucuagccaaaucccuccuggagaagaugcuuaagguaucugcacccgagaaacugauuaucaagucgaaaauaacuucaccuuuggccgaaaagaauggcaucacauggaacgauggugaggaaguguaccucagcuucuuuccagggagugagauguuccugggaaccuuucauuucuauccccugccuauuggcaucuaccagggccuccgacgugacuuagagccaaaauauuuugggaagacgcugagacuuauguacaugggauuggaggcuuccucuuggacugucagcaagcugaccgaaggucaauccgcacuaacagugguuucaggccucggguggaaaaagacuaaugugagugccgcugccagggauuuccuggcgaaauucggaauuaacauguga

SEQ ID NO: 6075 - RNA, 702 nt, Artificial Sequence
  derived and/or modified CDS sequence (opt3) from CVV__X73465.1__N
augaucgagcuggaauuuaacgacguggccgcuaauaccagcuccacauuugaucccgagauugcauacgucaacuucaagagaauacacacuacgggccucucuuaugaccauaucaggauuuucuacaucaaagggcgggaaauuaagaccucacuuacaaaacgcagugagugggaaguuacucugaauuugggagguuggaaggugaccguauucaacacaaauuuuccuggcaaccgaaauagcccagugccggaugacggguuaacccugcaccgucuauccggauaucucgccagauaccugcuugagaaaauccugaaggucucugaucccgagaaggugauaaucaaaucgaagauuaucaacccuuuggcggagaaaaauggcauuacuuggucagacggugaagaaguuuaucucagcuucuuuccagggagugagauguuccugggaacauuuaaguucuacccccuggcuaucggcauauauaaagugcagaggaaggagauggaaccuaaguaccucgagaaaaccaugcggcaacgcuacaugggcuuagaagccuccacguggacuauuucuaaggucaacgaggugcaggcagcccugaccguaguuagcgggcuuggauggaaaaagacaaauguguccgcugcagccagagaauuuuuggcuaaauucgguaucucaauguga

SEQ ID NO: 6076 - RNA, 702 nt, Artificial Sequence
  derived and/or modified CDS sequence (opt3) from CVV(10081)__KP835932.1__N
augaucgagcuggaauuuaacgacguggccgcuaauaccagcuccacauuugaucccgagauugcauacgucaacuucaagagaauauauacuacgggccucucuuacgaccacaucaggauuuucuauaucaaagggcgggaaauuaagaccucacuuacaaaacgcagugagugggaaguuacucugaauuugggagguuggaagaucaccguguucaacacaaauuuuccuggcaaccgaaauagcccaguaccggaugacggguuaacccugcaucgucuauccggauaccucgccagauaucugcuugagaaaauacugaaggugucugaucccgagaaggucaucauuaaaucgaagaucauuaacccuuuggcggagaaaaauggcaucacuuggucagacggugaagaaguguaccucagcuucuuuccagggagugagauguuccugggaacauuuaaguucuauccccuggcuauaggcauuuacaaaguucagaggaaggagauggaaccuaaguaccucgagaaaaccaugcggcaacgcuauaugggcuuagaagccuccacguggacuaucucuaaggugaacgagguccaggcagcccugaccgugguaagcgggcuuggauggaaaaagacaaauguuuccgcugcagccagagaauuuuuggcuaaauucgguauuucaauguga

SEQ ID NO: 6077 - RNA, 702 nt, Artificial Sequence
  derived and/or modified CDS sequence (opt3) from CHLV(CHLV-Mex07)__EU879062.3__N
augaucgagcuggaauuuaacgacguggccgcuaauaccagcuccacauuugaucccgagauugcauacgucaacuucaagagaauauauacuacgggccucucuuacgaccacaucaggauuuucuauaucaaagggcgggaaauuaagaccucacuuacaaaacgcagugagugggaaguuacucugaauuugggagguuggaaggugaccguauucaacacaaauuuuccuggcaaccgaaauagcccagugccggaugacggguuaacccugcaucgucuauccggauaccucgccagauaucugcuugagaaaauccugaaggucucugaucccgagaaggugauaaucaaaucgaagauuaucaacccuuuggcggagaaaaauggcauuacuuggucagacggugaagaaguuuaccucagcuucuuuccagggagugagauguuccugggaacauuuaaguucuauccccuggcuaucggcauauacaaagugcagaggaaggagauggaaccuaaguaccucgagaaaaccaugcggcaacgcuauaugggcuuagaagccuccacguggacugucucuaaggugaacgagguacaggcagcccugaccguugugagcgggcuuggauggaaaaagacaaaugucuccgcugcagccagagaauuuuuggcuaaauucgguauuucaauguga

SEQ ID NO: 6078 - RNA, 702 nt, Artificial Sequence
  derived and/or modified CDS sequence (opt3) from GERV__M19420.1__N
augcuggagcucgaguucgaagacgugcccaacaauaucggcagcaccuuugauccugaauccggguacacaaacuuccagagaaauuaucuuccaggagucacucuggaccaaauuaggauauuuuacaucaagggucgggagauuaaaaacucuuugucaaagcgcagugaaugggagguuacguuaaaucugggcggguggaaagugccgguacuaaacaccaauuuccccggaaaccgaaauaacgccgugccugauuauggccucacauuucaccguaucagcgguuaccuggcuagauaucuucuggggaaguacuuggcagagacugaaccagagaaacucauuaugaggaccaagaucgucaauccccuggccgaaaagaacggaauaacaugggaguccggcccugagguguaucugucuuucuuuccaggcgcggaaauguuccucgggaccuuucgguucuaccccuuagcuaucggaauuuacaaaguucagcgcaaggagauggacccuaaauuucuggaaaagacuaugagacagagguaucuugguaucgaugcccagacauggaccacgacuaaauugggcgagguggaagcagcccugaaggucgugucggggcuaggauggaagaaaaccaauguaucaagcgcugcacgggaguuccucaguaaguuuggcauucgcauguga

SEQ ID NO: 6079 - RNA, 702 nt, Artificial Sequence
  derived and/or modified CDS sequence (opt3) from IACOV(BeAn314206)__JN572067.1__N
augagcgagaucauuuucgacgaugugggccagauaaccuccucuacauuuaaccccgacguccaauacaucaauuucaagaaaaaccacacuacggggcugaauuaugaucagauuagaguguuuuuccucaacggaaagaaagccaaggaaacccuugcuaaaaggucagaggaaagucugcaguugaauuuugguggcuggcggguuguagugaugaacacacauuucccugggaaucgcaacauguuaaucccagacgaggcaaugacucugcaccgacuaagcggauaccucgcccguuaucugcuugaaaggauucuguccggcccggagcaugagaaggucgugaucaccucuaagauaguuaaucccaucgcggcuucgaacgguauuacauggaccgaugggccugaaguguacuugucauuuuucccaggaacugagauguuucucgagagcuucaaauuuuauccccuggccaucggcauuuacaagguccagaaaaagaugauggaaaguaaauaucuggagaaggcaaugagacaaaaguacuccggcauggacgccacacucuggacccagcagaaauacgcugaagugacgaaugcauuagccguaguuucuaaccugggguggaagaaaagcaauguguccgcugccgcgcgggauuuccuugcaaaguuuggaauccaguuguga

SEQ ID NO: 6080 - RNA, 702 nt, Artificial Sequence
  derived and/or modified CDS sequence (opt3) from ILEV(ArB16282)__AM709780.1__N
augaucgagcuggaguuccacgacgugaccgccaacacaagcuccacuuuugaucccgaagucgcuuacgcaaauuucaagaggauucauacgaacggccucaauuaugaccacauaagaaucuuuuacauuaaagggcgggaaaucaagaccucucuugccaaacgcucagagugggaaguuacacugaacuugggagguuggaagauuaguguguauaauacuaaauucccuggcaaccgaaauaacccaguaccggaugacggguuaacccugcaucgucuaagcggauuucucgcgagauaccugcuugagaagaugcugaagguguccgagcccgaaaaauugaucauaaagucuaaaaucauuaauccucucgcugagaagaacggcaucacaugguaugauggugaagaggucuaccugucguucuuuccagggucagagaugugccugggaacccaggacuucuaucccauggccauugaauuuuaccaagugcagaggaaagagauggaaccuaaguuccucgagaagacuuuaaaacagcggagccugggccuugaaccaaguacauggaccaucucccaguugguuaagcugcaaucugcacuaacgguggucagcggccucggguggaaaaagacuaaugugggagccgcugcacgcaacuuucuggccaaauucgguauaaauauguga

SEQ ID NO: 6081 - RNA, 702 nt, Artificial Sequence
  derived and/or modified CDS sequence (opt3) from ILEV(HB80P125)__AM709779.1__N
augaucgagcuggaauuucacgacgugaccgccaacacaagcuccacuuuugaucccgaggucgcuuacgcaaauuucaagaggauucauacgaacggccucaauuaugaccacauaagaaucuuuuacauuaaagggcgggaaaucaagaccucucuugccaaacgcucagagugggaaguuacacugaacuugggagguuggaagauugcgguguauaauacuaacuucccuggcaaucgaaacaauccaguaccggaugacggguuaacccugcaucgucuaaguggauaccucgcuagaugccugcuugagaaaaugcugaaggugagcgagcccgaaaagcagaucauaaaauccaagaucauuaacccuuuggccgagaaaaauggcaucacaugggaugacggugaagaggucuaucucucuuucuucccagggucggagauguuucugggaaccuucagguuuuacccccuggcaauuggcaucuauaaggugcaacggaaagaaauggagccuaaguaccucgaaaagacuaugcgccagagauacaugggcuuagaggccucaacauggaccauaagcaaacuggcugaaguucagagugcacuuacgguggucuccggguugggauggaagaaaacuaacgugucugccgcugccagggauuuccuggcgaaguuugguauuaauauguga

SEQ ID NO: 6082 - RNA, 702 nt, Artificial Sequence
  derived and/or modified CDS sequence (opt3) from ILEV(ILESHA/8e)__KC608151.1__N
augaucgagcuggaauuucacgacgugaccgccaacacaagcuccacuuuugaucccgaggucgcuuacgcaaauuucaagaggauucauacgaacggccucaauuaugaccacauaagaaucuuuuacauuaaagggcgggaaaucaagaccucucuugccaaacgcucagagugggaaguuacacugaacuugggagguuggaagauugcgguguauaauacuaacuucccuggcaaucgaaacaauccaaucccggaugacggguuaacccugcaucgucuaaguggauaccucgcuagauaucugcuugagaaaaugcugaagguaagcgagcccgaaaagcagauaaucaaauccaagauuaucaacccuuuggccgagaaaaauggcauuacaugggaugacggugaagagguguaccucucuuucuucccagggucggagauguuucugggaaccuucagguuuuauccccuggcaaucggcauauacaagguccaacggaaagaaauggagccuaaguaccucgaaaagacuaugcgccagagauauaugggcuuagaggccucaacauggaccauuagcaaacuggcugaagugcagagugcacuuacgguuguguccggguugggauggaagaaaacuaacgucucugccgcugccagggauuuccuggcgaaguuugguaucaauauguga

SEQ ID NO: 6083 - RNA, 702 nt, Artificial Sequence
  derived and/or modified CDS sequence (opt3) from ILEV(R5964)__AY729651.1__N
augaucgagcuggaauuucacgacgugaccgccaacacaagcuccacuuuugaucccgaggucgcuuacgcaaauuucaagaggauucauacgaacggccucaauuaugaccacauaagaaucuuuuacauuaaagggcgggaaaucaagaccucucuugccaaacgcucagagugggaaguuacacugaacuugggagguuggaagauugcgguguauaauacuaacuucccuggcaaucgaaacaauccaaucccggaugacggguuaacccugcaucgucuaaguggauaccucgcuagauaucugcuugagaaaaugcugaagguaagcgagcccgaaaagcagauaaucaaauccaagauuaucaacccuuuggccgagaaaaauggcauuacaugggaugacggugaagagguguaccucucuuucuucccagggucggagauguuucugggaaccuucagguuuuauccccuggcaaucggcauauacaagguccaacggaaagaaauggagccuaaguaccucgaaaagacuaugcgccagagauauaugggcuuagaggccucaacauggaccauuagcaaacuggcugaagugcagagugcacuuacgguuguguccggguugggauggaagaaaacuaacgucucugccccagcuagggauuuccuggccaaguuugguaucaauauguga

SEQ ID NO: 6084 - RNA, 702 nt, Artificial Sequence
  derived and/or modified CDS sequence (opt3) from MAGV__D13783.1__N
augaucgagcuggaguucaacgacguggccgcuaauaccagcuccacauuugaucccgaaauugcauacgucaacuucaagagaauacacacuacgggccucucuuaugaccauaucaggguucuuuacauuaaagggcgggaaaucaagaccucacugacaaaacgcagugagugggaagugacuuugaauuuaggagguuggaagguagccguguuuaacaccaauuucccuggcaaccgaaauagcccagucccggaugacgggcugacacuacaccgucucuccggauuucuggcgagauaucuucuggagaaaauuuugaaggugucugaucccgagaagcucaucauaaaaucgaagaucauuaacccucuggcugagaaaaauggcaucaccugggccgacggugaagaaguuuaccugucauucuuuccagggagcgagauguuccucggaacuuuuaaguucuaucccuuagcaauuggcaucuacaaagugcagaagaaggagauggaaccuaaauaucuggagaagacaaugaggcaacgguacaugggccuugaagccgcuaccuggacggucaguaaagugaacgagguacaggcagccuugacuguuguguccgggcugggauggaagaaaaccaaugucucugcugccgcgcgcgaauuucuagcaaaguucgguauaaacauguga

SEQ ID NO: 6085 - RNA, 702 nt, Artificial Sequence
  derived and/or modified CDS sequence (opt3) from MAGV(7272)__KX100103.1__N
augaucgagcuggaguucaacgacguggccgcuaauaccagcuccacauuugaucccgaaauugcauacgucaacuucaagagaauacacacuacgggccucucuuaugaccauaucaggguucuuuacauuaaagggcgggaaaucaagaccucacugacaaaacgcagugagugggaagugacuuugaauuuaggagguuggaagguagccguguuuaacaccaauuucccuggcaaccgaaauagcccagucccggaugacgggcugacacuacaccgucucuccggauuucuggcgagauaucuucuggagaaaauuuugaaggugucugaucccgagaagcucaucauaaaaucgaagaucauuaacccucuggcugagaaaaauggcaucaccugggccgacggugaagaaguuuaccugucauucuuuccagggagcgagauguuccucggaacuuuuaaguucuaucccuuagcaauuggcaucuacaaagugcagaggaaggagauggaaccuaaguaucuggagaaaacaaugcggcaacgcuacaugggccuugaagccgcuaccuggacggucaguaaggugaacgagguacaggcagccuugacuguuguguccgggcugggauggaaaaagaccaaugucucugcugccgcgagagaauuucuagcaaaauucgguauaaacauguga

SEQ ID NO: 6086 - RNA, 702 nt, Artificial Sequence
  derived and/or modified CDS sequence (opt3) from MAGV(3363)__KX100106.1__N
augaucgagcuggaauuuaacgacguggccgcuaauaccagcuccacauuugaucccgagauugcauacgucaacuucaagagaauauauacuacgggccucucuuacgaccacaucaggauuuucuauaucaaagggcgggaaauuaagaccucacuuacaaaacgcagugagugggaaguuacucugaauuugggagguuggaaggugaccguauucaacacaaauuuuccuggcaaccgaaauagcccagugccggaugacggguuaacccugcaucgucuauccggauaccucgccagauaucugcuugagaaaauccugaaggucucugaucccgagaaggugauaaucaaaucgaagauuaucaacccuuuggcggagaaaaauggcauuacuuggucagacggugaagaaguuuaccucagcuucuuuccagggagugagauguuccugggaacauuuaaguucuauccccuggcuaucggcauauacaaagugcagaggaaggagauggaaccuaaguaccucgagaaaaccaugcggcaacgcuauaugggcuuagaagccuccacguggacuauuucuaaggucaacgaggugcaggcagcccugaccguaguuagcgggcuuggauggaaaaagacaaauguguccgcugcagccagagaauuuuuggcuaaauucgguaucucaauguga

SEQ ID NO: 6087 - RNA, 702 nt, Artificial Sequence
  derived and/or modified CDS sequence (opt3) from NRIV(DakArY357/6e)__AY593727.1__N
augaucgagcuggaauuucacgacgugaccgccaacacaagcuccacuuuugaucccgaggucgcuuacgcaaauuucaagaggauucauacgaacggccucaauuaugacuacauaagaaucuuuuauauuaaagggcgggaaaucaagaccucucuugccaaacgcucagagugggaaguuacacugaacuugggagguuggaagauugcgguguacaauacuaacuucccuggcaaucgaaacaauccaaucccggaugacggguuaacccugcaccgucuaaguggauaucucgcuagauaccugcuugagaaaaugcugaagguaagcgagcccgaaaagcagauaaucaaauccaagauuaucaacccuuuggccgagaaaaauggcauuacaugggaugacggugaagagguguaucucucuuucuucccagggucggagauguuucugggaaccuucagguuuuacccccuggcaaucggcauauacaagguccaacggaaagaaauggagccuaaguaucucgaaaagacuaugcgccagagauacaugggcuuagaggccucaacauggaccauuagcaaacuggcugaagugcagagugcacuuacgguuguguccggguugggauggaagaaaacuaacgucucugccgcugccagggauuuccuggcgaaguuugguaucaauauguga

SEQ ID NO: 6088 - RNA, 702 nt, Artificial Sequence
  derived and/or modified CDS sequence (opt3) from NORV__X73470.1__N
augaucgagcuggaguucaacgacguggccgcuaauaccagcuccacauuugaucccgaagucgcauacauuaacuucaagagaguuuauacuacgggccucucuuacgaccacauaaggaucuuuuauauuaaagggcgggaaaucaagaccucacuuacaaaacgcagugagugggaagugacucugaauuugggagguuggaagguaaccguguucaacacaaauuuuccuggcaaccgaaauagcccagucccggaugacggguuaacccugcaucgucuauccggauuccucgccagauaccugcuugagaaaauucugaaggugucugagcccgaaaaguugaucauaaaaucgaagaucauuaacccucucgcggagaaaaauggcaucacuuggacagauggugaagagguuuaucugucauuuuucccagggagcgagauguuucugggaaccuucaaguuuuacccccucgcuauuggcaucuauaaagugcagaggaaggaaauggagccuaaguacuuagagaaaacgaugcggcaacgcuacaugggccuggaagccaguacuuggaccauauccaaggucaacgaagugcaggcagcccuuacaguaguuucuggguugggauggaaaaagacuaaugugagcgcugcagccagagaguuccuggcuaaauuugguauuaacauguga

SEQ ID NO: 6089 - RNA, 702 nt, Artificial Sequence
  derived and/or modified CDS sequence (opt3) from POTV(89-3380)__AY729652.1__N
augaucgagcuggaauuuaacgacguggccgcugauaccagcuccacauuugaccccgagauugcauacgucaauuucaagagaauacacacuacgggccucucuuaugaucauaucaggauuuucuacaucaaagggcgggaaauuaagaccucacuuacaaaacgcagugagugggaaguuacucugaacuugggagguuggaagaucaccguguucaauacaaacuuuccuggcaaucgaaacagcccaguaccggacgauggguuaacccugcaccgucuauccggauaucucgccagauaccugcuugagaaaauacugaaggugucugaccccgagaaggucaucauuaaaucgaagaucauuaauccuuuggcggagaaaaacggcaucacuuggucagauggugaagaaguguaucucagcuucuuuccagggagugagauguuccugggaacauuuaaguucuacccccuggcuauaggcauuuauaaaguucagaggaaggagauggaaccuaaguaccucgagaaaaccaugcggcaacgcuacaugggcuuagaagccuccacguggacugugucuaaggucaaugaggugcaggcagcccugaccguaguuagcgggcuuggauggaaaaagacaaacguguccgcugcagccagagaauuuuuggcuaaauucgguaucucaauguga

SEQ ID NO: 6090 - RNA, 702 nt, Artificial Sequence
  derived and/or modified CDS sequence (opt3) from SHOV(4042)__EU564831.1__N
augaucgagcuggaguuccacgacguggccgcuaacaccagcuccacauuugaucccgaagucgcauacgccaauuucaagagaguucauacuacgggccucucuuaugaccacauuaggauauuuuacaucaaagggcgggaaauuaagaccucacuugcgaaacgcagugagugggaagugacacugaacuugggagguuggaagaucacuguauauaauaccaacuucccuggcaaucgaaacaauccagugccggaugacggguuaacacugcaucgucuaagcggauuucucgcuagauaccugcuugagaaaaugcugaaggucuccgagcccgaaaaguugauuaucaaaucuaagauaaucaacccucucgccgagaaaaauggcauuaccuggacugauggugaagagguguaucugucguucuuuccaggggcagagauguuccugggaacauuuaaguucuacccccucgccaucggcauuuauaaaguucagaggaaggaaauggagccuaaguacuuagaaaagaccaugcggcaacgcuacaugggccuggaggcugcaacguggacugugucaaaacuuaccgaaguccaggccgcuuugacagugguaagcgggcugggauggaaaaagacuaacguuagugccgcggcaagagacuuucuagccaaauucgguaucuccauguga

SEQ ID NO: 6091 - RNA, 702 nt, Artificial Sequence
  derived and/or modified CDS sequence (opt3) from TENV(TSV-FE3-66FB)__FJ943505.1__N
augaucgaacuggaguucaacgacguggccgcuaauaccagcuccacauuugaucccgaagucggcuacguuaacuucaagagagugcacacuacggggcucucuuaugaccauauuaggauauuuuacaucaaaggacgggaaauuaagaccucacuuacaaaacgcagugagugggaaguaacucugaauuuggguggcuggaaggugaccgucuucaacacaaauuuuccugggaaccgaaauagcccagugccggaugacggauuaacccugcaccgucuauccggcuuccucgcaagauaucugcuugagaaaauccugaagguuucugaucccgagaaguugauuaucaaaucgaagauaaucaacccucucgccgagaaaaaugguauuacuugggcggacggggaagaaguguaccugucauuuuucccaggaagcgagauguuucugggcacauucaaguuuuauccccucgcuaucggcauuuacaaaguccagaggaaggagauggaaccuaaguauuuagagaaaaccaugcggcaacgcuacauggggcuggaagccgcaacguggacuaucaguaaggugaacgagguacaguccgcccuuaccguugugucuggauuggguuggaaaaagacaaaugucagcgcugcagccagagaguuccuggcuaaauuuggcauaaacauguga

SEQ ID NO: 6092 - RNA, 702 nt, Artificial Sequence
  derived and/or modified CDS sequence (opt3) from XINV(BeH388464)__EU564830.1__N
augcuggaacucgaauuuaacgacguggccgcuaauaccagcuccacauuugaucccgaggucggcuacgcaaacuucaagagaauccacacuaaugggcuuucuuaugacaacauuaggauauuuuacaucaaaggacgggaaauuaagacgucacuggccaaacgcagugagugggaaguuaccuugaauuuagguggcuggaagaucacaguguauaacacuaauuucccugggaaccgaaaucauccaauuccggaugacggacugaccauccaccgucuaagcggcuaccucgcgagauaucugcuugagaaaauacugaagguauccgaucccgagaaguugcucaucaaaacaaagauuaucaacccucuggcugagaaaaaugguauuaccuggaacgacggggaagaaguguaccugucuuucuucccaggaucggagauguuucucggcacuuucaaguuuuaucccuuagccaucggcauauacaaaguccagaggaaggagauggaaccuaaguaccuggagaaagcaaugcggcaacgcuauauggggcuugaaucagccacauggaccgugagcaaguugaaugagguucagagugcucugacgguggucuccggacuagguuggaaaaagacuaacgugucugcagccgcuagagaguuccucgccaaauuuggcauuaauauguga

SEQ ID NO: 6093 - RNA, 702 nt, Artificial Sequence; identical to SEQ ID NO: 6055
  derived and/or modified CDS sequence (opt3) from NRIV(9800535)__JX857328.1__N

SEQ ID NO: 6094 - RNA, 702 nt, Artificial Sequence
  derived and/or modified CDS sequence (opt3) from NRIV(Adrar)__KJ716848.1__N
augaucgagcuggaguuccacgacguggccgcuaacaccagcuccacauuugaucccgaagucgcauacgccaauuucaagagaauuuauacuacgggccucucuuacgaccauauaaggaucuuuuauauuaaagggcgggaaaucaagaccucacuugcgaaacgcagugagugggaaguuacacugaacuugggagguuggaagauuacuguguacaauaccaacuucccuggcaaucgaaacaauccaguaccggaugacggguuaacacugcaccgucuaagcggauuucucgcuagauaucugcuugagaaaaugcugaagguguccgagcccgaaaaguugaucauaaaaucuaagaucauuaacccucucgccgagaaaaauggcaucaccuggaacgauggugaagaggucuaccugucguucuuuccagggucagagauguuccugggaacuuuuagguucuauccccucgcaauuggcaucuacaaggugcagcggaaagaaauggagccuaaguacuuagaaaagacaaugcgccaaagauauaugggccuggaggccgcuaccuggacgguuagcaaacuuacugaagugcagagugcauugaccgucguguccucucugggguggaagaaaacaaauguaagcgccgcugccagggacuuucuagcgaaguucggaauaaacauguga

SEQ ID NO: 6095 - RNA, 702 nt, Artificial Sequence
  derived and/or modified CDS sequence (opt3) from NRIV(D28542/4e)__KC608154.1__N
augaucgagcuggaguuccacgacguggccgcuaacaccagcuccacauuugaucccgaagucgcauacgccaauuucaagagaguuuauacuacgggccucucuuacgaccauauuaggauauuuuauaucaaagggcgggaaauuaagaccucacuugcgaaacgcagugagugggaagugacacugaacuugggagguuggaagaucacuguauacaauaccaacuucccuggcaaucgaaacaauccagugccggaugacggguuaacacugcaccgucuaagcggauuucucgcuagauaucugcuugagaaaaugcugaaggucuccgagcccgaaaaguugauuaucaaaucuaagauaaucaacccucucgccgagaaaaauggcauuaccuggaacgauggugaagagguguaccugucguucuuuccagggucagagauguuccugggaacuuuuagguucuauccccucgcaaucggcauuuacaagguucagcggaaagaaauggagccuaaguacuuagaaaagacaaugcgccaaagauauaugggccuggaggccgcuaccuggacggugagcaaacuuacugaaguccagagugcauugaccgugguauccucucugggguggaagaaaacaaauguuagcgccgcugccagggacuuucuagcgaaguucggaaucaacauguga

SEQ ID NO: 6096 - RNA, 702 nt, Artificial Sequence
  derived and/or modified CDS sequence (opt3) from NRIV(SUD-HKV141)__JX857322.1__N
augaucgagcuggaguuccacgacguggccgcuaacaccagcuccacauuugaucccgaagucgcauacgccaauuucaagagaguucauacuacgggccucucuuaugaccacauuaggauauuuuacaucaaagggcgggaaauuaagaccucacuugcgaaacgcagugagugggaagugacacugaacuugggagguuggaagguaacuguguauaauaccaacuucccuggcaaucgaaacaauccagucccggaugacggguuaacacugcaucgucuaagcggauuucucgcuagauaccugcuugagaaaaugcugaagguguccgagcccgaaaaguugaucauuaaaucuaagaucauaaacccucucgccgagaaaaauggcaucaccuggaacgauggugaagagguuuaucugucguucuuuccagggucagagauguuccugggaacuuuuagguucuacccccucgcaauuggcaucuauaaggugcagcggaaagaaauggagccuaaguacuuagaaaagacaaugcgccaaagauacaugggccuggaggccgcuaccuggacggucagcaaacuuacugaagugcagagugcauugaccguaguuuccucucugggguggaagaaaacaaaugugagcgccgcugccagggacuuucuagcgaaguucggaauuaacauguga

SEQ ID NO: 6097 - RNA, 705 nt, Artificial Sequence
  derived and/or modified CDS sequence (opt3) from BWAV(M459)__NC_034480.1__N
augagcgaccugaucuucuacgauguggacuccgucaacgccaaugaguuugaucccgacaccggcuaucucgauuucaagaacaauuacccuggggcucuuaacacaaauacugcaagaacguuuuuccugaacgccgcgaaagcuaagaauguuuugaggaacaaaccagacaagaaagugaauccgaaguuuggaaacugggaaguagagguggucaauaaccacuuccccgguaaucggaacaauccuauuggcaaggaugacuuaacccugcaucgcauaucuggguaucuagcccgauggauccucgaagaguacaaacgugaugacgaaucagagaaggagauuaucgaaaguacagugauuaacccaaucgcagagagcaacggaauaagaugguccgauggcgccgaaaucuaucugucguuuuuccccgguacugagauguuucuugagccuuucaaauuuuacccacuggcuauugggaucuauaggguuaagcacaaaaugauggacgcacaguucuugaagaaggcccuccggcaacgcuacggaaaaaugaccgcugaaaaguggaugucuacaaaagugaagaccauuggcgaggccgucagaaauguggaaaaacugaaguggggcaaagggggacugucagaugcggcaaggaacuuucucaagaaguucgacaucgccaugauauga

SEQ ID NO: 6098 - RNA, 705 nt, Artificial Sequence
  derived and/or modified CDS sequence (opt3) from BWAV(M459)__EU564827.1__N
augagcgaccugaucuucuacgauguggacuccgucaacgccaaugaguuugaucccgacaccggcuaucucgauuucaagaacaauuacccuggggcucuuaacacaaauacugcaagaacguuuuuccugaacgccgcgaaagcuaagaauguuuugaggaacaaaccagacaagaaagugaauccgaaguuuggaaacugggaaguagagguggucaauaaccacuuccccgguaaucggaacaauccuauuggcaaggaugacuuaacccugcaucgcauaucuggguaucuagcccgauggauccucgaagaguacaaacgugaugacgaaucagagaaggagauuaucgaaaguacagugauuaacccaaucgcagagagcaacggaauaagaugguccgauggcgccgaaaucuaucugucguuuuuccccgguacugagauguuucuugagccuuucaaauuuuacccacuggcuauugggaucuauaggguuaagcacaaaaugauggacgcacaguucuugaagaaggcccuccggcaacgcuacggaaaaaugaccgcugaaaaguggaugucuacaaaagugaaggccauuggcgaggcggucagaaauguggaaaaacugaaguggggcaaagggggacugucagaugcagccaggaacuuucucaagaaguucgacaucgcuaugauauga

SEQ ID NO: 6099 - RNA, 705 nt, Artificial Sequence
  derived and/or modified CDS sequence (opt3) from BWAV(UgAr1888)__KJ867185.1__N
augagcgaccugaucuucuacgauguggacuccgucaacgccaaugaguuugaucccgacaccggcuaucucgauuucaagaacaauuacccuggggcucuuaacacaaauacugcaagaacguuuuuccugaacgccgcgaaagcuaagaauguuuugaggaacaaaccagacaagaaagugaauccgaaguuuggaaacugggaaguagagauugugaauaaccacuuccccgguaaucggaacaauccuauaggcaaggaugacuuaacccugcaucgcaucucuggguaucuagcccgauggauucucgaagaguacaaacgugaugacgaaucagagaaggagaucauugaaaguacagucaucaacccaauagcagagagcaacggaaucagaugguccgauggcgccgaaauuuaucugucguuuuuccccgguacugagauguuucuugagccuuucaaauuuuacccacuggcuaucgggauuuauagggugaagcacaaaaugauggacgcacaguucuugaagaaggcccuccggcaacgcuacggaaaaaugaccgcugaaaaguggaugucuacaaaaguuaaggccaucggcgaggcggugagaaaugucgaaaaacugaaguggggcaaagggggacugucagaugcagccaggaacuuucucaagaaguucgacauagcuaugauuuga

SEQ ID NO: 6100 - RNA, 708 nt, Artificial Sequence
  derived and/or modified CDS sequence (opt3) from BWAV/PGAV(SAAr1)__EU564828.1__N
augagcggcgaccugguguucuacgaugucgacuccguuaacucuaaugccuuugaucccgacgcuggguauguggcauucucaaacaaucacccuggagcccucaacaucaccacagcgagaacguuuuuccuuaaugcugccaaggcaaaagguguacugaggaacaagccagauaaaaaggugaaaccgaaguuuggcgacugggaggucgaaauugugaauaaccauuuccccgggaaucggaacaauacuauaggagaggaugacuugaccuuacaccgcaucaguggcuaccuggcccgauggguucuagaggaacauagcaaggaugacgaauccgagaaagagcucauugaaucuacaaucgugaacccuauugcugagucgaaugguaucaaguggucagauggggcagccauauaucugagcuuuuucccaggaacugaaauguuucuugagcccuucaaauuuuucccucuggcuaucggcauuuaccgugucaagcacaaaaugauggacgcccaguuuuugaagaaggcgcucagacaaagguauggcaaacugaccgcagagaaguggauggccacaaaagugaagaguaucggggaagcuguacgggccguugagaaacugaaguggggaaaagguggcauuuccgaugcagcucgcaccuuccucaagaaguucgacaucgccuuaauauga

SEQ ID NO: 6101 - RNA, 708 nt, Artificial Sequence; identical to SEQ ID NO: 6100
  derived and/or modified CDS sequence (opt3) from BWAV/PGAV(191B-07)__KJ867179.1__N

SEQ ID NO: 6102 - RNA, 708 nt, Artificial Sequence
  derived and/or modified CDS sequence (opt3) from CEV(283)__KX817314.1__N
augagcgaccugguguucuacgaugucgccuccaccggcgcuaacggguuugaccccgaugcaggauauguugacuucugcgccaaguacggugagucuaucaaucucgcggcugugagaauauuuuuccuuaacgccgcaaaagccaaggcugcacugucaaggaaaccugaacggaaggccaauccaaaauuuggcgaguggcagguagaaguggucaacaaucacuucccggcuaaccgcaauaaccccauugggaauaacgauuugacaauccaucgaauuaguggauauuuagcccguugggugcuggagcaauacaaggaaaaugaggacgagagccagagagagcuaguuaagacuacggugaucaacccuauugcggaauccaauggcaucaggugggaaaacggugcagagauauaucucgccuuuuucccagggaccgagauguuucuggaaacauucaaauuuuacccccuuacuaucggaauuuaucgggucaagaauggcaugauggauucucaguaccugaaaaaggcuuugcgccagagauacggcucgcucaccgccgagaaauggaugucacaaaagacagggaugaucgcaaagagccugaaagaaguggagcagcugaaguggggaagggguggccucagugacaccgcucggacuuucuuacagaaauuugggauuaagcugccuuga

SEQ ID NO: 6103 - RNA, 708 nt, Artificial Sequence
  derived and/or modified CDS sequence (opt3) from CEV(BFS-283)__U12797.1__N
augagcgaccugguguucuacgaugucgccuccaccggcgcuaacggguuugaccccgaugcaggauauguugacuucugcgccaagcacggugagucuaucaaucucgcggcugugagaauauuuuuccuuaacgccgcaaaagccaaggcugcacugucaaggaaaccugaacggaaggccaauccaaaauuuggcgaguggcagguagaaguggucaacaaucauuucccggcuaaccgcaauaaccccauugggaauaacgauuugacaauccaccgaauuaguggauacuuagcccguugggugcuggagcaauauaaggaaaaugaggacgagagccagagagagcuaguuaagacuacggugaucaacccuauugcggaauccaauggcaucaggugggaaaacggugcagagauauaccucgccuuuuucccagggaccgagauguuucuggaaacauucaaauuuuauccccuuacuaucggaauuuaccgggucaagaauggcaugauggauucucaguaucugaaaaaggcuuugcgccagagauacggcucgcucaccgccgagaaauggaugucacaaaagacagggaugaucgcaaagagccugaaagaaguggagcagcugaaguggggaagggguggccucagugacaccgcucggacuuucuuacagaaauuugggauuaagcugccuuga

SEQ ID NO: 6104 - RNA, 708 nt, Artificial Sequence
  derived and/or modified CDS sequence (opt3) from CHATV(Mohko ILO8-3)__KF719221.1__N
augagcgaccugguguucuacgaugucgccuccaccggcgcuaacggguuugaccccgaugagggauauauggcauucugcguuaagcacgccgaaucuaucucacucgcggcugugagaauauuuuuccuuaaugccgcaaaagccaaggcugcacuggccaggaaaccugagaagaaagcuaguccaaaguuuggugaauggcagguagagauugugaacaaucauuucccgggcaaccggaauaaccccaucgggaauaacgacuugacaguccaccgcuuaagcggauaccuggcccgaugggugcuagaacaauauaaggagaaugaggaugaaucccagcgugagcucauuaaaacuacgguuaucaacccuauugcggaaucuaauggcgugagaugggacucggguccagagaucuaccugucauuuuuccccgggaccgagauguuucuugaaacauucaaguuuuauccucugacuauaggaaucuacagggucaaacagggcaugauggauccacaguauuugaagaaagcacuccggcaacgcuacggcacccugacagccgacaaguggaugagccagaaggugaccgcuauugccaaaagucugaaggagguagaacagcucaaaugggggagaggagguuuauccgauacugcaaggacauuccugcagaaguuuggcauccggcuucccuga

SEQ ID NO: 6105 - RNA, 708 nt, Artificial Sequence
  derived and/or modified CDS sequence (opt3) from CHATV(Mohko M07-1)__KF719224.1__N
augagcgaccugguguucuacgaugucgccuccaccggcgcuaacggguuugaccccgaugagggauauauggcauucugcguuaagcacgccgaaucuaucaaucucgcggcugugagaauauuuuuccuuaacgccgcaaaagccaaggcugcacuggccaggaaaccugagaagaaggcuucaccaaaauuuggugaauggcagguagagauugugaauaaccauuucccgggcaaucggaacaaucccaucgggaacaaugacuugacaguccaccgcuuaaguggauaccuggcccgaugggugcuagaacaauauaaggagaacgaggaugaaagccagcgugagcucauuaaaacuacgguuaucaauccuauugcggaauccaacggcgugagaugggacucugguccagagaucuaccugucguuuuuccccgggaccgagauguuucuugaaacauucaaguuuuauccucugacuauaggaaucuacagggucaaacagggcaugauggauccacaguauuugaagaaagcacuccggcaacgcuacggcacccugacagccgacaaguggaugucacagaaggugaccgcuauugccaaaagccugaaggagguagaacagcucaaaugggggagaggagguuuaagugauacugcaaggacauuccugcagaaguuuggcauccggcuucccuga

SEQ ID NO: 6106 - RNA, 708 nt, Artificial Sequence
  derived and/or modified CDS sequence (opt3) from CHATV(Mohko S07-2)__KF719233.1__N
augagcgaccugguguucuacgaugucgccuccaccggcgcuaacggguuugaccccgaugagggauauauggcauucugcguuaagcacgccgaaucuaucaaucucgcggcugugagaauauuuuuccuuaacgccgcaaaagccaaggcugcacuggccaggaaaccugagaagaaggcuucaccaaaauuuggugaauggcagguagagauugugaauaaccauuucccgggcaaucggaacaaucccaucgggaacaaugacuugacaguccaccgcuuaaguggauaccuggcccgaugggugcuagaacaauauaaggagaacgaggaugaaagccagcgugagcucauuaaaacuacgguuaucaauccuauugcggaauccaacggcgugagaugggacucugguccagagaucuaccugucguuuuuccccgggaccgagauguuucuugaaacauucaaggucuauccucugacuaccggaauauacagggugaaacagggcaugauggauccacaguauuugaagaaagcacuccggcaacgcuacggcacacugaccgccgacaaguggaugucacagaagguaacugcuaucgccaaaagccugaaggagguugaacagcucaaaugggggagaggagguuuaagugauacagcaaggaccuuucugcagaaguucggcauucggcuucccuga

SEQ ID NO: 6107 - RNA, 708 nt, Artificial Sequence
  derived and/or modified CDS sequence (opt3) from CHATV(LEIV-11483)__FJ853592.1__N
augagcgaccugguguucuacgaugucgccuccaccggcgcuaacggguuugaccccgaugagggauauauggcauucugcguuaagcacggucagucugugaaucucgccgcgguaagaaucuuuuuccuuaacgcugccaaagcaaaggccgcucuggcaaggaaaccugaaaagaaagccucaccaaaguuuggcgaguggcaaguggaaauugucaauaaccauuucccggggaaucggaacaaucccauaggaaacaaugacuugacaauccaccgcuuaaguggcuaccuggcucgaugggugcuagagcaguauaaggaaaacgaggaugagagccagcgugaacucauuaaaacuacgguuaucaauccuauugccgaguccaacggugugagaugggacucuggggcggaaaucuaccugucguuuuucccaggaaccgagauguuucuugagacauucaaguuuuauccccugacuauaggcaucuacagggucaaacagggcaugauggauccucaauauuugaagaaagcacuccggcagcgcuacgggacccugacagccgacaaguggaugucacagaaggugaccgcuauugccaaaagccugaaggaaguagagcagcucaaauggggaagagguggcuuaagugauacugcaaggacauuccugcaaaaguuugggauccggcuuccauga

SEQ ID NO: 6108 - RNA, 708 nt, Artificial Sequence
  derived and/or modified CDS sequence (opt3) from CHATV(LEIV-11552)__EU479702.1__N
augagcgaccugguguucuacgaugucgccuccaccggcgcuaacggguuugaccccgaugagggauauauggcauucugcguuaagcacggucagucugugaaucucgccgcgguaagaaucuuuuuccuuaacgcugccaaagcaaaggccgcucuggcaaggaaaccugaaaagaaagccucaccaaaguuuggcgaguggcaaguggaaauugucaauaaccauuucccggggaaucggaacaaucccauaggaaacaaugacuugacaauccaccgcuuaaguggcuaccuggcucgauggauucuagagcaguauaaggaaaacgaggaugagagccagcgugaacucaucaaaacuacggugauuaauccuaucgccgaguccaacgguguuagaugggacucuggggcggaaauauaccugucguuuuucccaggaaccgagauguuucuugagacauucaaguuuuauccccugacuaucggcauuuacagggugaaacagggcaugauggauccucaauauuugaagaaagcacuccggcagcgcuacgggacccugacagccgacaaguggaugucacagaaggucaccgcuaucgccaaaagccugaaggaaguggagcagcucaaauggggaagagguggcuuaagugauacugcaaggacauuccugcaaaaguuugggauucggcuuccauga

SEQ ID NO: 6109 - RNA, 708 nt, Artificial Sequence
  derived and/or modified CDS sequence (opt3) from CHATV(LEIV-13107)__FJ946829.1__N
augagcgaccugguguucuacgaugucgccuccaccggcgcuaacggguuugaccccgaugagggauauauggcauucugcguuaagcacggucagucugugaaucucgccgcgguaagaaucuuuuuccuuaacgcugccaaagcaaaggccgcucuggcaaggaaaccugaaaagaaagccaauccaaaguuuggcgaguggcaaguggaaauugucaacaaucauuucccggggaaccggaauaaccccauaggaaauaacgacuugacaauccaccgcuuaucaggcuaccuggcucgaugggugcuagagcaguauaaggaaaaugaggaugagagucagcgugaacucauuaaaacuacgguuaucaacccuauugccgagagcaauggugugagaugggacuccggggcggaagucuaccugucguuuuucccaggaaccgagauguuucuugagacauucaaguuuuauccccugacuaucggcauauacagggugaaacagggcaugauggauccucaauauuugaagaaagcacuccggcagcgcuacgggacccugacagccgacaaguggaugucucagaagguaaccgcuaucgccaaaucacugaaggaaguugagcagcucaaauggggaagagguggcuuaagcgauacugcaaggacauuccugcaaaaguuugggauucggcuuccauga

SEQ ID NO: 6110 - RNA, 708 nt, Artificial Sequence
  derived and/or modified CDS sequence (opt3) from CHATV(LEIV-17794)__FJ913879.1__N
augagcgaccugguguucuacgaugucgccuccaccggcgcuaacggguuugaccccgaugagggauauauggcauucugcguuaagcacggucagucugugaaucucgccgcgguaagaaucuuuuuccuuaacgcugccaaagcaaaggccgcucuggcaaggaaaccugaacggaaggccucaccaaaauuuggcgaguggcaaguggaaauugucaauaaccauuucccggggaaucgcaacaaucccauaggaaacaaugacuugacaauccaccgauuaaguggcuaccuggcucguugggugcuagagcaguauaaggaaaacgaggaugagagccagagagaacucauuaagacuacgguuaucaauccuauugccgaguccaacggugugaggugggacucuggggcggaaaucuaccugucguuuuucccaggaaccgagauguuucuugagacauucaaauuuuauccccugacuauaggcaucuaccgggucaagcagggcaugauggauccucaauauuugaaaaaggcacuccgccagagauacgggacccugacagccgacaaauggaugucacagaaggugaccgcuauugccaagagccugaaagaaguagagcagcucaaguggggaagggguggcuuaagugauacugcacggacauuccugcaaaaauuugggauccgccuuccauga

SEQ ID NO: 6111 - RNA, 708 nt, Artificial Sequence
  derived and/or modified CDS sequence (opt3) from CHATV(LEIV-17827)__GQ330475.1__N
augagcgaccugguguucuacgaugucgccuccaccggcgcuaacggguuugaccccgaugagggauauauggcauucugcguuaaguacggugaaucuaucaaucucgccgcggugagaauauuuuuccuuaacgcugccaaagcaaaggccgcucuggcaaggaaaccugagaagaaagccaauccaaaguuuggcgaauggcagguagagauugugaacaaucacuucccggggaaccggaauaaccccaucggaaauaacgacuugacaauucaucgcuuaucaggcuaucuggcucgauggguccuagaacaauacaaggagaaugaggaugaaagucagcgugagcucaucaaaacuacgauuaucaacccuauagccgaaagcaauggugugagaugggaguccggggcggagguuuaucugucguuuuucccaggaaccgaaauguuucuugagaucuucaaguuuuacccccugacaauuggcaucuauagggugaaacagggcaugauggacccucaguacuugaagaaagcacuccggcaacgcuacgggacucugaccgccgauaaguggaugucucagaaggucacagcuauugccaaaucacugaaggaaguggagcagcucaaauggggaagagguggcuuaagcgacaccgcaaggacuuuccugcagaaguuugggauccggcuuccauga

SEQ ID NO: 6112 - RNA, 708 nt, Artificial Sequence
  derived and/or modified CDS sequence (opt3) from CHATV(LEIV-17829)__GQ330476.1__N
augagcgaccugguguucuacgaugucgccuccaccggcgcuaacggguuugaccccgaugagggauauauggcauucugcguuaaguacggugaaucuaucaaucucgccgcggugagaauauuuuuccuuaacgcugccaaagcaaaggccgcucuggcaaggaaaccugagaagaaagccaauccaaaguuuggcgaauggcagguagagauugugaacaaucacuucccggggaaccggaauaaccccaucggaaauaacgacuugacaauucaucgcuuaucaggcuaucuggcucgauggguccuagaacaauacaaggagaaugaggaugaaagucagcgugagcucaucaaaacuacgauuaucaacccuauagccgaaagcaauggugugagaugggacuccggggcggagguuuaucugucguuuuucccaggaaccgagauguuucuugaaaucuucaaguuuuacccccugacaauuggcaucuauagggugaaacagggcaugauggauccucaguacuugaagaaagcacuccggcaacgcuacgggacucugaccgccgacaaguggaugucucagaaggucacagcuauugccaaaucacugaaggagguggaacagcucaaauggggaagagguggcuuaagcgauaccgcaaggacuuuccugcagaaguuugggauccggcuuccauga

SEQ ID NO: 6113 - RNA, 708 nt, Artificial Sequence
  derived and/or modified CDS sequence (opt3) from CHATV(LEIV-18733)__HQ734824.1__N
augagcgaccugguguucuacgaugucgccuccaccggcgcuaacggguuugaccccgaugagggauauauggcauucugcguuaaguacggugaaucuaucaaucucgccgcggugagaauauuuuuccuuaacgcugccaaagcaaaggccgcucuggcaaggaaaccugagaagaaagccaauccaaaguuuggcgaauggcagguagagauuaucaacaaucacuucccggggaaccggaauaaccccauuggaaauaacgacuugacaauccaucgcuuaucaggcuaucuggcucgaugggugcuagaacaauacaaggagaaugaggaugaaagucagcgugagcucauuaaaacuacgaucauaaacccuaucgccgaaagcaauggugucagaugggacuccggggcggagguguaucugucguuuuucccaggaaccgagauguuucuugaaauuuucaaguuuuacccccugacaaucggcauuuauaggguuaaacagggcaugauggauccucaguacuugaagaaagcacuccggcaacgcuacgggacucugaccgccgacaaguggaugucucagaaggugacagcuaucgccaaaucacugaaggaggucgaacagcucaaauggggaagagguggcuuaagcgauaccgcaaggacuuuccugcagaaguuugggauacggcuuccauga

SEQ ID NO: 6114 - RNA, 708 nt, Artificial Sequence
  derived and/or modified CDS sequence (opt3) from CHATV(LEIV-18895)__GQ330482.1__N
augagcgaccugguguucuacgaugucgccuccaccggcgcuaacggguuugaccccgaugagggauauauggcauucugcguuaaguacggugaaucuaucaaucucgccgcggugagaauauuuuuccuuaacgcugccaaagcaaaggccgcucuggcaaggaaaccugagcggaaggccaauccaaaauuuggcgaauggcagguagagauugugaacaaucacuucccggggaaccgcaauaaccccaucggaaauaacgacuugacaauucaucgauuaucaggcuaucuggcucguuggguccuagaacaauacaaggagaaugaggaugaaagucagagagagcucaucaagacuacgauuaucaacccuauagccgaaagcaauggugugaggugggacuccggggcggagguuuaucugucguuuuucccaggaaccgagauguuucuugaaaucuucaaauuuuacccccugacaauuggcaucuaucgggugaagcagggcuugauggauccucaguaccucaaaaaggcacugcgccaaagauacgggacucugaccgccgacaaauggaugucucagaaggucacagcuauugccaagucacucaaagagguggaacaguuaaaguggggaagggguggccugagcgauaccgcacggacuuuccuucagaaauuugggauccgcuugccauga

SEQ ID NO: 6115 - RNA, 708 nt, Artificial Sequence
  derived and/or modified CDS sequence (opt3) from CHATV(LEIV-22712)__HQ734825.1__N
augagcgaccugguguucuacgaugucgccuccaccggcgcuaacggguuugaccccgaugagggauauauggcauucugcguuaagcacggugaaucuaucaaucucgccgcggugagaauauuuuuccuuaacgcugccaaagcaaaggccgcucuggcaaggaaaccugagaagaaagccucaccaaaguuuggcgaauggcagguagagauuaucaauaaccauuucccggggaaucggaacaaucccauuggaaacaaugacuugacaauccaccgcuuaaguggcuaccuggcucgaugggugcuagaacaauauaaggagaacgaggaugaaagccagcgugagcucauuaaaacuacggucaucaauccuauagccgaauccaacggugugagaugggacucuggggcggagaucuaccugucguuuuucccaggaaccgagauguuucuugaaacauucaaguuuuauccccugacuauuggcaucuacaggguuaaacagggcaugauggauccucaguauuugaagaaagcacuccggcaacgcuacgggacccugacagccgacaaguggaugucacagaaggugaccgcuauugccaaaagccugaaggaggucgaacagcucaaauggggaagagguggcuuaagugauacugcaaggacauuccugcagaaguuugggauccggcuuccauga

SEQ ID NO: 6116 - RNA, 708 nt, Artificial Sequence
  derived and/or modified CDS sequence (opt3) from CHATV(LEIV-23500)__EU479701.1__N
augagcgaccugguguucuacgaugucgccuccaccggcgcuaacggguuugaccccgaugcaggauauauggccuucugcguuaagcacggugagucuaucaaucucgcggcugugagaauauuuuuccuuaacgccgcaaaagccaaggcugcacuggccaggaaaccugaaaagaaagcuaauccaaaguuuggcgaguggcagguagaaauugugaacaaucauuucccggggaaccggaauaaccccaucggaaauaacgacuugacaauucaccgcuuaucaggcuaccuggcccgauggguccuagagcaauauaaggaaaaugaggaugagagucagcgugaacucaucaaaacuacggugauuaacccuaucgcggagagcaaugguguuagaugggaaaacggggcagagguguaccuguccuuuuucccaggaaccgagauguuucuugaaacauucaaguuuuauccccugacuauaggcaucuacagggucaaacagggcaugauggacccucaguauuugaagaaagcccuccggcaacgcuacgggacccugacagcugauaaguggaugucucagaaggugaccgccauugcaaaaucgcugaaggagguagaacagcucaaauggggaagagguggcuuaucagacacugcuaggacauuccugcagaaguuugggauccggcuuccauga

SEQ ID NO: 6117 - RNA, 708 nt, Artificial Sequence
  derived and/or modified CDS sequence (opt3) from INKV__Z68496.1__N
augggcgaccugguguucuacgaugaggccagcaccggggcuaacggauuugaccccgaugcagguuucgucgccuuuauggcggaccacggcgaauccaucaaucucgcugccguuagaauuuucuuucuuaacgcagccaaggcuaaagcagcccuggcuaggaagccugagcggaaagccacaccaaaguucggggaauggcaaguggagauaguaaauaaccauuuuccgggaaaucgcaacaaucccaucggcaacaaugauuugacuauucaccgauuaucugguuaucuggcgcguugggugcuagaacauuucacggaggacgaugacgagucacagagagaacucaucaggaguaccauuaucaacccuauagcagagagcaaugggauccacuggaacaauggaccagaaauuuaccuguccuuuuuccccggcacagagauguuucuugaggucuucaaauuuuauccucugacuaucggcauuuaccgggugaagcaugggaugauggauccacaguauuugaagaaagcccuccgccagagauacggaacccugacagcugaaaaguggauggcccagaaaaccguucugaucgcaaagucucucaaagacguggagcaauuaaagugggguaggggcgggcugucggaugcugcccggacuuuccuuauaaaguucggagucaaauugcccuga

SEQ ID NO: 6118 - RNA, 708 nt, Artificial Sequence
  derived and/or modified CDS sequence (opt3) from INKV(KN3641)__U47137.1__N
augggcgaccugguguucuacgaugucgccagcaccggggcuaacggauuugaccccgaugcagguuucguugccuuuauggcggaccacggcgaguccaucaaucucgcugccgugagaauuuucuuucuuaacgcagccaaggcuaaagcagcccuggcuaggaagccugaacggaaagccacaccaaaguucggggaguggcagguagaaauagugaauaaccauuuuccgggaaaucgcaacaaucccaucggcaacaaugauuugacuauucaccgauuaucugguuaucuggcgcguuggguccuagagcauuucacggaagacgaugacgagucacaaagagagcucaucaggaguaccauuaucaacccuauagcagaaagcaaugggauccacuggaacaauggaccagagauuuaccuguccuuuuuccccggcacagaaauguuucuugagguguucaaauuuuauccucugacuaucggcauuuaccggguuaagcaugggaugauggauccacaguauuugaagaaagcccuccgccagagauacggaacccugacagcugagaaguggauggcccagaaaaccgugcugaucgcaaagucucucaaagacgucgaacaauuaaagugggguaggggcgggcugucggaugcugcccggacuuuccuuauaaaguucggagugaaauugcccuga

SEQ ID NO: 6119 - RNA, 708 nt, Artificial Sequence
  derived and/or modified CDS sequence (opt3) from INKV(Lovanger)__KU302751.1__N
augggcgaccugguguucuacgaugucgccagcaccggggcuaacggauuugaccccgaugcagguuucguugccuuuauggcggaccacggcgaguccaucaaucucgcugccgugagaauuuucuuucuuaacgcagccaaggcuaaagcagcccuggcuaggaagccugaacggaaagccacaccaaaguucggggaguggcagguagaaauagugaauaaccauuuuccgggaaaucgcaacaaucccaucggcaacaaugauuugacuauucaccgauuaucugguuaucuggcgcguuggguccuagagcauuucacggaagacgaugacgagucacaaagagagcucaucaggaguaccauuaucaacccuauagcagaaagcaaugggauccacuggaacaauggaccagagauuuaccuguccuuuuuccccggcacagaaauguuucuugagguguucaaauuuuauccucugacuaucggcauuuaccggguuaagcaugggaugauggauccacaguauuugaagaaagcccuccgccagagauacggaacccugacagcugagaaguggaugacccagaaaacugugcugaucgccaagucucucaaagacgucgaacaauuaaagugggguaggggcgggcugucggaugcagcucggacauuccuuauaaaguucggagugaaauugcccuga

SEQ ID NO: 6120 - RNA, 708 nt, Artificial Sequence
  derived and/or modified CDS sequence (opt3) from INKV(SW AR 83-161)__U47138.1__N
augggcgaccugguguucuacgaugucgccagcacuggggcuaacggauuugaccccgaugcagguuucguugccuuuauggcggaccacggcgaguccaucaaucucgcugccgugagaauuuucuuucuuaacgcagccaaggcuaaagcagcccuggcuaggaagccugaacggaaagccacaccaaaguucggggaguggcagguagaaauagugaauaaccauuuuccgggaaaucgcaacaaucccaucggcaacaaugauuugacuauucaccgauuaucugguuaucuggcgcguuggguccuagagcauuucacggaagacgaugacgagucacaaagagagcucaucaggaguaccauuaucaacccuauagcagaaagcaaugggauccacuggaacaauggaccagagauuuaccuguccuuucuucccggcacagaaauguuccuggagguguuuaaauucuauccuuugacuaucggcauuuaccggguuaagcaugggaugauggauccacaguaucucaagaaagcccugcgccagagauacggaacccugacagcugagaaguggauggcccagaaaaccgugcucaucgcaaagucuuuaaaagacgucgaacaacugaagugggguaggggcgggcuuucggaugcugcccggaccuuuuugauaaaguucggagugaaacugcccuga

SEQ ID NO: 6121 - RNA, 708 nt, Artificial Sequence
  derived and/or modified CDS sequence (opt3) from LUMV__X73468.1__N
augagcgaccugguguucuacgaugucgccuccaccggcgcuaacggguuugaccccgaugcaggauauguugacuucugcgugaagcacggugagucuaucaaucuccauucaguaagaauauuuuuccuuaacgccgcgaaagcuaaggccgcacuggccaggaaaccugaacggaaggcuaguccaaaauuuggcgaguggcaaguggaaauugucaauaaccacuucccggggaaucgcaacaaucccaucgauaacaaugacuugacaauucaucgauuaagcggauaccuggcacguugggugcuagagcaguuuaaggaaaacgaggaugccgcucagagagagcucaucaagacuacgguuauuaauccuaucgccgaauccaacggcauaaggugggacaauggugcggagaucuaucuggcauucuuuccagggaccgaaauguuccuugagacauuuaacuucuacccccugacuauuggaaucuaucgggugaaacacggcaugauggauccucaguacuugaagaaagcccuccgcagaagguauggcucucugaccgcugacaaguggaugucgcagaaaacagucgccauugcaaagucacugaaggauguggagcaacucaaaugggggcggggagguuuaagcgacaccgcucgcguauuucugcagaaguucggcaucaaacuuccauga

SEQ ID NO: 6122 - RNA, 708 nt, Artificial Sequence
  derived and/or modified CDS sequence (opt3) from LUMV(SAAr 1881)__KX817326.1__N
augagcgaccugguguucuacgaugucgccuccaccggcgcuaacggguuugaccccgaugcaggauauguugacuucugcgugaagcacggugagucuaucaaucuccauucaguaagaauauuuuuccuuaacgccgcgaaagcuaaggccgcacuggccaggaaaccugaacggaaggcuaguccaaaauuuggcgaguggcaaguggaaauugucaauaaccacuucccggggaaucgcaacaaucccaucgauaacaaugacuugacaauucaucgauuaagcggauaccuggcacguugggugcuagagcaauuuaaggaaaacgaggaugccgcucagagagagcucaucaagacuacgguuauuaauccuaucgccgaauccaacggcauaaggugggacaauggugcggagaucuaucuggcauucuuuccagggaccgaaauguuccuugagacauuuaacuucuacccccugacuauuggaaucuaucgggugaaacacggcaugauggauccucaguacuugaagaaagcccuccgccagagauauggcucucugaccgcugacaaguggaugucgcagaaaacagucgccauugcaaagucacugaaggauguggagcagcucaaaugggggaggggagguuuaagcgacaccgcucggguauuucugcagaaguucggcaucaaacuuccauga

SEQ ID NO: 6123 - RNA, 708 nt, Artificial Sequence
  derived and/or modified CDS sequence (opt3) from MELV(TRVL 9375)__KX817329.1__N
augggcgaccugaucuucuacgauguggccagcaccggggcuaacggauuugaccccgaugcagguuaucucgccuucacaauugcgcacggcgaggcuauaaaucuuuccgccgucagaaucuuuuuccugaacgcagccaaggcuaaagcagccuugucuaggaagccugaacggaaagcuacuccaaaguuuggggacuggcagguugagauugugaauaaccauuucccgggaaaucgcaacaaucccaucggcaacaaugauuuaacgauucaccgacugucagguuaccuagcccguuggguacucgaccuguuuaaagaaaacgaggaugaaagucaaaaggagcuuauccagagcaccauaaucaauccuauugcggaguccaacgggauccauugggcaaauggaguggaaauuuaucugucuuucuuuccaggcacagagauguucuuggaagccuuuagauucuacccccucacuaucggcauauauagggucaagcacgggcugauggacccucaguaccugaaaaaggcucuccggcagcgcuauggaaccuuaacagccgauaaauggauggcacaaaagaccacuaugauugcuaaaucgcugaaggacguggagcagcuuaagugggguaaaggcggguugucagaugccgcgagaacauuucugcagaaguucggaguuaggcuaccauga

SEQ ID NO: 6124 - RNA, 708 nt, Artificial Sequence
  derived and/or modified CDS sequence (opt3) from MBV__U31989.1__N
augagcgaccugguguucuacgaugucgccuccaccggcgcuaacggguuugaccccgaugcaggauauguugacuucugcgccaagcacggugagucuaucaaucucgcggcugugagaauauuuuuccuuaacgccgcaaaagccaaggcugcacugucaaggaaaccugaacggaaggccaauccaaaauuuggcgaguggcagguagaaauugugaacaaucauuucccggcuaaccgcaauaaccccaucgggaauaacgauuugacaauucaccgaaucaguggauacuuagcccguuggguccuggagcaauauagagaaaaugaggacgagagccagagggagcuagugaagacuacgguuauuaacccuaucgcggaauccaauggcauacggugggaaaacgguccagagaucuaccucgcauuuuuccccgggaccgagauguuucuggaaacauucaaguuuuauccucuuacuauuggaaucuaccgcgugaaacauggcaugauggauccacaguaucugaagaaagccuugagacagagguacggcucucucaccgcugagaaguggaugucgcagaaaacagggaugauugccaagucacugaaggaagucgagcaacugaaauggggacgggguggccucagcgacaccgcacgcacuuucuuacagaaguuugggauccgacugcccuga

SEQ ID NO: 6125 - RNA, 708 nt, Artificial Sequence
  derived and/or modified CDS sequence (opt3) from SAV(VR723)__U47139.1__N
augagcgagcugguguucuacgacgucgccuccaccggcgcuaacggguuugaucccgacgcaggauaucucgccuucugcguuaagcacggugaaucuaucucacuuaguagcgugagaauauuuuuccugaaugcggcuaaagccaaggcagccuuguccaggaaaccugagcggaaggcuaacccaaaauuuggcgaauggcagguagagauugugaauaaccauuucccggggaaucgcaacaaucccaucgauaacuuagaccugacaauucaccgacuaucuggauaccucgcacguuggguccuggaacaauuuaucgagaaugaggaugaaucgcagagagagcuuauuaagacuacggugaucaacccuauagccgaaucaaauggcaucaagugggagaacggugcugagauuuaucugagcuucuuuccagggaccgaaauguucuuggagaucuuuaaauucuacccccucacaauuggaaucuauaggguuaagcagggcaugauggacccucaguaccugaaaaaggcccugcggcaacgcuauggcagucucacugcggauaaauggaugucccagaaggugggggcaauagccaagucuuuaaaagacauugaacagcugaaguggggaaaagguggccuuagcgauaccgcuagaacauuuuugcagaaguucgggaucaaacugccauga

SEQ ID NO: 6126 - RNA, 708 nt, Artificial Sequence
  derived and/or modified CDS sequence (opt3) from SDNV(BeAr 103645)__U47140.1__N
augggcgaccugguguucuacgaugucgccagcaccggggcuaacggauuugaccccgaugcagguuucguugccuuuauggcgggccacggggaguccaucaaucucacagcugugagaauuuucuuucuuaacgccgcaaaggccaaagcugcacugucuaggaagccugaacggaaagccacuccaaaguucggagacuggcagguagagauagugaauaaccauuuuccgggcaaucgcaacaaucccaucgguaacaaugauuugacgauucaccgaaucucaggguauuuagcucguuggacccuggaacauuucagagagggaggcgacgaagcccaaaaagagcuaauuaggacaacuaucauaaacccuaucgcggagaguaauggcauucacugggcaaacggggccgaaaucuaccucagcuuuuucccaggaaccgagauguuucuggaggcuuucaaguuuuauccccuuacaauugguaucuaccgggucaagcauggcaugauggaugcccaguaucugaaaaaggcauugcgccagagauacgggacccucacugcugacgaauggauggcccagaaaacagugcugauaaccaagucccugaaagauguugagcaacucaaguggggaaggggcgguuuaucugacgcggcccggacguuccugucgaaguucggggugaaacuuccuuga

SEQ ID NO: 6127 - RNA, 708 nt, Artificial Sequence
  derived and/or modified CDS sequence (opt3) from SDNV(BeAr 103645)__KX817335.1__N
augggcgaccugguguucuacgaugucgccagcaccggggcuaacggauuugaccccgaugcagguuucguugccuuuauggcgggccacggggaguccaucaaucucacagcugugagaauuuucuuucuuaacgccgcaaaggccaaggcugcacugucuaggaagccugaacggaaagccacuccaaaguucggagacuggcagguagagauagugaauaaccauuuuccgggcaaucgcaacaaucccaucgguaacaaugauuugacgauucaccgaaucucaggguauuuagcucguuggacccuggaacauuucagagagggagaagacgaggcccaaaaagagcuaauuaggacaacuaucauaaacccuaucgcggaaaguaauggcauucacugggcaaacggcgccgagaucuaccucagcuuuuucccagggaccgaaauguuucuggaggcuuucaaguuuuauccccuuacaauuggaaucuaccgggucaagcaugguaugauggaugcccaguaucugaaaaaggcauugcgccagagauacggcacccucacugcugacaaauggauggcccagaagacagugcugauaaccaaaucccugaaggauguugagcaacucaagugggggaggggaggcuuaucugacgcggcccggacguuccugucgaaauucggugugaaacuuccuuga

SEQ ID NO: 6128 - RNA, 708 nt, Artificial Sequence
  derived and/or modified CDS sequence (opt3) from SSHV__EU294510.1__N
augagcgaccugguguucuacgaugucgccuccaccggcgcuaacggguuugaccccgaugcaggauauauggccuucugcguuaaguacgcggagucugugaaucucgcugccguaagaaucuuuuuccuuaacgcagccaaagcuaaggcagcccugucaaggaaaccugaacggaaggcuaauccaaaauuuggugaguggcaaguggaagucgugaacaaucacuucccgggcaaccgcaauaaccccauuaauagugacgauuugacaauacaucgauuaagcggguaucuggcccguuggguucuagagcaguacaaggaaaacgaggacgaguccagaagggaacucaucaagacuacgauuaucaauccuauugcggagucuaacggagugcggugggauucgggcgcagaaaucuaucugucauuuuucccagguaccgagauguuucuugagacauucaaauuuuacccccugacuauagggaucuaucgcgucaagcagggaaugauggacccucaguacuugaaaaaggcccucagacagagguacggcagccugaccgcugauaaauggaugagucaaaaggugacagccauugcaaagucccugaaagaaguagagcagcucaaguggggccgcgggggauuaucugacaccgcucggagcuuccugcagaaauuugguauccgacuuccauga

SEQ ID NO: 6129 - RNA, 708 nt, Artificial Sequence
  derived and/or modified CDS sequence (opt3) from SSHV(F10838)__KM215563.1__N
augagcgaccugguguucuacgaugucgccuccaccggcgcuaacggguuugaccccgaugcaggauauauggccuucugcguuaaguacgcggagucugugaaucucgcugccguaagaaucuuuuuccuuaacgcagccaaagcuaaggcagcccugucaaggaaaccugaacggaaggcuaauccaaaauuuggugaguggcaaguggaagucgugaacaaucacuucccgggcaaccgcaauaaccccauuaauagugacgauuugacaauacaucgauuaagcggguaucuggcccguuggguucuagagcaguacaaggaaaacgaggacgaguccagaagggaacucaucaagacuacgauuaucaauccuauugcggagucuaacggagugcggugggauucgggcgcagaaaucuaucugucauuuuucccagguaccgagauguuucuugagacauucaaauuuuacccccugacuauagggaucuaucgcgucaagcagggaaugauggacccucaguacuugaaaaaggcccucagacagagguacggcagccugaccgcugauaaauggaugagucaaaaggugacagccauugcaaagucccugaaagaaguagagcagcucaaguggggccgcgggggauuaucugacaccgcucggagccugcuucagaaauucgguauccgauugccauga

SEQ ID NO: 6130 - RNA, 708 nt, Artificial Sequence
  derived and/or modified CDS sequence (opt3) from SORV(SORV-252)__GU018050.2__N
augggcgaccugguguucuacgaugucgccagcaccggggcuaacggauuugaccccgaugcagguuucguugccuuuauggcggaccacggcgaguccaucucucucucagcugugagaauuuucuuucuuaaugccgcaaaggccaaagcugcacuggccaggaagccugaacggaaagcuaacccaaaguucggggaguggcagguagaaauagugaauaaccauuuuccgggaaaucgcaacaaucccaucggcaacaaugauuugacaauucaccgauuaagugguuaucuggcccguuggguccuagagcauuucacugaagacgaggaugagagccaaagagaacucaucagguccacgauuaucaacccuauagcggagucuaaugggauccgguggaacaauggaccagaaauuuaccugucguuuuuccccggcaccgagauguuucuugaggcauucaaauuuuauccucugacaaucggcauuuaccgcgugaagcacggguugauggacccacaguaucucaagaaagcccugagacagagguacggaacucugaccgcugaaaaguggauggcccagaaaacaguucucaucgcaaagucauuaaaagauguggagcaacugaaguggggucggggcgggcuuagcgacgcugcccgcaccuucuugauaaaguucggagucaaacugcccuga

SEQ ID NO: 6131 - RNA, 708 nt, Artificial Sequence
  derived and/or modified CDS sequence (opt3) from SORV(NJO 94F)__U47141.1__N
augggcgaccugguguucuacgaugucgccagcaccggggcuaacggauuugaccccgaugcagguuucguugccuuuauggcggaccacggcgaguccaucaaucucucugcugugagaauuuucuuucuuaacgccgcaaaggccaaagcugcacuggccaggaagccugaacggaaagcuaauccaaaguucggggaguggcagguagaaauagugaacaaucauuuuccgggaaaccgcaauaaccccaucggcaauaacgauuugacaauucaccgauuaucagguuaucuggcccguuggguccuagagcauuucacugaagacgaggaugagagucaaagagaacucaucaggagcacgauuaucaauccuauagcggaguccaacgggauccacuggaauaacggaccagaaauuuaccugucguuuuuccccggcaccgagauguuucuugaggcauucaaauuuuauccucugacaaucggcauuuaccgggugaagcaugggaugauggacccacaguauuugaagaaagcccuccgccagagauacggaacucugaccgcugaaaaguggauggcccagaaaacaguucugaucgcaaagucucucaaagauguggagcaauuaaagugggguaggggcgggcugucagacgcugcccggaccuuccuuauaaaguucggagucaaauugcccuga

SEQ ID NO: 6132 - RNA, 708 nt, Artificial Sequence
  derived and/or modified CDS sequence (opt3) from SORV(NJO-94F)__KX817338.1__N
augggcgaccugguguucuacgaugucgccagcaccggggcuaacggauuugaccccgaugcagguuucguugccuuuauggcggaccacggcgaguccaucaaucucucugcugugagaauuuucuuucuuaacgccgcaaaggccaaagcugcacuggccaggaagccugaacggaaagcuaauccaaaguucggggaguggcagguagaaauagugaacaaucauuuuccgggaaaccgcaauaaccccaucggcaauaacgauuugacaauucaccgauuaucagguuaucuggcccguuggguccuagagcauuucacugaagacgaggaugagagucaaagagaacucaucaggagcacgauuaucaauccuauagcggaguccaacgggauccacuggaauaacggaccagaaauuuaccugucguuuuuccccggcaccgagauguuucuugaggcauucaaauuuuauccucugacaaucggcauuuaccgggugaagcauggguugauggacccacaguaucucaagaaagcccugcgccagagauacggaacucugaccgcugaaaaguggauggcccagaaaacaguucucaucgcaaagucuuuaaaagauguggagcaacugaagugggguaggggcgggcuuucagacgcugcccggaccuucuugauaaaguucggagucaaacugcccuga

SEQ ID NO: 6133 - RNA, 708 nt, Artificial Sequence
  derived and/or modified CDS sequence (opt3) from TAHV__Z68497.1__N
augagcgaccugguguucuacgaugucgccuccaccggcgcuaacggguuugaccccgaugcaggauauguugacuucugcaucaagcacggugaggccauuaaucuccauucugugagaauauuuuuccuuaacgcggcuaaagccaaggcagcccuggcuaggaaaccugaacggaaggcaucaccaaaauuuggcgaguggcagguagaaguggucaauuaccacuucccggggaaccgcaauaaccccaucgauaauaacgacuugacaauucaucgauuauauggauaccuggcccguugggugcuagagcaauuuaaggaaaaugaggaugcugcccagagagagcucaucaagacuacgguuauuaacccuaucgcggaaaguaauggcauaaggugggacaacggugcagagaucuaucuggccuucuuuccagggaccgaaauguuccuugagacauuuaauuucuacccccugacuauuggaaucuaucgggugaaacagggcaugauggauccucaguacuugaagaaagcucuccgccaaagauacggcagccugaccgccgacaaguggaugucccagaaaacaaccgcaauugcuaagucucugaaggaugucgagcagcucaaaugggggaggggagguuuaucggacacugcccggacauuucugcagaaguucggcauccgccuuccauga

SEQ ID NO: 6134 - RNA, 708 nt, Artificial Sequence
  derived and/or modified CDS sequence (opt3) from TAHV(22595-6)__HM036217.1__N
augagcgaccugguguucuacgaugucgccuccaccggcgcuaacggguuugaccccgaugcaggauauguugacuucugcaucaagcacggugaggccauuaaucuccauucugugagaauauuuuuccuuaacgcggcuaaagccaaggcagcccuggcuaggaaaccugaacggaaggcaucaccaaaauuuggcgaguggcagguagaaguggucaauaaccacuucccggggaaucgcaacaaucccaucgauaacaaugacuugacaauucaucgauuaaguggauaccuggcccguugggugcuagagcaauuuaaggaaaacgaggaugcugcccagagagagcucaucaagacuacgguuauuaauccuaucgcggaaagcaacggcauaaggugggacaauggugcagagaucuaucuggccuucuuuccagggaccgaaauguuccuugagacauuuaacuucuacccccugacuauuggaaucuaucgggugaaacagggcaugauggauccucaguacuugaagaaagcucuccgccaaagauauggcucccugaccgccgacaaguggaugucucagaaaacaaccgcaauugcuaagucgcugaaggaugucgagcagcucaaaugggggaggggagguuuaucagacacugcccggacauuucugcagaaguucggcauccgccuuccauga

SEQ ID NO: 6135 - RNA, 708 nt, Artificial Sequence
  derived and/or modified CDS sequence (opt3) from TAHV(NM08003)__HQ541823.1__N
augagcgaccugguguucuacgaugucgccuccaccggcgcuaacggguuugaccccgaugcaggauauguugacuucugcaucaagcacggugaggccauuaaucuccauucugugagaauauuuuuccuuaacgcggcuaaagccaaggcagcccuggcuaggaaaccugaacggaaggcaucaccaaaauuuggcgaguggcagguagaaguggucaauaaccacuucccggggaaucgcaacaaucccaucgauaacaaugacuugacaauucaucgauuaaguggauaccuggcccguugggugcuagagcaauuuaaggaaaacgaugacgcugcccagagagagcucaucaagacuacgguuauuaauccuaucgcggagagcaacggcauaaggugggauaauggugcagaaaucuaucuggccuucuuuccagggaccgagauguuccuugaaacauuuaacuucuacccccugacuauuggaaucuaucgggugaaacagggcaugauggacccucaguacuugaagaaagcucuccgccaaagauauggcucccugaccgccgauaaguggaugucucagaaaacaaccgcaauugcuaagucgcugaaggacgucgagcagcucaaaugggggaggggagguuuaucagauacugcccggacauuucugcagaaguucggcauccgccuuccauga

SEQ ID NO: 6136 - RNA, 708 nt, Artificial Sequence
  derived and/or modified CDS sequence (opt3) from TAHV(XJ0625)__EU622820.2__N
augagcgaccugguguucuacgaugucgccuccaccggcgcuaacggguuugaccccgaugcaggauauguugacuucugcgugaaguacggugaggccaucaaucuccacucuguaagaauauuuuuccuuaacgcggcuaaagccaaggcagcccuggcuaggaaaccugaacggaaggcaucaccaaaauuuggcgaguggcaaguggaagucgugaauaaccauuucccggggaaucgcaacaaucccauugauaacaaugacuugacaauccaccgauuaaguggauaucuggcccguuggguucuagagcaguuuaaggaaaacgaggaugcugcccagagagagcucauuaagacuacggugaucaauccuauugcggaaagcaacggcaucaggugggacaauggugcagagauauaccuggccuucuuuccagggaccgaaauguuccuugagacauuuaacuucuauccccugacuaucggaauuuaccgggucaaacagggcaugauggauccucaguauuugaagaaagcucuccgccaaagauacggcccacugaccgccgacaaguggaugucccagaaaacaguggcaaucgcuaagucucugaaggauguagagcagcucaaaugggggaggggagguuuaucggacaccgcccggacuuuucugcagaaguucggcauucgccuucccuga

SEQ ID NO: 6137 - RNA, 708 nt, Artificial Sequence
  derived and/or modified CDS sequence (opt3) from TAHV(XJ0708)__HM243139.1__N
augagcgaccugguguucuacgaugucgccuccaccggcgcuaacggguuugaccccgaugcaggauauguugacuucugcgccaaguacggugaggcgaucaaucuccacucugugagaauauuuuuccuuaacgcugccaaagcaaaggccgcucuggcaaggaaaccugaacggaaggccucaccaaaauuuggcgaguggcagguagaaguggucaauaaccauuucccggggaaucgcaacaaucccauugauaacaaugacuugacaauccaccgauuaaguggauaucuggcucguugggugcuagagcaauuuaaggaaaacgaggaugccgcgcagagagagcucauuaagacuacgguuaucaauccuauugcagaaagcaacggcaucaggugggacaauggugccgagauauaccuggcuuucuuuccagggaccgaaauguuccuugagacauuuaacuucuauccccugacuaucggaauuuaccgggugaaacagggcaugauggauccucaguauuugaagaaagcccuccgccaaagauacggcccacugaccgcagacaaguggaugucccagaaaacagucgcuaucgccaagucucugaaggauguggagcagcucaaaugggggaggggagguuuaucggacaccgcgcggacuuuucugcagaaguucggcauucgccuucccuga

SEQ ID NO: 6138 - RNA, 708 nt, Artificial Sequence
  derived and/or modified CDS sequence (opt3) from TVTV(AR42)__KX891323.1__N
augagcgagcugguguucuacgacgcccccuccaccggcgcuaacggguuugauccugacgcaggauaugucgccuucaucgcggcucacgccgguucuuacgaucucucagcaguuagaauauuuuuccuuaaugccgcuaaggccaaaaacgcacugaguaggaagccagaaggcaaagugagcauuaaguuuggggagugguccguagaaguggucaauaaccauuucccgggaaaucggaacaaucccaucggcaacaaugacuugacaauucaccgcaucucugguuauuuagcucgaugggugcuggaggaauuuaaagggcaggaugacgaggcccaaaaggauauuauccguucgacuauaguuaacccuaucgcggagucaaauggcauucauugggacagcggagcagaugccuaccuaaguuucuuuccaggcacggaaauguuccucgaguccuuugacuuccugccccuugcuaucgggauuuauagagugaagaacggaaugauggauguccaguaccugaaaaaggccuugaggcagcgguaugguaccaugacagcagacaaauggaugucuacuaagaccacagugaucgcuaaaacccucaagcgcguagagagcuuuaaguggggcaaagggggacuguccgaagccgcgagagccuuccugucaaaguucaauguuaaaauaccuuga

SEQ ID NO: 6139 - RNA, 708 nt, Artificial Sequence
  derived and/or modified CDS sequence (opt3) from TVTV(ND3374)__KM215564.1__N
augagcgagcugguguucuacgacgcccccuccaccggcgcuaacggguuugauccugacgcaggauaugucgccuucaucgcggcucacgccgguucuuacgaucucucagcaguuagaauauuuuuccuuaaugccgcuaaggcaaagaacgcccugaguaggcggccagaaggcaaggugagcauuaaauuuggggagugguccguagaaguggucaauaaccauuucccgggaaaucgcaacaaucccaucggcaacaaugacuugacaauucaccgaaucucugguuauuuagcucguugggugcuggaggaauuuaaggggcaggaugacgaggcccaaaaagauauuaucagaucgacuauaguuaacccuaucgcggagucaaauggcauucauugggacagcggagcagaugccuaccuaaguuucuuuccaggcacggaaauguuccucgaguccuuugacuuccugccccuugcuaucgggauuuauagggugaagaacggaaugauggauguccaguaccugaagaaagccuugcggcagcgcuaugguaccaugacagcagacaaguggaugucuacuaaaaccacagugaucgcuaagacccucaaaagaguagagagcuuuaaguggggcaaagggggacuguccgaagccgcgagggccuuccugucaaaauucaauguuaagauaccuuga

SEQ ID NO: 6140 - RNA, 708 nt, Artificial Sequence
  derived and/or modified CDS sequence (opt3) from JCV(3324-04)__HM007356.1__N
augggcgaccugguguucuacgaugucgccagcaccggggcuaacggauuugaccccgaugcagguuucguugccuuuauggcggaccacggcgaguccgugucucucucagcuguaagaaucuucuuucuuaaugccgcaaaggccaaagcugcacuggccaggaagccugaacggaaagcuacaccaaaguucggggaguggcaaguggaaauugucaacaaucauuuuccgggaaaccgcaauaaccccauaggcaauaacgauuugacuauccaccgauuaagugguuaucuggcccguugggugcuagagcauuucacgaccgacgaugacgaaagccagagagagcucauuagguccacaaucauuaauccuaucgcggagucuaacgggauacacuggaauaacggaccagaaaucuaccugucguuuuuccccggcacugagauguuucuugaaauuuucaaauuuuauccucugaccaucggcauuuaccggguuaagcaugggaugauggauccacaguauuugaagaaagcacuccgccagagauacggaacacugaccgccgagaaguggauggcucagaaaacugugcugaucgccaagucacucaaagacgucgagcaauuaaagugggguaggggcgggcugagcgaugcagcucggacauuccuuauaaaguucggagugaaauugcccuga

SEQ ID NO: 6141 - RNA, 708 nt, Artificial Sequence
  derived and/or modified CDS sequence (opt3) from JCV(61v2235)__U12796.1__N
augggcgaccugguguucuacgaugucgccagcaccggggcuaacggauuugaccccgaugcagguuucguugccuuuauggcggaccacggcgaguccaucaaucucucugcugugagaauuuucuuucuuaacgccgcaaaggccaaagcugcacuggccaggaagccugaacggaaagcuacaccaaaguucggggaguggcagguagaaauagugaauaaccauuuuucaggaaaucgcaacaauccgaucggcaacaaugauuugacuauucaccgauuaagugguuaucuggcccguuggguccuagagcauuucaacagcgacgaugacgaaucccaaagagagcucaucaggucuacgauuaucaaucccauagcggagucgaacgggauccacuggaauaacggaccugaaauuuaccugucauuuuucccaggcaccgagauguuucuugaaaucuucaaauuuuauccccugacaauuggcaucuaccgggugaagcaugggaugauggauccucaguauuugaagaaagcacuccgccagagauacggaacucugaccgccgagaaguggauggcucagaaaacaguucugauagccaagagccucaaagacguggagcaauuaaagugggguaggggcgggcugagugaugcagcucggaccuuccuuauuaaguucggagucaaauugccauga

SEQ ID NO: 6142 - RNA, 708 nt, Artificial Sequence
  derived and/or modified CDS sequence (opt3) from JCV(1064-03)__EF681816.1__N
augggcgaccugguguucuacgaugucgccagcaccggggcuaacggauuugaccccgaugcagguuucguugccuuuauggcggaccacggcgaggcuaucaaucucgccgcagugagaauuuucuuucuuaacgccgcuaaggcaaaagccgcucuggccaggaagccugaacggaaagcgacaccaaaguucggggaguggcagguagaaauagugaauaaccauuuuccgggaaaucgcaacaaucccaucggcaacaaugauuugacuauucaccgauuauccgguuaucuggcacguuggguccuagagcauuucacggaagacgaugacgagucucaaagagagcucaucaggucaaccauuaucaacccuauagccgaaaguaaugggauccacuggaacaauggaccagagauuuaccugagcuuuuuccccggcacagaaauguuucuugagguguucaaauuuuauccucugacuaucggcauuuaccggguuaagcaugggaugauggauccacaguauuugaagaaagcucuccgccagagauacggaacccugacagccgagaaguggauggcacagaaaaccgugcugaucgcuaagucccucaaagacgucgaacaauuaaagugggguaggggcgggcugucugaugccgcgcggacuuuccuuauaaaguucggagugaaauugcccuga

SEQ ID NO: 6143 - RNA, 708 nt, Artificial Sequence
  derived and/or modified CDS sequence (opt3) from JCV(33909)__EF681853.1__N
augggcgaccugguguucuacgaugucgccagcaccggggcuaacggauuugaccccgaugcagguuucguugccuuuauggcggaccacggcgaggugaucaaucucgcugccguaagaauuuucuuucuuaacgcagccaaggcuaaagcagcccuggcuaggaagccugaacggaaagccacaccaaaguucggggaguggcaaguggaaauagucaauaaccauuuuccgggaaaucgcaacaaucccaucggcaacaaugauuugacuauucaccgauuauccgguuaucuggcgcguugggugcuagagcauuucacggaagacgaugacgagucucagagagagcucaucaggucaaccauuaucaacccuauagcagaaaguaaugggauccacuggaacaauggaccagagauuuaccugagcuuuuuccccggcacagaaauguuucuugagguuuucaaauuuuauccucugacuaucggcauuuaccgggugaagcaugggaugauggauccacaguauuugaagaaagcccuccgccagagauacggaacccugacagcugagaaguggauggcccagaaaaccguccugaucgcaaagucccucaaagacguggaacaauuaaagugggguaggggcgggcugucugaugcugcccggacuuuccuuauaaaguucggaguaaaauugcccuga

SEQ ID NO: 6144 - RNA, 708 nt, Artificial Sequence
  derived and/or modified CDS sequence (opt3) from JCV(2179-00)__EF681808.1__N
augggcgaccugguguucuacgaugucgccagcaccggggcuaacggauuugaccccgaugcagguuucguugccuuuauggcggaccacggcgaguccgugucucucucagcuguaagaaucuucuuucuuaaugccgcaaaggccaaagcugcacuggccaggaagccugaacggaaagcuacaccaaaguucggggaguggcaaguggaaauugucaacaaucauuuuccgggaaaccgcaauaaccccauaggcaauaacgauuugacuauccaccgauuaagugguuaucuggcccguugggugcuagagcauuucacgaccgacgaugacgaaagccagagagagcucauuagguccacaaucauuaauccuaucgcggagucuaacgggauacacuggaauaacggaccagaaaucuaccugucguuuuuccccggcacugagauguuucuugaaauuuucaaauuuuauccucugaccaucggcauuuaccggguuaagcaugggaugauggauccacaguauuugaagaaagcacuccgccagagauacggaauccugacagccgagaaguggauggcucagaaaaccgugcugauagccaagucacucaaagacgucgagcaauuaaagugggguaggggcgggcugagcgaugcagcucggacuuuccuuauuaaguucggagugaaauugcccuga

SEQ ID NO: 6145 - RNA, 708 nt, Artificial Sequence
  derived and/or modified CDS sequence (opt3) from JCV(2989-06)__EF681849.1__N
augggcgaccugaucuucuacgauguggccagcaccggggcuaacggauuugaccccgaugcagguuucgucgccuuuauggcggaccacggcgaguccguuucucucucagcugugagaauuuucuuucuuaaugccgcaaaggccaaagcugcacuggccaggaagccugaacggaaagcuacaccaaaguucggggaguggcagguagaaauagugaacaaucauuuuccgggaaaccgcaauaaccccaucggcaauaacgauuugacuauucaccgauuaagugguuaucuggcccguuggguccuagagcauuucacgaccgacgaugacgaaagccaaagagagcucaucagguccacaauuaucaauccuauagcggagucuaacgggauccacuggaauaacggaccagaaauuuaccugucguuuuuccccggcacugagauguuucuugaaaucuucaaauuuuauccucugaccauuggcaucuaccgggugaagcaugggaugauggauccacaguauuugaagaaagcacuccgccagagauacggaacacugaccgccgagaaguggauggcucagaaaacuguucugauagccaagucacucaaagacguggagcaauuaaagugggguaggggcgggcugagcgaugcagcucggacauuccuuauuaaguucggagucaaauugcccuga

SEQ ID NO: 6146 - RNA, 708 nt, Artificial Sequence
  derived and/or modified CDS sequence (opt3) from JCV(5592-02)__EF681804.1__N
augggcgaccugguguucuacgaugucgccagcaccggggcuaacggauuugaccccgaugcagguuucguugccuuuauggcggaccacggcgaguccgugucucucucagcuguaagaaucuucuuucuuaaugccgcaaaggccaaagcugcacuggccaggaagccugaacggaaagcuacaccaaaguucggggaguggcaaguggaaauugucaacaaucauuuuccgggaaaccgcaauagucccauaggcaacaaugauuugacuauccaccgauuaagcgguuaucuggcccguugggugcuagagcauuucacgaccgacgaugacgaaucccagagagagcucauuaggucuacaaucauuaacccuaucgcggagucgaaugggauacacuggaacaauggaccagaaaucuaccugucauuuuuccccggcacugagauguuucuugaaauuuucaaauuuuauccucugaccaucggcauuuaccggguuaagcaugggaugauggauccacaguauuugaagaaagcacuccgccagagauacggaacacugaccgccgagaaguggauggcucagaaaacugugcugaucgccaagagccucaaagacgucgagcaauuaaagugggguaggggcgggcugagugaugcagcucggacauuccuuauaaaguucggagugaaauugcccuga

SEQ ID NO: 6147 - RNA, 708 nt, Artificial Sequence
  derived and/or modified CDS sequence (opt3) from JCV(F5609)__KM215546.1__N
augggcgaccugguguucuacgaugucgccagcaccggggcuaacggauuugaccccgaugcagguuucguugccuuuauggcggaccacggcgaguccgugucucucucagcuguaagaaucuucuuucuuaaugccgcaaaggccaaagcugcacuggccaggaagccugaacggaaagcuacaccaaaguucggggaguggcaaguggaaauugucaacaaucauuuuccgggaaaccgcaauaaccccauaggcaauaacgauuugacuauccaccgauuaagugguuaucuggcccguugggugcuagagcauuucacgaccgacgaugacgaaagccagagagagcucauuagguccacaaucauuaauccuaucgcggagucuaacgggauacacuggaauaacggaccagaaaucuaccugucguuuuuccccggcacugagauguuucuugaaauuuucaaauuuuauccucugaccaucggcauuuaccggguuaagcaugggaugauggauccacaguauuugaagaaagcacuccgccagagauacggaacacugaccgccgagaaguggauggcucagaaaacugugcugaucgccaagucacucaaagacgucgagcaauuaaagugggguaggggcgggcugagcgaugcagcucggacauuccuuaccaaguucggagugaaauugcccuga

SEQ ID NO: 6148 - RNA, 708 nt, Artificial Sequence
  derived and/or modified CDS sequence (opt3) from JCV(F6577)__KM215557.1__N
augggcgaccugguguucuacgaugucgccagcaccggggcuaacggauuugaccccgaugcagguuucguugccuuuauggcggaccacggcgaguccgugucucucucagcuguaagaaucuucuuucuuaaugccgcaaaggccaaagcugcacugaguaggaagccugaacggaaagccacaccaaaguucggggaguggcaaguggaaauugucaacaaucauuuuccgggaaaccgcaauaaccccauaggcaauaacgauuugacuauccaccgauuaagcgguuaucuggcucguugggugcuagagcauuucacgaccgacgaugacgaaucccagagagagcucauuaggucuacaaucauuaauccuaucgccgagucgaacgggauacacuggaauaacggaccagaaaucuaccugucauuuuuccccggcacugagauguuucuugaaauuuucaaauuuuauccucugaccaucggcauuuaccggguuaagcaugggaugauggauccacaguauuugaagaaagcgcuccgccagagauacggaacacugaccgcagagaaguggauggcccagaaaacugugcugaucgcuaagagccucaaagacgucgagcaauuaaagugggguaggggcgggcugagugaugccgcacggacauuccuuauaaaguucggagugaaauugcccuga

SEQ ID NO: 6149 - RNA, 708 nt, Artificial Sequence
  derived and/or modified CDS sequence (opt3) from JCV(W13135)__KM215552.1__N
augggcgaccugguguucuacgaugucgccagcaccggggcuaacggauuugaccccgaugcagguuucguugccuuuauggcggaccacggcgaguccgugaaucucucugcuguaagaaucuucuuucuuaacgccgcaaaggccaaagcugcacuggccaggaagccugaacggaaagcuacaccaaaguucggggaguggcaaguggaaauugucaauaaccauuuuccgggaaaucgcaacaaucccauaggcaacaaugauuugacuauccaccgauuaucagguuaucuggcccguugggugcuagagcauuucacgaccgacgaugacgaaagucagagagagcucauuaggagcacaaucauuaacccuaucgcggaguccaaugggauacacuggaacaauggaccagaaaucuaccugucguuuuuccccggcacugagauguuucuugaaauuuucaaauuuuauccucugaccaucggcauuuaccggguuaagcaugggaugauggauccacaguauuugaagaaagcacuccgccagagauacggaacacugaccgccgagaaguggauggcucagaaaacugugcugaucgccaagucucucaaagacgucgagcaauuaaagugggguaggggcgggcugucagaugcagcucggacauuccuuauaaaguucggagugaaauugcccuga

SEQ ID NO: 6150 - RNA, 708 nt, Artificial Sequence
  derived and/or modified CDS sequence (opt3) from JCV(W18393)__KM215559.1__N
augggcgaccugguguucuacgaugucgccagcaccggggcuaacggauuugaccccgaugcagguuucguugccuuuauggcggaccacggcgaguccaucaaucucucugcugugagaauuuucuuucuuaacgccgcaaaggccaaagcugcacuggccaggaagccugaacggaaagcuacaccaaaguucggggaguggcagguagaaauaaucaauaaccauuuuccgggaaaucgcaacaaucccauuggcaacaaugauuugacuauccaccgauuaucagguuaucuggcccguugggugcuagagcauuucacggcggacgaugacgaaagucaaagagagcucauuaggagcaccaucauaaacccuaucgcagaguccaaugggauucacuggaacaauggaccagaaaucuaccugucguuuuuccccggcacagagauguuucuugaaauuuucaaauuuuauccucugacuaucggcauauaccgggucaagcaugggaugauggauccacaguauuugaagaaagcccuccgccagagauacggaacccugacagcugagaaguggauggcccagaaaaccgugcugauugcaaagucucucaaagacguugagcaauuaaagugggguaggggcgggcugucagaugcugcccggacuuuccuuaucaaguucggagugaaauugcccuga

SEQ ID NO: 6151 - RNA, 708 nt, Artificial Sequence
  derived and/or modified CDS sequence (opt3) from KEYV(KEYV/Ochlerotatus atlanticus/USA/KEYVLK01/2005)__KT630290.1__N
augggcgaccugguguucuacgaugucgccagcaccggggcuaacggauuugaccccgaugcagguuauguugccuucauggcgaaucacggcgaguccaucucucucucaacagugagaauauuuuuccuuaacgcugccaaggcaaaagccgcucugacuaggaagccugaacggaaagcaacgccaaaguuuggggaguggcagguagaaauugugaauaaccauuucccgggaaaucgcaacaaucccaucggcaacaaugacuugaccuuacaccgaauuagugguuaccuggcccguuggguccuagagcauuuuggggaaggagaggaugagagccaaaaagaacucaucaaguccacagugauuaacccuaucgcugagucuaauggcauaagauggggcaacgggguugaaaucuaucugucguucuuuccaggaacugagauguuccuugagcuguuuaaguucuaccccuugaccauugguaucuauagggugaaacacggcaugauggacgcccaguaccucaagaaagcgcugcggcagcgcuaugggacacugaccgcagauaaguggauggcccagaaaacuucaaugauuacaaagagccucaaggacgucgaacaauuaaaauggggaaagggcggucugagugauaccgcuagagccuuucuugcaaaauucggggugagguugccuuga

SEQ ID NO: 6152 - RNA, 708 nt, Artificial Sequence
  derived and/or modified CDS sequence (opt3) from KEYV(KEYV/Ochlerotatus atlanticus/USA/KEYVLK02/2005)__KT630293.1__N
augggcgaccugguguucuacgaugucgccagcaccggggcuaacggauuugaccccgaugcagguuauguugccuucauggcgaaucacggcgaguccaucucucucucaacagugagaauauuuuuccuuaacgcugccaaggcaaaagccgcucugacuaggaagagugaacggaaagcaacgccuaaguuuggggaguggcagguagaaauugugaauaaccauuucccaggaaaucgcaacaauccgaucggcaacaaugacuugaccuuacaccgaauuagcgguuaccuggcccguuggguccuagagcauuuuggggaaggagaggaugagucccaaaaagaacucaucaagucuacagugauuaaccccaucgcugagucgaauggcauaagauggggcaacgggguugaaaucuaucugucauucuuuccuggaacugagauguuccuugagcuguuuaaguucuacccauugaccauugguaucuauagggugaaacacggcaugauggacgcccaguaccucaagaaagcgcugcggcagcgcuaugggacacugaccgcagauaaguggauggcccagaaaacuagcaugauuacaaagagucucaaggacgucgaacaauuaaaauggggaaagggcggucuguccgauaccgcuagagccuuucuugcaaaauucggggugagguugcccuga

SEQ ID NO: 6153 - RNA, 708 nt, Artificial Sequence; identical to SEQ ID NO: 6151
  derived and/or modified CDS sequence (opt3) from KEYV(C14031-33)__U12801.1__N

SEQ ID NO: 6154 - RNA, 708 nt, Artificial Sequence
  derived and/or modified CDS sequence (opt3) from LACV(Human/78)__NC_004110.1__N
augagcgaccugguguucuacgaugucgccuccaccggcgcuaacggguuugaccccgaugcaggauauauggacuucugcguuaagaaugccgagcuccuuaaccuggcggcugugagaaucuuuuucuugaaugccgcaaaagccaaggcugcauuaucuaggaaaccugaacggaaggccaacccaaaauuuggugaguggcagguagaagugauuaauaaccacuucccgggcaaucgcaacaaucccauagggaacaaugaucugacaauccaucgacuaucaggauaccucgcucguuggguccuggaccaauauaacgagaaugaugacgaaagucagcacgagcuuauuagaacuacgaucauuaacccuaucgccgagagcaauggcguggguugggauuccgggccagaaauauaccugucguuuuuccccggaaccgagauguuuuuggaaacauucaaguuuuauccucucacuaucggcauucauaggguuaagcagggcaugauggacccacaguaccugaaaaaggcgcugcggcaacgcuaugggacccucacagcagauaaauggaugucucagaagguggccgcuaucgccaaaucauuaaaggacgucgagcagcugaaguggggaaaagguggccuuagcgauaccgcaaagacuuucuugcagaaauuugggauuagacugcccuga

SEQ ID NO: 6155 - RNA, 708 nt, Artificial Sequence
  derived and/or modified CDS sequence (opt3) from LACV__KP271107.1__N
augagcgaccugguguucuacgaugucgccuccaccggcgcuaacggguuugaccccgauacaggauauauggacuucugcguuaagaaugcagagucucucaaccuugccgcggugagaaucuuuuuccugaaugcugccaaagcaaaggccgcuuugucaaggaaaccugaacggaaggcaaacccaaaauuuggugaguggcagguagaagugauuaauaaccacuucccgggcaaucgcaacaaucccauagggaacaaugauuuaacuauccaucgacugaguggauaccuagcccguuggguccucgaccaauauaacgagaaugaugacgaaagccagcacgagcugauuagaacgaccaucauuaacccuaucgcugaguccaauggcguggguugggauucugggccagaaauauaccuuucguuuuuccccggaacagagauguuucuggaaacuuucaaguuuuauccuuugaccaucggcauucauaggguuaagcagggcaugauggacccacaguaccucaaaaaggcccugcggcaacgcuaugggacacugaccgcggauaaauggaugucacagaagguggcagccaucgcuaaaagccucaaggacgucgagcaguuaaaguggggaaaagguggccugagugauacugccaagacauuccuucagaaauuugggauuagauugcccuga

SEQ ID NO: 6156 - RNA, 708 nt, Artificial Sequence
  derived and/or modified CDS sequence (opt3) from LACV(BEN2_Lafayette_WI_2007)__GU596386.1__N
augagcgaccugguguucuacgaugucgccuccaccggcgcuaacggguuugaccccgaugcaggauauauggacuucugcguuaagaaugccgagucucucaaccuugcggcugugagaaucuuuuuccugaaugccgcaaaagccaaggcugcauugucaaggaaaccugaacggaaggccaacccaaaauuuggugaguggcagguagaagugauuaauaaccacuucccgggcaaucgcaacaaucccauagggaacaaugauuuaacaauccaucgacugaguggauaccuagcucguuggguccucgaccaauauaacgagaaugaugacgaaagccagcacgagcugauuagaacuacgaucauuaacccuaucgccgaguccaauggcguggguugggauucugggccagaaauauaccuuucguuuuuccccggaaccgagauguuucuggaaacauucaaguuuuauccuuugacuaucggcauucauaggguuaagcagggcaugauggacccacaguaccucaaaaaggcgcugcggcaacgcuaugggacccugacagcagauaaauggaugucacagaagguggccgcuaucgccaaaagccucaaggacgucgagcaguuaaaguggggaaaagguggccugagugauaccgcaaagacuuuccuucagaaauuugggauuagauugcccuga

SEQ ID NO: 6157 - RNA, 708 nt, Artificial Sequence
  derived and/or modified CDS sequence (opt3) from LACV(Dallas/TX/2009)__GU591164.1__N
augagcgaccugguguucuacgaugucgccuccaccggcgcuaacggguuugaccccgaugcaggauauauggacuucugcguuaagaaugccgagucucucaaccuugcggcugugagaaucuuuuuccugaaugccgcaaaagccaaggcugcauugucaaggaaaccugaacggaaggccaacccaaaauuuggugaguggcagguagaaguggucaauaaccacuucccgggcaaucgcaacaaucccauugggaacaaugauuuaacaauacaucgacugaguggauaccuagcucguugggugcucgaccaauauaacgagaaugaugacgaaagccagagagagcugaucaggacuacgauuaucaacccuauugccgaguccaauggcguucggugggauucugguccagaaaucuaccuuucguuuuuccccgggaccgagauguuucuggaaacauucaaguuuuauccuuugacuauaggaauccaccgcgugaagcagggcaugauggacccacaguaccucaaaaaggcgcugagacaaagguauggcacccugacagcagauaaauggaugucacagaaggucgccgcuauugccaaaagccucaaggacguggagcaguuaaagugggggaaaggaggucugagugauaccgcaaagacuuuccuucagaaauuuggcauccgguugcccuga

SEQ ID NO: 6158 - RNA, 708 nt, Artificial Sequence
  derived and/or modified CDS sequence (opt3) from LACV(Fort Bend County/TX/2009)__GU591167.1__N
augagcgaccugguguucuacgaugucgccuccaccggcgcuaacggguuugaccccgaugcaggauauauggacuucugcguuaagaaugccgagucucucaaccuugcggcugugagaaucuuuuuccugaaugccgcaaaagccaaggcugcauugucaaggaaaccugaacggaaggccaacccaaaauuuggugaguggcagguagaagugauuaauaaccacuucccgggcaaucgcaacaaucccauagggaacaaugauuuaacaauccaucgacugaguggauaccuagcucguuggguccucgaccaauauaacgagaaugaugacgaaagccagagagagcugauuaggacuacgaucauuaacccuaucgccgaguccaauggcgugcggugggauucugguccagaaauauaccuuucguuuuuccccgggaccgagauguuucuggaaacauucaaguuuuauccuuugacuaucggcauucaccgcguuaagcagggaaugauggacccacaguaccucaaaaaggcgcugagacaaagguauggcacccugacagcagauaaauggaugucacagaagguggccgcuaucgccaaaagccucaaggacgucgagcaguuaaagugggggaaaggaggucugagugauaccgcaaagacuuuccuucagaaauuuggcauucgguugcccuga

SEQ ID NO: 6159 - RNA, 708 nt, Artificial Sequence
  derived and/or modified CDS sequence (opt3) from LACV(LACV/95/OH-H (CCH-MB96))__GU206135.1__N
augagcgaccugguguucuacgaugucgccuccaccggcgcuaacggguuugaccccgaugcaggauauauggacuucugcguuaagaaugccgagucucucaaccuugcggcugugagaaucuuuuuccugaaugccgcaaaagccaaggcugcauugucaaggaaaccugaacggaaggccaacccaaaauuuggugaguggcagguagaaguggucaauaaccacuucccgggcaaucgcaacaaucccauugggaacaaugauuuaacaauacaucgacugaguggauaccuagcucguugggugcucgaccaauauaacgagaaugaugacgaaagccagcacgagcugaucaagacuacgauuaucaacccuauugccgaguccaauggcguugguugggauucugggccagaaaucuaccuuucguuuuuccccggaaccgagauguuucuggaaacauucaaguuuuauccuuugacuauaggcauccauagagugaaacagggcaugauggacccacaguaccucaagaaagcgcugaggcaacgguaugggacccugacagcagauaaguggaugucacagaaagucgccgcuauugccaagagccucaaggacguggagcaguuaaaauggggaaaggguggccugagugauaccgcaaaaacuuuccuucagaaguuugggauccgcuugcccuga

SEQ ID NO: 6160 - RNA, 696 nt, Artificial Sequence
  derived and/or modified CDS sequence (opt3) from OROV(BeAn19991)__NC_005777.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucagaugaggagcccaauuaagcaggcugaauuucgggcaaccgugguaguuccccucgccgaggugaaaggaugcacauggaaugauggcgacgcuauguaucuggguuucgccgcgggggcagaaauguuucuucagaccuucacuuucuuuccucuggucauagagaugcaccgcguguugaaggauggaauggacgugaacuucaugaagaaaguccucagacaaagguacggccagaagacagccgagcaguggaugcgggaagagaucguugcugugcgcgccgcauuugaagcuguaggcacccuggccugggcgcgaacgggguucuccccagccgcaagagauuuucugaggcaguucggaauugacaucuga

SEQ ID NO: 6161 - RNA, 696 nt, Artificial Sequence
  derived and/or modified CDS sequence (opt3) from OROV(AR136921)__HQ830443.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucagaugaggagcccaauuaagcaggcugaauuucgggcaaccgugguaguuccccucgccgaggugaaaggaugcacauggaaugauggcgacgcuauguaucuggguuucgccgcgggggcagaaauguuucuucagaccuucacuuucuuuccucuggucauagagaugcaccgcguguugaaggauggaauggacgugaacuucaugaagaaaguccucagacaaagguacggccagaagacagccgagcaguggaugcgggaagagaucguugcugugcgcgccgcauuugaagcuguaggcacccuggccugggcgcgaacgggguucuccccagccgcaagagauuuucugaggcaguucggaauugguaucuga

SEQ ID NO: 6162 - RNA, 696 nt, Artificial Sequence
  derived and/or modified CDS sequence (opt3) from OROV(AR366927)__HQ830448.1__N
augagcgaguucuuuuucaacgacgugccccagagaaccacauccacuuuugauccugaagccgcuuacgucgcauucgaggccagguauggccaaguucugaaugcgggggugguacggguguuuuuccucaaccagaagaaagcuaaggacguccuucgcaaaacgucucgaccaaugguggaucugaccuuuggagguguucaguucgccauggugaauaaccacuuuccgcaguuccaaucaaaucccgucccugacaacggcuugacauuacaucgucugaguggguaccuagcaagaugggccuuuacucagaugaggagcccaaucaagcaggcugaauuucgggcaaccgugguaguuccccucgccgaggugaaaggaugcacauggaaugauggcgacgcuauguaucuggguuuugccgcgggggcagaaauguuccuucagaccuucacuuucuucccucuggucauugagaugcaccgcguguugaaggauggaauggacgugaacuuuaugaagaaaguccucagacaaaaguacggccagaaaacagccgagcaguggaugagggaagagauaguugcugugcgggccgcauucgaagcuguaggcacccuggccugggcgcgcacgggguuuuccccagccgcacgagauuuccugagacaguuuggaaucgguauuuga

SEQ ID NO: 6163 - RNA, 696 nt, Artificial Sequence
  derived and/or modified CDS sequence (opt3) from OROV(BeAn 206119)__AY993909.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucagaugaggagcccaauuaagcaggcugaauuucgggcagccgugguaguuccccucguggaggucaaaggaugcaccuggaaugauggcgacgcuauguaucuggguuucgccgcgggggcagaaauguuucuucagacauucaccuucuuuccucuggugauagagaugcaccgcguguugaaggauggaauggacgucaacuucaugaagaaaguucucagacaaagguacggccagaagacugccgagcaguggaugcgggaagagaucguggcuguacgcgccgcauuugaaacagugggcaccuucgcuugggcccgaacgggguuuuccccagcggccagagauuuccugaggcaguuuggaauugguaucuga

SEQ ID NO: 6164 - RNA, 696 nt, Artificial Sequence
  derived and/or modified CDS sequence (opt3) from OROV(BeAn 208819)__AY993911.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucagaugaggagcccaauuaagcaggcugaauuucgggcaaccgugguaguuccccucguggaggucaaaggaugcacauggaaugauggcgacgccauguaucuggguuucgcugccggggcggaaauguuucuucagaccuucacuuucuuuccucuggugauagagaugcaccgcguguugaaggauggaauggacgucaacuucaugaagaaaguucucagacaaagguacggccagaagacagcagagcaguggaugcgggaagagaucguggccguacgcgcugccuuugaagcagugggcacccuggcuugggcccgaacgggguucuccccagcggccagagauuuucugaggcaguucggaauugguaucuga

SEQ ID NO: 6165 - RNA, 696 nt, Artificial Sequence
  derived and/or modified CDS sequence (opt3) from OROV(BeAn 208823)__AY993912.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucagaugaggagcccaauuaagcaggcugaauuucgggcaaccgugguaguuccccucguggaggucaaaggaugcacauggaaugauggcgacgccauguaucuggguuucgcugccggggcggaaauguuucuucagaccuucacuuucuuuccucuggugauagagaugcaccgcguguugaaggauggaauggacgucaacuucaugaagaaaguucucagacaaagguacggccagaagacagcagagcgguggaugcgcgaagagaucguggccguacgagcugccuuugaagcagugggcacccuggcuugggccagaacgggguucuccccagcggccagggauuuucugcggcaguucggaauugguaucuga

SEQ ID NO: 6166 - RNA, 696 nt, Artificial Sequence
  derived and/or modified CDS sequence (opt3) from OROV(H244576)__HQ830444.1__N
augagcgaguucuuuuucaacgacgugccccagagaaccacauccacuuuugauccugaagccgcuuacgucgcauucgaggccagguauggccaaguucugaaugcgggggugguacggguguuuuuccucaaccagaagaaagcuaaggacguccuucgcaaaacgucucgaccaaugguggaucugaccuuuggagguguucaguucgccauggugaauaaccacuuuccgcaguuccaaucaaaucccgucccugacaacggcuugacauuucaucguuuaaguggguaccuggcaagaugggccuucacucagaugaggagcccaaucaagcaggcugaauuucgggcaaccgugguaguuccccuagccgaggugaaaggaugcacauggaaugauggcgacgcuauguaucucgguuucgccgcgggggcagaaauguuccugcagaccuuuacuuucuuuccucuugucauugagaugcaccgcgugcugaaggauggaauggacgugaacuucaugaagaaagucuugagacaaaaguacggccagaaaacagccgagcaguggaugagggaagagauaguugcugugcgggccgcauuugaagcuguaggcacccucgccugggcgcgcacgggguucuccccagccgcacgagauuuucugagacaguucggaaucgguauuuga

SEQ ID NO: 6167 - RNA, 696 nt, Artificial Sequence
  derived and/or modified CDS sequence (opt3) from OROV(H355186)__HQ830446.1__N
augagcgaguucaucuuuuccgacgugccccagagaaccacaucuacuuucgauccugaagccgcuuacgucgcauuugaggccagguauggccaaguucugaacgcgggggugguacggguguucuuucucaaucagaagaaagcuaaggacguccuucgcaaaacgucacgaccaaugguggaucugaccuucggagguguucaguuugccauggugaacaaucacuucccgcaguuucaaaguaaccccgucccugacaauggcuugacauuacaucgucugagcggguaccuagcaagaugggccuucacucagaugagguccccaauuaagcaggcugaauuucgggcaaccgugguaguuccccucgccgaggugaaaggaugcacauggaacgauggcgacgcuauguaucuggguuucgccgcgggggcagaaauguuucuucagaccuucacuuucuuuccucuggucauagagaugcaccgcguguugaaggauggaauggacgugaauuucaugaagaaaguccucagacaaagguacggccagaagacagccgagcaguggaugcgggaagagaucguugcugugcgcgccgcauuugaagcuguaggcacccuggccugggcgcgaacgggguucucuccagccgcaagagauuuucugaggcaguucggaauugguaucuga

SEQ ID NO: 6168 - RNA, 696 nt, Artificial Sequence
  derived and/or modified CDS sequence (opt3) from OROV(H356898)__HQ830447.1__N
augagcgaguucaucuuuaacgacgugccccagagaaccacauccacuuucgauccugaagccgcuuacgucucuuuugaggcaagguauggccaaguucugaaugccggggugguacggguguucuuucucaaccagaagaaagcgaaggacguccuucgcaaaacgucacgaccaaugguggaucugaccuucggagguguucaguuugcuauggugaauaaccacuucccgcaguuucaaaguaaucccgucccugacaacggcuugacauuacaucgucugagcggguaccuagccagaugggcauucacucagaugagguccccaauuaagcaggccgaauuucgggcuaccgugguaguuccccucgcagaggugaaaggaugcacauggaaugauggcgacgccauguaucuggguuucgcugccggggcggaaauguuucuucagaccuucacuuucuuuccucuggucauagagaugcaccgcguguugaaggauggaauggacgugaacuucaugaagaaaguccucagacaaagguacggccagaagacagcagagcaguggaugcgggaagagaucguugccgugcgcgcugccuuugaagcaguaggcacccuggcuugggcccgaacgggguucucuccagcggccagagauuuucugaggcaguucggaauugguaucuga

SEQ ID NO: 6169 - RNA, 696 nt, Artificial Sequence
  derived and/or modified CDS sequence (opt3) from OROV(H389865)__HQ830453.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucacaugaggagcccaauuaagcaggcugaauuucgggcaaccgugguaguuccccucgccgaggugaaaggaugcacauggaaugauggcgacgcuauguaucuggguuucgccgcgggggcagaaauguuucuucagaccuucacuuucuuuccucuggucauagagaugcaucgcguguugaaggauggaauggacgugaacuucaugaagaaauuucucagacagagguacggccaaaagacagccgagcaguggaugcgggaagagauccuggcugucaaagccgcauucgaauccguuggcacccuggcuugggcccgcacgggguuuucuccagcggcccgagauuuccucagacaguuugcaauuggaaucuga

SEQ ID NO: 6170 - RNA, 696 nt, Artificial Sequence
  derived and/or modified CDS sequence (opt3) from OROV(H472433)__HQ830455.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucucaggaguucaguuugccauggugaauaaccacuucccgcaguuucaaaguaaucccgucccugacaacgguuugacauuacaucgucugagcggcuaccuagcaagaugggccuucacucagaugagguccccaauuaagcaggcugaauuucgggcaaccgugguaguuccccucgccgaggugaaagggugcacauggaaugauggagacgcuauguaucugggcuucgccgcgggugcagaaauguuucuucagaccuucacuuucuuuccucuggucauagagaugcaccgcguguugaaggaugggauggacgugaacuucaugaagaaaguccucagacaaagguacggacagaagacagccgagcaguggaugcgggaagagaucguugcugugcgcgccgcauuugaagcuguaggcacccuggccugggcgcgaacgggcuucucuccagccgcaagagauuuucugaggcaguucgggauuggaaucuga

SEQ ID NO: 6171 - RNA, 696 nt, Artificial Sequence
  derived and/or modified CDS sequence (opt3) from OROV(H532490)__HQ830463.1__N
augagcgaguucaucuuuaacgacgugccccagagaaccacauccacuuucgauccugaagccgcuuacgucucuuuugaggcaagguauggccaaguucugaaugccggggugguacggguguucuuucucaaccagaagaaagcgaaggacguccuucgcaaaacgucaaguccaaugguggaucugaccuucggagguguucaguuugcuauggugaauaaccacuucccgcaguuucaaagcaaucccgucccugacaacggcuugacauuacaucgacuguccggguaccuagcccguugggcauucacucagaugagaucuccaauuaagcaggccgaauuuagggcuaccgugguaguuccccucgcagaggugaaaggaugcacauggaaugauggcgacgccauguaucuggguuucgcugccggggcggaaauguuucuucagaccuucacuuucuuuccucuggucauagagaugcaccggguguugaaggauggaauggacgugaacuucaugaagaaaguccuccgccaaagauacggccagaagacagcagagcaguggaugagggaagagaucguugccgugcgggcugccuuugaagcaguaggcacccuggcuugggcccgcacgggguucucgccagcggcccgagauuuucugagacaguucggaauugguaucuga

SEQ ID NO: 6172 - RNA, 696 nt, Artificial Sequence
  derived and/or modified CDS sequence (opt3) from OROV(H543629)__HQ830467.1__N
augagcgaguuccuguuuaacgacgugccccagagaaccacauccacuuucgauccugaagccgcuuacgucgcauuugaggccagguauggccaaguucucaaugcgggggugguacggguguucuuucuuaaccagaagaaagcuaaggacguccugcgcaaaacgucucgaccaaugguggauuugaccuucggagguguucaguuugccauggugaauaaccacuucccgcaguuucaaucaaaucccgucccugacaacggcuuaacacugcaucgucuaaguggguaccucgcaagaugggccuucacucagaugaggagcccaaucaagcaggcugaauuucgggcaaccgugguaguuccccuggccgaggugaaaggaugcacauggaaugauggcgacgcuauguaucuugguuucgccgcgggggcagaaauguuucugcagaccuucacuuucuuuccuuuggucauugagaugcaccgcgugcucaaggauggaauggacgugaacuucaugaagaaaguccugagacaaagguacggccagaagacagccgagcaguggaugcgggaagagauaguugcugugcgcgccgcauuugaagcuguaggcacccuggccugggcgcgaacgggguucuccccagccggaagagauuuucucaggcaguucgguaucggcauuuga

SEQ ID NO: 6173 - RNA, 696 nt, Artificial Sequence
  derived and/or modified CDS sequence (opt3) from OROV(H543638)__HQ830468.1__N
augagcgaguuccuguuuaacgacgugccccagagaaccacauccacuuucgauccugaagccgcuuacgucgcauuugaggccagguauggccaaguucucaaugcgggggugguacggguguucuuucuuaaccagaagaaagcuaagaauguccugcgcaaaacgucucgaccaaugguggacuugaccuucggagguguucaguuugccauggugaacaaucacuucccgcaguuucaaucaaaccccgucccugauaauggcuuaacacugcaucgucuaaguggguaccucgcaagaugggccuucacucagaugaggagcccaaucaagcaggcugaauuucgggcaaccgugguaguuccccuggccgaggugaaaggaugcacauggaacgacggcgaugcuauguaucuugguuucgccgcgggggcagaaauguuucugcagaccuucacuuucuuuccuuuggucauugagaugcaccgcgugcucaaggacggaauggaugugaauuucaugaagaaaguccugagacaaagguacggccagaagacagccgagcaguggaugcgggaagagauaguugcugugcgcgccgcauuugaagcuguaggcacccuggccugggcgcgaacgggguucuccccagccggaagagacuuucucaggcaguucgguaucggcauuuga

SEQ ID NO: 6174 - RNA, 696 nt, Artificial Sequence
  derived and/or modified CDS sequence (opt3) from OROV(H706890)__HQ830473.1__N
auggccgaguucaucuuuaacgacgugccccagagaaccacaagcacuuucgauccugaagcugcauacgucgccuuugaggcgagguauggccaaguucugaaugcuggggugguacggguguucuuucucaaccagaagaaagccaaggacguccuucgcaaaacgucccgaccaaugguggaucugaccuucggagguguucaguuugcaauggugaauaaccacuucccgcaguuucaaucuaaucccgucccugacaacggcuugacauuacaucgucugucaggguaccuagccagaugggcuuucacucagaugaggaguccaauuaagcaggcagaauuucgggccaccgugguaguuccccucgcugaggugaaaggaugcacauggaaugauggcgacgccauguaucuggguuucgcggcaggggccgaaauguuucuucagaccuucacuuucuuuccucuggucauagagaugcaccgcguguugaaggauggaauggacgugaacuucaugaagaaaguccucagacaaagguacggccagaagacagcugagcaguggaugcgggaagagaucguugccgugcgcgcagcuuuugaagccguaggcacccuggcgugggcccgaacgggguucagcccagcagcuagagauuuucugaggcaguucggaauugguaucuga

SEQ ID NO: 6175 - RNA, 696 nt, Artificial Sequence
  derived and/or modified CDS sequence (opt3) from OROV(H758669)__HQ830479.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauuuugaauaaccacuucccgcaguuucaaucaaaucccgugccugacaacggcuuaacacugcaucgucuaaguggguaccucgcaagaugggccuucacucagaugaggagcccaauaaagcaggcugaauuucgggcaaccgucgugguaccccuggccgagguuaaaggaugcacauggaaugauggcgacgcuauguaucuugguuucgccgcgggggcagaaauguuucugcagaccuucacuuucuuuccuuuggugaucgagaugcaccgcguccucaaggauggaauggacgugaacuucaugaagaaagugcugagacaaagguacggccagaagacagccgagcaguggaugcgggaagagauugucgcuguucgcgccgcauuugaagcugugggcacccuggccugggcgcgaacgggguucuccccagccgcaagagauuuucucaggcaguucggaaucgguauuuga

SEQ ID NO: 6176 - RNA, 696 nt, Artificial Sequence
  derived and/or modified CDS sequence (opt3) from OROV(H758687)__HQ830478.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucagaugaggagcccaauuaagcaggcugaauuucgggcaaccgugguaguuccccucgccgaggugaaaggaugcacauggaaugauggcgacgcuauguaucuggguuucgccgcgggggcagaaauguuucuucagaccuucacuuucuuuccuuucgucauagagaugcaccgcgugcugaaggauggaauggacgugaacuuuaugaagaaagucuugagacaaagguacggccagaagacagccgagcaguggaugcgggaagagaucguugcugugcgcgccgcauucgaagcuguaggcacccucgccugggcgcgaacgggguuuuccccagccgcaagagauuuccugaggcaguuuggaauugguaucuga

SEQ ID NO: 6177 - RNA, 696 nt, Artificial Sequence
  derived and/or modified CDS sequence (opt3) from OROV(H759041)__HQ830488.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucagaugaggagcccaauuaagcaggcugaauuucgggcaaccgugguaguuccccucgccgaggugaaaggaugcacauggaaugauggcgacgcuauguaucuggguuucgccgcgggggcagaaauguuucuucagaccuucacuuucuuuccucuggucauagagaugcaccgcguguugaacgauggaauggacgugaauuucaugaagaagguccucagacaaagguacggccagaaaacagccgagcaguggaugcgggaagagaucguugcugugcgcgccgcauuugaagcuguaggcacccuggccugggcgcgaacgggguucuccccagccgcaagagauuuucugaggcaguucggaauugguaucuga

SEQ ID NO: 6178 - RNA, 696 nt, Artificial Sequence
  derived and/or modified CDS sequence (opt3) from OROV(BeAr473358)__AF164539.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucacaugaggagcccaauuaagcaggcugaauuucgggcaaccgugguaguuccccucgccgaggugaaaggaugcacauggaaugauggcgacgcuauguaucuggguuucgccgcgggggcagaaauguuucuucagaccuucacuuucuuuccucuggucauagagaugcaucgcguguugaaggauggaauggacgugaacuucaugaagaaaauccucagacagagguacggccaaaagacagccgagcaguggaugcgggaagagauuaucgcugucaaaaccgccuuugaaacgguuggcacucuggcaugggcuauuaccggguucuccccagccgcgcgcaauuuucugcgacaguucgagaucgauauauga

SEQ ID NO: 6179 - RNA, 696 nt, Artificial Sequence
  derived and/or modified CDS sequence (opt3) from OROV(BeH 521086)__AY704559.1__N
augagcgaguuccuguuuaacgacgugccccagagaaccacauccacuuucgauccugaagccgcuuacgucgcauuugagucuagguauggccaaguucucaaugccggggugguacggguguucuuucuuaaccagaagaaagcgaaggacguccugcgcaaaacgucacgaccaaugguggauuugaccuucggagguguucaguuuacaauggugaauaaccacuucccgcaguuucaaaguaaucccgucccugacaacggcuuaacucugcaucgucuaagcggguaccucgcuagaugggccuucacccagaugagguccccaaucaagcaggcagaauuucgggccacagugguaguuccccuggcugaggugaaaggaugcaccuggaaugauggcgacgcaauguaucuugguuucgccgcuggggccgaaauguuucugcagacuuucacauucuuuccuuuggucauugagaugcaccgcgugcucaaggauggaauggacgugaacuucaugaagaaaguccugagacaaagguacggccagaagaccgcggagcaguggaugcgggaagagauaguugcagugcgcgccgcuuuugaagccguaggcacgcuggcaugggcucgaacuggguucucuccagccgcgagagauuuucucaggcagucgggaaucgguauuuga

SEQ ID NO: 6180 - RNA, 696 nt, Artificial Sequence
  derived and/or modified CDS sequence (opt3) from OROV(BeH121923)__HM470110.1__N
augagcgaguucaucuuuaacgacgugccccagagaaccacauccucuuucgauccugaagccgcuuacgucgcauuugaggccagguauggccaaguucugaaugcgugcgugguacggguguucuuucucaaccagaagaaagcuaaggacguccuucgcaaaacuucauggccaaugguggaucugacguucgggcgaguucaguuugccauggugaauaaccacuucccgcaguuucaaaguaaucccgucccugacaacggauuggcauuacaucgucugagcgguuaccuagccagaugggcuuucacccagaugagguccccaauuaagcaggcagaauuucgggccacagugguaguuccccucgcugaggugaaaggcuguacuuggaaugauggggacgccauguaucugggauucgcggcaggcgccgaaauguuucuucagaccuucacauucuuuccucuggucauagagaugcaccgcguguugaaggaugguauggacgugaacuucaugaagaaaguccucagacaaagguacgggcagaagaccgcugagcaguggaugcgggaagagaucguugccgugcgcgcagcuuuugaagccguaggaacucuggcgugggcccgaacaggcuucucuccagcagcuagagauuuucugaggcaguucggcauugacaucuga

SEQ ID NO: 6181 - RNA, 696 nt, Artificial Sequence
  derived and/or modified CDS sequence (opt3) from OROV(BeH379693)__AF164534.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgccgaacgucucguccaaugguggaucugaccuucggagguguucaguuugccauggugaauaaccacuucccgcaguuucaaucaaaucccgucccugacaacggcuugacauuacauagacugaguggguaccuagcaaggugggccuucacucagaugcggagcccaauuaaacaggcugaauuucgcgcaaccgugguaguuccccucgccgaggugaagggaugcacauggaaugauggcgacgcuauguaucuggguuucgccgcgggggcagaaauguuucuucagaccuucacuuucuuuccucuggucauagagaugcacagaguguugaaagauggaauggacgugaacuucaugaagaagguccucaggcaacgguacggccagaaaacagccgagcaguggaugcgcgaagagaucguugcugugcgagccgcauuugaagcuguaggcacccuggccugggcgagaacgggguucuccccagccgcaagggauuuucugcggcaguucggaauugguaucuga

SEQ ID NO: 6182 - RNA, 696 nt, Artificial Sequence
  derived and/or modified CDS sequence (opt3) from OROV(BeH381114)__AF164535.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucagaugaggagcccaauuaagcaggcugaauuucgggcaaccgugguaguuccccucgccgaggugaaaggaugcacauggaaugauggcgacgcuauguaucuggguuucgccgcgggggcagaaauguuucuucagaccuucacuuucuuuccucuggucauagagaugcaccgcguguugaaggauggaauggacgugaacuucaugaagaaaguccucagacaaagguacggccagaagacagccgagcaguggaugcgggaagagaucguugcugugcgcgccgcauuugaagcuguaggcacccuggccugggcgcgaacgggguucuccccagccgcaagagauuuucugaggcaguucggaauuuguaucuga

SEQ ID NO: 6183 - RNA, 696 nt, Artificial Sequence
  derived and/or modified CDS sequence (opt3) from OROV(BeH390233)__AF164536.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucagaugaggagcccaauuaagcaggcugaauuucgggcaaccgugguaguuccccucgccgaggugaaaggaugcacauggaaugauggcgacgcuauguaucuggguuucgccgcgggggcagaaauguuucuucagaccuucacuuucuuuccucuggucauagagaugcaccgcguguugaaggauggaauggacgugaacuucaugaagaaaguccucagacaaagguacggccagaagacagccgagcaguggaugcgggaagagaucguugcugugcgcgccgcauuugaagcuguaggcacccuggccugggcgcgaacgggguucuccccagccgcaagagauuuucugggacaguucgguauuggcaucuga

SEQ ID NO: 6184 - RNA, 696 nt, Artificial Sequence
  derived and/or modified CDS sequence (opt3) from OROV(BeH472204)__AF164538.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucagaugaggagcccaauuaagcaggcugaauuucgggcaaccgugguaguuccccucgccgaggugaaaggaugcacauggaaugauggcgacgcuauguaucuggguuucgccgcgggggcagaaauguuucuucagaccuucacuuucuuuccucuggucauagagaugcaccgcguguugaaggauggaauggacgugaacuucaugaagaaaguccucagacaaagguacguucagaagacagccgagcaguggaugcgggaagagaucguggcuguacgcgccgcauuugaagcugugggcacccuggccugggcgcgaacgggcuucuccccagccgcaagagauuuucugaggcaguucgggauuggaaucuga

SEQ ID NO: 6185 - RNA, 696 nt, Artificial Sequence
  derived and/or modified CDS sequence (opt3) from OROV(BeH505442)__AF164542.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucagaugaggagcccaauuaagcaggcugaauuucgggcaaccgugguaguuccccucgccgaggugaaaggaugcacauggaaugauggcgacgcuauguaucuggguuucgccgcgggggcagaaauguuucuucaggccuucaccuucuuuccucuggucauagagaugcaccgcguguugaaggauggaauggacgugaacuucaugaagaaaguccucagacaaagguacggccagaagacugcugagcaguggaugcgggaagagaucguugccgugcgcgcagcuuuugaagccguaggcacacuggcgugggcccgaaccggguucuccccagcagcuagagauuuucugaggcaguucggaauugacaucuga

SEQ ID NO: 6186 - RNA, 696 nt, Artificial Sequence
  derived and/or modified CDS sequence (opt3) from OROV(BeH541863)__AF164544.1__N
augagcgaguucaucuuuuccgacgugccccagagaaccacaucuacuuucgauccugaagccgcuuacgucgcauuugaggccagguauggccaaguucugaacgcgggggugguacggguguucuuucucaaucagaagaaagcuaaggacguccuucgcaaaacgucacgaccaaugguggaucugaccuucggagguguucaguuugccauggugaacaaucacuucccgcaguuucaaaguaaccccgucccugacaauggcuugacauuacaucgucugagcggguaccuagcaagaugggccuucacucagaugagguccccaauuaagcaggcugaauuucgggcaaccgugguaguuccccucgccgaggugaaaggaugcacauggaacgauggcgacgcuauguaucuggguuucgccgcgggggcagaaauguuucuucagaccuucacuuucuuuccucuggucauagagaugcaccgcguguugaaggauggaauggacgugaauuucaugaagaaaguccucagacaaagguacggccagaagacagccgagcaguggaugcgggaagagaucguugcugugcgcgccgcauuugaagcuguaggcacccuggccugggcgcgaacgggguucucuccagccgcaagaaacuuucugaggcaguucggaauugguaucuga

SEQ ID NO: 6187 - RNA, 696 nt, Artificial Sequence
  derived and/or modified CDS sequence (opt3) from OROV(BeH543033)__AF164545.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucagaugaggagcccaauuaagcaggcugaauuucgggcaaccgugguaguuccccucgccgaggugaaaggaugcacauggaaugauggcgacgcuauguaucuggguuucgccgcgggggcagaaauguuucuucagaccuucacuuucuuuccucuggucauagagaugcaccgcguguugaaggauggaauggacgugaacuucaugaagaaaguccucagacaaagguacggccagaagacagccgagcaguggaugcgggaagagaucguugcugugcgcgccgcauuugaagcuguaggcacccuggccugggcgcgaacgggguucuccccagccgcaagagaguuucugaggcaguucggaauugguaucuga

SEQ ID NO: 6188 - RNA, 696 nt, Artificial Sequence
  derived and/or modified CDS sequence (opt3) from OROV(BeH543618)__AF164548.1__N
augcaggaguucaucuuuaacgacgugccccaaagaaccacaagcacuuucgauccugaagccgcuuacgucgcauuugaggccagguauggccagguucugaaugcgggggugguacggguguucuuucucaaccagaagaaagcuaaggacguccuucgcaaaacgucccgaccaaugguggaucugaccuucggagguguucaguuugccauggugaauaaccacuucccgcaauuucagucuaaucccgucccugacaacggcuugacauuacaucgucugucaggguaccuagcaagaugggccuucacucagaugaggaguccaauuaagcaggcugaauuucgggcaaccgugguaguuccccucgccgaggugaaaggaugcacauggaaugauggcgacgcuauguaucuggguuucgccgcgggggcagaaauguuucuucaaaccuucacuuucuuuccucuggucauagagaugcaccgcguguugaaggauggaauggacgugaacuucaugaagaaaguccucagacagagguacggccagaagacagccgagcaguggaugcgggaagagaucguugcugugcgcgccgcauuugaagcuguaggcacccuggccugggcgcgaacgggguucagcccagccgcaagagauuuucugaggcaauucggaauugguaucuga

SEQ ID NO: 6189 - RNA, 696 nt, Artificial Sequence
  derived and/or modified CDS sequence (opt3) from OROV(BeH544552)__AF164546.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucagaugaggagcccaauuaagcaggcugaauuucgggcaaccgugguaguuccccucgccgaggugaaaggaugcacauggaaugauggcgacgcuauguaucuggguuucgccgcgggggcagaaauguuucuucagaccuucacuuucuuuccucuggucauagagaugcaccgcguguugaaggauggaauggacgugaacuucaugaagaaaguccucagacaaagguacggccagaagacagccgagcaguggaugcgggaagagaucguugcugugcgcgccgcauuugaagcuguaggcacccuggccugggcgcgaacgggguucuccccagccgcaagagauuuucugaggcagauuggaaucgguauuuga

SEQ ID NO: 6190 - RNA, 696 nt, Artificial Sequence
  derived and/or modified CDS sequence (opt3) from OROV(GML444911)__AF164556.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucagaugaggagcccaauuaagcaggcugaauuucgggcaaccgugguaguuccccucgccgaggugaaaggaugcacauggaaugauggcgacgcuauguaucuggguuucgccgcgggggcagaaauguuucuucagaccuucacuuucuuuccucuggucauagagaugcaccgcguguugaaggauggaauggacgugaacuucaugaagaaaguccucagacaaagguacggccagaagacagccgagcaguggaugcgggaagagaucguugcugugcgcgccgcauuugaagcuguaggcacccuggccugggcgcgaacgggguucuccccagccgcaagagauuuucugaggcaguucggaauuuauaucuga

SEQ ID NO: 6191 - RNA, 696 nt, Artificial Sequence
  derived and/or modified CDS sequence (opt3) from OROV(IQT4083)__AF164552.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucagaugaggagcccaauuaagcaggcugaauuucgggcaaccgugguaguuccccucgccgaggugaaaggaugcacauggaaugauggcgacgcuauguaucuggguuucgccgcgggggcagaaauguuucuucagaccuucacuuucuuuccucuggucauagagaugcaccgcguguugaaggauggaauggacgugaacuucaugaagaaaguccucagacaaagguacggcaagaaaacagccgagcaguggaugcgggaagagaucguugcugugcgcgccgcauuugaagcuguaggcacccuggccugggcgcgaacgggguucuccccagccgcaagagauuuucugaggcaguucggaauugacaucuga

SEQ ID NO: 6192 - RNA, 696 nt, Artificial Sequence
  derived and/or modified CDS sequence (opt3) from OROV(PPS 522 H 669314)__EF467370.1__N
augagcgaguucaucuccaacgacgugccccacagaaccacaucuacuuuugauccugaagccgcuuacgucgcauucgaggccagguauggccagguucugaaugcgggggugguacggguguuuuuccucaaccaaaagaaagcuaaggacguccuucgcaaaacgucacgaccaaugguggaucugaccuuuggagguguucaguucgccauggugaauaaccauuuuccgcaguuccagaguaaucccgucccugacaacggcuugacauuacaccgucugagcggguaccuagcaagaugggccuuuacucaaaugagguccccaauuaagcaggcugaguuccgggcaaccgugguaguuccccucgccgaagugaaaggaugcacauggaaugauggcgacgcuauguaucuggguuuugccgcgggggcagaaauguuccuucagaccuuuacuuucuucccucuggucauagagaugcaucgcguguugaaggauggaauggacgugaacuuuaugaagaaaguccucagacagagguacggccaaaagacagccgagcaguggaugcgggaagagaucguugcugugcgcgccgcauucgaagcuguaggcacccuggccugggcgcgaacgggguuuucuccagccgcaagagauuuccugaggcaguuuggaauuuguaucuga

SEQ ID NO: 6193 - RNA, 696 nt, Artificial Sequence
  derived and/or modified CDS sequence (opt3) from OROV(TVP-19254/GML-480914)__KP795083.1__N
augagcgaguucaucuuuaacgacgugccccagagaaccacauccacuuucgauccugaagccgcuuacgucgcauuugaggccagguauggccaaguucugucugcgggggugguacggguguucuuucucaaucagaagaaagcuaaggacguccuucgcaaaacgucacgaccaaugguggaucugaccuucggagguguucaguuugccauggugaacaaucacuucccgcaguuucaaaguaaccccgucccugacaauggcuugacauuacaucgucugagcggguaccuagcaagaugggccuucacucagaugagguccccaauuaagcaggcugaauuucgggcaaccgugguaguuccccucgccgaggugaaaggaugcacauggaacgauggcgacgcuauguaucuggguuucgccgcgggggcagaaauguuucuucagaccuucacuuucuuuccucuggucauagagaugcaccgcguguugaaggauggaauggacgugaauuucaugaagaaaguccucagacaaagguacggccagaagacagccgagcaguggaugcgggaagagaucguugcugugcgcgccgcauuugaagcuguaggcacccuggccugggcgcgaacgggguucucuccagccgcaagagauuuucugaggcaguucggaauugacaucuga

SEQ ID NO: 6194 - RNA, 696 nt, Artificial Sequence
  derived and/or modified CDS sequence (opt3) from OROV(TVP-19256/IQE-7894)__KP795086.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuuacaauggugaauaaccacuucccgcaguuucaaucaaaucccgucccugacaacggcuugacuuuacaucgucugaguggguaccuagccagaugggcauucacccagaugaggagcccaauuaagcaggccgaauuucgggcuacagugguaguuccccucgcagaggugaaaggaugcaccuggaaugauggcgacgccauguaucuggguuucgcugccggggcggaaauguuucuucagacuuucacauucuuuccucuggucauagagaugcaccgcguguugaaggauggaauggacgugaacuucaugaagaaaguccucagacaaagguacggccagaagaccgcagagcaguggaugcgggaagagaucguugccgugcgcgcugccuuugaagcaguaggcacgcuggcuugggcccgaacuggguucuccccagcggccagagauuuucugaggcaguucggaauugacaucuga

SEQ ID NO: 6195 - RNA, 696 nt, Artificial Sequence
  derived and/or modified CDS sequence (opt3) from OROV(TVP-19258/IQT-4083)__KP795092.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucagaugaggagcccaauuaagcaggcugaauuucggggaaccgugguaguuccccucgcagaggugaaaggcugcacauggaaugauggugacgccauguaucugggguucgcugccggagcggaaauguuucuucagaccuucacuuucuuuccucuggucauagagaugcaccgcguguugaaggauggcauggacgugaacuucaugaagaaaguccucagacaaagguacggccagaagacagcagagcaguggaugcgggaagagaucguugccgugcgcgcugccuuugaagcaguagggacccuggcuugggcccgaacgggauucuccccagcggccagagauuuucugaggcaguucgguauugacaucuga

SEQ ID NO: 6196 - RNA, 699 nt, Artificial Sequence
  derived and/or modified CDS sequence (opt3) from OROV/FPV(Aus Ch 16129)__AF362400.1__N
augaccgacuucguguuuaacgaugucccccagagagccacaagcacuuucgacccugaggcugcauacguugccuuugaaaauagguuccgggcgaaccugacgguggauguagcucgcaucuuuuuccucaaucaaaagaaagccaaggaccgacuugcaaaaaccgcccgugcuacaguggauauuacuuuuggcggggucguguucccaguugugaacaaucacuauccggaguaccagagaaaccccgucccugacgauggacugaccuugcauagguuauccgguuaucuggcacgguggcuaauagaccagugcaaugccucuccagugcgcaugacagaaaucagaaccaagguaauuaucccccucgcugagguuaaaggcuguacuuggaacgauggggccucaauguaccugggauuugcggcaggcgccgaaauguuccuucagaguuuuacauucuauccucuggugauugagaugcaaagggucuugaaggacgguauggaugugaauuuuaugcggaaggugcuccgccagcgauacgggaccaaaacggcugagcaguggaugagagacgauaucgucgccguuaagacugcauucgaagcuauaaacaccaucagcugggccagguccggauucucuccagcggcccgggaguuucugcgucaguucggcauuaauaucuga

SEQ ID NO: 6197 - RNA, 696 nt, Artificial Sequence
  derived and/or modified CDS sequence (opt3) from OROV/IQTV(IQE3728/PER/06)__KF150535.1__N
augagcgaguucaucuuuaacgacgugccccagagaaccacauccacuuucgauccugaagccgcuuacgucgcauuugaggccagguauggccaaguucugaaugcgggggugguacggguguucuuucucaaccagaagaaagcuaaggacguccuucgcaaaacgucucgaccaaugguggaucugaccuucggagguguucaguuugccauggugaauaaccacuucccgcaguuucaaucaaaucccgucccugacaacggcuugacauuacaucgucugaguggguaccuagcaagaugggccuucacucagaugaggagcccaauuaagcaggcugaauuucgggcaaccgugguaguuccccucgccgaggugaaaggaugcacauggaaugauggcgacgcuauguaucuggguuucgccgcggggaccgaaauguuucuucagacuuucacauucuuuccucuggucauagagaugcaccgcguguugaaggauggaauggacgugaacuucaugaagaaaguccucagacaaagguacggccagaagaccgcagagcaguggaugcgggaagagaucguugccgugcgcgcugccuuugaagcaguaggcacgcuggcuugggcccgaacuggguucuccccagcggccagagauuuucugaggcaguucggaauugguaucuga

SEQ ID NO: 6198 - RNA, 699 nt, Artificial Sequence
  derived and/or modified CDS sequence (opt3) from OROV/UTIV(Be An 84785)__KF697156.1__N
auggccgaguucguguuuaacgacgucccccagagaagcaccuccacauucgauccugaaguugcuuacgcaacuuuugaggccgcguucaggcaaacgcugaaugugaacguagugcgggucuuuuuccucaaucagaagaacgcuaaaaaugugcuucgcaagaccucucgaccaaacguugaccugacauuuggcggggccacuuucccgaucgugaauaaccacuuuccccaguuccagucaaauccugucccagauaacggauugaccuuacaucgucugagugguuaucuagcaagauggagcauggaccaaaugaggacaaaucccauucggcaggccgaauuucgcgcugcagugguaguuccucucgccgagauaaaaggcugcaccuggaacgauggggacgcuauguaccuggccuucgcggcaggagccgaaauguuucuuaauacuuucacauucuuuccacuggugaucgagaugcacagagucuugaaggauggcauggacgugaacuucaugaggaaagugcuccggcagcgcuaugguaccaagacggcugagcaguggaugaaggaugaaauuauccccauuaaagccgcauuugaggcugucgggaugcuguccugggcccgaacuggauucucuccugcggccagagacuuucugaggcaauucggcaucaauguuuga

SEQ ID NO: 6199 - RNA, 738 nt, Artificial Sequence
  derived and/or modified CDS sequence (opt3) from HRTV(TN)__KJ740146.1__N
augaccgacuggagcgccaucgcuguggagauuggcaacgaaccccuggaugucccugcacucguugaguucgccaaggaaauagcguacgaggggcuugacccagcugugauccugggauuguuaagagaaagggguggcgagaauuggcggaacgauguaaaauauauuaucguguuugcccugacacgcgggaauaagauugucaaagcaugcggaaagauguccaaaaagggcgccgagcgaaugacuaaccuagcucguguguacgaacucaaggagaaugcaguugacagaauggccgugacgccggucaggguggcucagugucugcccaccuggacaugcgccgcggcagccgcuaucaaagaauaucuuccuguagguccagccauaaugcacaacaagauccaaggguacccccuggagaugauguguauggcauucggaucuuugauuccucaggcugauguuucaaucgaggugauuaaagacuuuauggaugccuauagucucuggcaggacacuuucgcgcggaccaucaaugucgaucagcgcaagaugacaaaagccgaaguguacgcaaaguuuagagacccacugcaugcugccgugaacagccuguucuuucccaaugcuaccaggauauccuggcuccaagccaagggcuuacugacugcaacaaaagaggccucuggcucggucaaggcugcggcagccgcuuaucggaacauguga

SEQ ID NO: 6200 - RNA, 738 nt, Artificial Sequence
  derived and/or modified CDS sequence (opt3) from HRTV(Patient1)__JX005842.1__N
augaccgacuggagcgccaucgcuguggagauuggcaacgaaccccuggaugucccugcacucguugaguucgccaaggaaauagcguacgaggggcuugacccagcugugaucuuuggacuguugagagaaagggguggcgagaauuggcggaacgauguaaaauauauuaucguguucgccuuaacacgcgggaauaagauugucaaagcaugcggaaagauguccaaaaagggcgccgagcgaaugacuaaccuggcucguguguacgaacuaaaggagaaugcaguugacagaauggccgugacgccggucaggguggcucagugucuccccaccuggacaugcgccgcggcagccgcuaucaaagaauaucugccuguagguccagccauaaugcacaacaagauccaaggguacccccuugagaugauguguauggcauuuggaucucugauuccucaggcugauguuucaaucgaggugauuaaagacuucauggaugccuauaguuuguggcaggacacuuuugcgcggaccaucaaugucgaucagcgcaagaugacaaaagccgaaguguacgcaaaguucagagacccacuccaugcugccgugaacagccuguuuuuccccaaugcuaccaggauauccuggcugcaagccaagggccucuuaacugcaacaaaagaggccucuggcucggucaaggcugcggcagccgcuuaucggaacauguga

SEQ ID NO: 6201 - RNA, 738 nt, Artificial Sequence; identical to SEQ ID NO: 6199
  derived and/or modified CDS sequence (opt3) from HRTV(Patient2)__JX005843.1__N

SEQ ID NO: 6202 - RNA, 732 nt, Artificial Sequence
  derived and/or modified CDS sequence (opt3) from PTV(PAN472868)__NC_027202.1__N
augagcuacgaggaaaucgccgugcaguucgcuuccgagucuauugacgaacaagcagucgccggcuggguuaccgauuuugcguaucagggguucgacgcuaagagagugauagcccugguaaaagauaggggaggugaggacuggaagcaggaugugaaaaagaugaucguccucucacuuacacggggcaacaaacccaauaagauggugcugaagaugagugacaaagggaaggcaaugguuaacgaauugguguuaaaauacaagcugaaaagcggaaauccuucccgcgaugaccuaacucucucucgaauuacggccgcuuuugcaggcuggaccugccaggccgcugauuauguccaagaguaccugccagugacaggucgugccauggacgcgaucucgucaagcuauccgagagcaaugaugcaccccaguuucgccgggcuuauugaucaggagcugccugcugacguauuguccgaaaucacucaggcccauugucucuuuaugauacaguucucuaagaccaucaacccaagccugaggggacuguccaaggaugagauuguuucaaguuuugaacggcccaugcaagcagcuaucagcucuacauuccucaccuccgccaaucgcagagcgauguuaaaaacucugggcauuaucaacgacaaucuuaagccuucaagcaguacagugucugccgcaaaagucuuuagguccuuguga

SEQ ID NO: 6203 - RNA, 732 nt, Artificial Sequence
  derived and/or modified CDS sequence (opt3) from PTV(Adames)__KR912210.1__N
augagcuacgaggaaaucgccgugcaguucgcuuccgagucuauugacgaacaagcagucgccggcuggguuaccgauuuugcguaucagggguucgacgcuaagagagugauagcccugguaaaagagaggggaggugaagauuggaagcaggacgugaaaaagaugaucguccucucacuuacacggggcaacaaacccaauaagauggugcugaagaugagugauaaagggaaggcaaugguuaacgaguugguguuaaaauacaagcugaaaagcggaaauccuucccgcgacgaucuaacucucucucgaauuacggccgcuuuugcaggcuggaccugccaggccgcugacuauguccaagaguaccugccagugacaggucgugccauggauacuaucucgucaggguauccgagagcgaugaugcaccccagcuucgcaggacuuauugaccaggaacugccugccgauguauugagugagaucacccaggcucauugucucuuuaugauacaguucuccaagacaaucaacccaucucugaggggccugagcaaggacgaaauuguuuccucauuugagcggcccaugcaagccgcaaucaguagcaccuuccucacuucugcuaaucgcagagccauguuaaaaacacugggcauuaucaacgauaaucuuaagccuuccucaagcaccgugagugcggccaaagucuuuaggucuuuguga

SEQ ID NO: 6204 - RNA, 732 nt, Artificial Sequence
  derived and/or modified CDS sequence (opt3) from PTV(Balliet)__KR912211.1__N
augagcuacgaggaaaucgccgugcaguucgcuuccgagucuauugacgaacaaaccgucgcaggcuggguuacagauuuugccuaucagggguucgacgcgaagagagugauagcucugguaaaagauaggggaggugaggacuggaagcaggaugugaaaaagaugaucguccucucacuuacucggggcaacaaacccaauaagaugauucugaagaugagugacaaagggaaggccauggugaacgaauugguuuuaaaauacaagcugaaaagcggaaauccuucccgcgaugaccuaacgcucucucgaaucaccgcagccuuugcuggcuggacaugccaggcagccgauuaugugcaagaguaccugccagucacuggucgugcuauggacgccauuucgucaagcuauccgagagcgaugaugcaccccaguuucgcagggcuuaucgaucaggagcugccugccgacguguuuuccgaaauaacccaggcucauuguuuguucaugauccaguuuucuaagacaauuaacccaagccucaggggacuguccaaggaugagaucguaucaaguuucgaacggcccaugcaagccgcaauuagcucuaccuuucugacuuccgcuaaucgcagagccaugcucaaaacauuaggcaucauaaacgacaaucugaagccuucaagcaguaccguuucugcggccaaaguguucaggucccuuuga

SEQ ID NO: 6205 - RNA, 732 nt, Artificial Sequence
  derived and/or modified CDS sequence (opt3) from PTV(PaAR2381)__KP272006.1__N
augagcuacgaggaaaucgccgugcaguucgcuuccgagucuauugacgaacaagcagucgccggcuggguuaccgauuuugcguaucagggguucgacgcuaagagagugauagcccugguaaaagauaggggaggugacgauuggaagcaggacgugaaaaagaugaucguccucucacuuacacggggcaacaaacccaauaagauggugcugaagaugagugauaaagggaaggcaaugguuaacgaguugguguuaaaauacaagcugaaaagcggaaauccuucccgcgacgaucuaacucucucucgaauuacggccgcuuuugcaggcuggaccugccaggccgcugacuauguccaagaauaccugccagugacaggucgugccauggaugcgaucucgucaagcuauccgagagcaaugaugcaccccaguuucgccgggcuuauugaccaggagcugccugcugauguauuguccgagaucacucaggcccauugucucuuuaugauacaguucucuaagaccaucaacccaagccugaggggacuguccaaggacgaaauuguuucaaguuuugagcggcccaugcaagcagcuaucagcucuacauuccucaccuccgccaaucgcagagcgauguuaaaaacucugggcauuaucaacgacaaucuuaagccuucaagcaguacagugucugccgcaaaagucuuuagguccuuguga

SEQ ID NO: 6206 - RNA, 732 nt, Artificial Sequence
  derived and/or modified CDS sequence (opt3) from PTV(GML902876)__KP272012.1__N
augagcuacgaggaaaucgccgugcaguucgcuuccgagucuauugacgaacaagcagucgccggcuggguuaccgauuuugcguaucagggguucgacgcuaagagagugauagcccugguaaaagauaggggaggugacgauuggaagcaggacgugaaaaagaugaucguccucucacuuacacggggcaacaaacccaauaagauggugcugaagaugagugauaaagggaaggcaaugguuaacgaguugguguuaaaauacaagcugaaaagcggaaauccuucccgcgacgaucuaacucucucucgaauuacggccgcuuuugcaggcuggaccugccaggccgcugacuauguccaagaauaccugccagugacaggucgugccauggaugcgaucucgucaagcuauccgagagcaaugaugcaccccaguuucgccgggcuuauugaccaggagcugccugcugauguauuguccgagaucacucaggcccauugucucuuuaugauacaguucucuaagaccaucaacccaagccugaggggacuguccaaggacgaaauuguuucaaguuuugagcggcccaugcaagcagcuaucagcucuacauuccucaccuccgccaaucgcagagcgauguuaaaaacucugggcauuaucaacgacaaucuuaagccuucaagcaguacagccucugcagcuaaaguguuuagguccuuguga

SEQ ID NO: 6207 - RNA, 732 nt, Artificial Sequence
  derived and/or modified CDS sequence (opt3) from PTV(Adames)__KP272030.1__N
augagcuacgaggaaaucgccgugcaguucgcuuccgagucuauugacgaacaagcagucgccggcuggguuacccacuuugcguaucagggguucgaugcuaagagagugauagcccugguaaaagagaggggaggugaagacuggaagcaggaugugaaaaagaugaucguccucucacuuacacggggcaacaaacccaauaagauggugcugaagaugagugacaaagggaaggcaaugguuaacgaguugguguuaaaauacaagcugaaaagcggaaauccuucccgcgaugaccuaacucucucucgaauuacggccgcuuuugcaggcuggaccugccaggccgcugauuauguccaagaguaccugccagugacaggucgugccauggacacuaucucgucaggguauccgagagcgaugaugcaucccagcuucgcaggacuuauugaucaggaacugccugccgacguauugagugagaucacccaggcucacugucucuuuaugauacaguucuccaagacaaucaacccaucucugaggggccugagcaaggaugaaauuguuuccucauuugagcggcccaugcaagccgcaaucaguagcaccuuccucacuucugcuaaucgcagagccauguuaaaaacacugggcauuaucaacgacaaucuuaagccuuccucaagcaccgugagugcggccaaagucuuuaggucuuuguga

SEQ ID NO: 6208 - RNA, 735 nt, Artificial Sequence
  derived and/or modified CDS sequence (opt3) from Phlebovirus(CoAr171616)__HM566153.1__N
augagcuacgaggaaaucgccgugaacuucgcuuccgagucuauugacgaaucaaccauaagugcaugggucagcgauuuugccuaucagggcuucgacgcgaagagaguuaucgcucugauuaaagagaggggaggggaaaauuggaaggaggaugugaaaaagaugaucguacucucccuuacacgggguaacaaacccgccaagaugauucugaagaugucugacaaaggcaagaaagaggugaaugauuugaucacucgcuacaaguuaaaaucggggaacccuucacgagacgaucugacgcuaagccgugucgcagccgcuuuugcaggauggaccugccaagccgcugaauaugugcaggaguaccucccaguuacaggcagagccauggacgcguucagugcagauuuuccgagggcccugaugcaccccuccuucgcuggucuuauagaccaggaacugccuucuagcgccaugacugauaucgugcaugcacacuguuuguuuaugauucaguucuccaagaccaucaauccaacaauucggucagcuaguaaggacgagaucgucgccagcuuugaucgccccaugcaagcggccauaaacucuaccuuccucacuuccgcacagagaagggcuaugcugaaaacacugggggugauuaaugacaaccucaagguaucaaccgccguuagcagugcugccaaagcauuuaagaaauuacaguga

SEQ ID NO: 6209 - RNA, 735 nt, Artificial Sequence
  derived and/or modified CDS sequence (opt3) from Phlebovirus(CoAr171616)__EF201836.1__N
augagcuacgaggaaaucgccauucacuucgcuuccgagucuauagacgaaucaaccaucagugcaugggugagcgauuuugccuaucagggcuucgacgcgaagagagucauugcucugaucaaagagaggggaggggaaaacuggaaggaggauguuaaaaagaugauugugcucucccuuacacgggguaauaaacccgccaagaugauccugaagaugucugacaaaggcaagaaagagguaaacgauuugauaacucgcuacaaguuaaaaucggggaauccuucacgagacgaucugacgcuaagccguguggcagccgcuuuugcaggauggaccugccaagccgcugaauauguccaggaguaccucccagugacaggcagagccauggacgcguucagugcagauuuuccgagggcccugaugcaucccuccuucgcuggucuuaucgaccaggaacugccuucuagcgccaugacugauauuguucacgcacauuguuuguuuaugauccaguucuccaagaccauuaacccaacaauccggucagcuaguaaggacgagauaguggccagcuuugaucgccccaugcaagcggccauuaauucuaccuuccucacuuccgcacagagaagggcuaugcugaaaacacugggggucaucaacgacaaucucaaggugucaaccgccguaagcagugcugccaaagcauuuaagaaauuacaguga

SEQ ID NO: 6210 - RNA, 732 nt, Artificial Sequence
  derived and/or modified CDS sequence (opt3) from Phlebovirus(CoAr170255)__EF201840.1__N
augagcuacgaggaaaucgccauucaguucgcuuccgagucuguggacgcaaccacaauagccgcgugggucucagaauuugcuuaucaaggcuucgaugccagacagguuaucaaccuggugaagcagaggggaggggacgauuggaaggaggacguaaagaaaaugauugugcucagucuuacucgggguaauaagcccagcaaaaugcugaacaagauguccgaaucuggccagaagaucgucaaugauuugauuucgaaauacaaguuaaaaucagggaacccuggacgcaaugaccugacgcuaagccgaaucgcagccgcuuuugcaggcuggaccugccaagccgcugaggugguucaggauuaucucccagugacaggucgugccauggacgcgauaagugauaaguucccgagagcacugaugcaccccuccuuugccgggcuugucgacccuacucugccagagggagugguagaagauaucguucaugcucacuguuuguucaugauucaguuuucuaaaaccaucaaccccagccucagguccucaaguaagagcgagguggucucuuccuucgaccggccuaugcaggccgcaauuaauucaccauuucugacagcuggcaaccgcagagauauccugaugagccucggcuuaauaaauaguaaccugaagcccucuccugccgugauugcggccgcaaaaguguacaggaaacuuuga

SEQ ID NO: 6211 - RNA, 732 nt, Artificial Sequence
  derived and/or modified CDS sequence (opt3) from Buenaventura virus(CoAr3319)__KP272003.1__N
augagcuacgaggaaaucgccauucaguucgcuuccgagucuguggacgcaaccacaauagccgcgugggucucagaauuugcuuaucaaggcuucgaugccagacagguuaucaaccuggugaagcagaggggaggggacgauuggaaggaggacguaaagaaaaugauugugcucagucuuacucgggguaauaagcccagcaaaaugcugaacaagauguccgaaucuggccagaagaucgucaaugauuugauuucgaaauacaaguuaaaaucagggaacccuggacgcaaugaccugacgcuaagccgaaucgcagccgcuuuugcaggcuggaccugccaagccgcugaggugguucaggauuaucucccagugacaggucgugccauggacgcgauaagugauaaguucccgagagcacugaugcaccccuccuuugccgggcuugucgacccuacucugccagagggagugguagaagauaucguucaugcucacuguuuguucaugauucaguuuucuaaaaccaucaaccccagccucagguccucaaguaagagcgagguggucucuuccuucgaccggccuaugcaggccgcaauuaauucaccauuucugacagcuggcaaccgcagagauauccugaugagccucggcuuaauaaauaguaaccugaagcccucuccuaccgugguggccgcggccaaagucuacaggaaacuuuga

SEQ ID NO: 6212 - RNA, 732 nt, Artificial Sequence
  derived and/or modified CDS sequence (opt3) from Cocle virus(GML244915)__KP272035.1__N
augagcuacgaggaaaucgccgugcaguucgcuuccgagucuauugacgaacaagcagucgccggcuggguuaccgauuuugcguaucagggguucgacgcuagaagggugauagcccugguaaaggaucggggaggugaggacuggaaacaggaugugaagaaaaugaucguccucucacuuacacgcggcaacaagcccaauaaaauggugcugaagaugagugacaaggggaaagcaaugguuaacgaauugguguuaaaguacaaacuaaagagcggaaauccuucccgagaugaccugacucucucucguauuacggccgcuuuugcaggcuggaccugccaggccgcugauuauguccaagaguaccugccagugacagguagagccauggacgcgaucucgucaggguauccgagggcaaugaugcaccccagcuucgccggacuuauugaucaggagcugccugcugacguauugagugaaaucacucaggcccauugucucuuuaugauacaguucuccaaaaccaucaacccaucucugcggggccugggcaaggaugagauuguuagcuccuuugaacgccccaugcaagcagcuaucucaaguacauuccucaccagcgccaauagaagggcgauguuaaagacucuggggauuaucaacgacaaucuuaaaccuucuuccucaacagugagcgccgcaaaggucuuucggaguuuguga

SEQ ID NO: 6213 - RNA, 732 nt, Artificial Sequence
  derived and/or modified CDS sequence (opt3) from Capira virus(VP-366G)__KP272044.1__N
augagcuacgaggaaaucgccauucaguucgcuuccgagucuauagacgaaucaaccaucgcagccugggugagugauuuugcguaucaaggcuucgacgcuaagcaggucauuauccugauuaaaaagagagggggagagaacuggaaagaagauguuaagaaaaugaucgugcucagccuuacaagggguaauaagcccuccaagaugguaaacaaaaugucugacgagggcaagaaaguggucaaugagcugauaucgaaguacaaauugaagacugggaacccugcccgggaugacuuaacgcugucacgcaucgcagccgcuuuugcaggauggaccugccaggccgcugaauaugugcaggauuaccuaccaguuacaggccgagccauggacgcgcucagcgauaaguauccgcgugcacugaugcaccccaguuucgccggucuuauugacccuacucugccagaugacgcugugaaagauaucguccaugcccacuguuuguuuaugauucaauucuccaagaccaucaaucccucucucagaagcuccacaaaaaccgagauagugaacucauuugacaggccuaugcaggcagcuauuaauaguccauuccugacugccgaaaaccggcgcgcgaugcugacaacccucgggguaaucaauagcaacuuaaagcccucugccgcaguuguggcugccgcuaaagccuacagaaagcuguga

SEQ ID NO: 6214 - RNA, 732 nt, Artificial Sequence
  derived and/or modified CDS sequence (opt3) from Campana virus(VP-334K)__KP272042.1__N
augagcuacgaggaaaucgccauucaguucgcuuccgagucuguggacgcaaccacaauagccgcgugggucucagaauuugcuuaucaaggcuucgaugccagacagguuaucaaccuggugaagcagaggggaggggacgauuggaaagaggacguaaagaaaaugauugugcucagucuuacucgggguaauaagcccagccgcauggucacgaaaauguccgaaucuggccagaagaucgugaacgaucugauuucgaaguacaaauugaagucagggaauccuggacgaaacgacuuaacccugagccguguugcagccgcuuuugcaggcuggacaugccaagccgcugaggugguccaggauuaucuaccagugacugguagagccauggacgcgcucagugauaaauucccgagggcaaucaugcaccccuccuuugccgggcugauagacccuacccuuccagagaauguaguugaagauaucgugcaugcucacugucuguucaugauucaguuuucuaagacaaucaaccccagcuugcgguccucaaguaaaagcgaggucgugucuuccuucgaccgcccuaugcaggccgcaauuaauucaccauuucucaccgcugccaacagaagggauaugcugaugagccugggacucaucaguucuaauuuaaagcccuccgcggccgugacugcagcugccaaggcuuaccggaaacuguga

SEQ ID NO: 6215 - RNA, 738 nt, Artificial Sequence
  derived and/or modified CDS sequence (opt3) from RVFV(ZH-548)__DQ380151.1__N
auggacaacuaccaggagcuggccauccaauucgcugcacaggccguggauagaaaugaaauugagcagugggucagggaauuugcguaucagggcuucgacgcucggcgcguuauagagcuccuuaagcaauacgggggagccgauugggaaaaagacgcaaagaaaaugaucgugcuggccuugacccgagguaacaagccccguagaaugaugaugaaaaugagcaaggagggcaaggcuacaguagaggcauuaauuaauaaauauaagcugaaagaagggaacccuuccagggaugagcuaacucucucucggguggccgcugcccuggcgggauggacgugccaggcacuugucgugcugucagaaugguugccaguuaccggcacaacuauggacggucucaguccggccuacccccgccacaugaugcauccuagcuuugcugggaugguggauccaucccugcccggagacuaucugagagccauccucgaugcacacucuuuauaccugcuucaguucucgagggucauuaauccuaacuugcggggccgcaccaaggaggagguggcugccacauuuacccagccaaugaaugcggccguaaacucaaauuucaucagccaugaaaaacgaagagaguuucugaaggcauucggccuaguugacaguaacgggaagcccuccgcugccgugauggcugccgcacaagccuauaaaacugcugcguga

SEQ ID NO: 6216 - RNA, 738 nt, Artificial Sequence
  derived and/or modified CDS sequence (opt3) from RVFV(OV 35/74)__EF530207.1__N
auggacaacuaccaggagcuggccauccaauucgcugcacaggccguggauagaaaugaaauugagcagugggucagggaauuugcguaucagggcuucgacgcucggcgcguuauagagcuccuuaagcaauacgggggagccgauugggaaaaagacgcaaagaaaaugaucgugcuggccuugacccgagguaacaagccccguagaaugaugaugaaaaugagcaaggagggcaaggcuacaguagaggcauuaauuaauaaauauaagcugaaagaagggaacccuuccagggaugagcuaacucucucucggguggccgcugcccuggcgggauggacgugccaggcacuugucgugcugucagaaugguugccaguuaccggcacaacuauggacggucucaguccggccuacccccgccacaugaugcauccuagcuuugcugggaugguggauccaucccugcccgaggacuaucugagagccauccucgaugcacacucuuuauaccugcuucaguucucgagggucauuaauccuaacuugcggggacgcaccaaggaggaaguggcugccacauuuacccagccaaugaaugcggccguaaacucaaauuucaucagccaugagaaacgaagagaauuucugaaggcauucggccuaguugacaguaacggcaagcccuccgcugccgugauggcugccgcacaagccuauaaaacugcugcguga

SEQ ID NO: 6217 - RNA, 762 nt, Artificial Sequence
  derived and/or modified CDS sequence (opt3) from SFNV(Toscana)__NC_006318.1__N
augagcgacgagaacuacagagauaucgcccuggcuuuccucgacgaauccgcagauucuggcaccauuaaugccugggugaacgaguuugcguaucagggguucgaccccaagaggauaguccaacuuguuaaagaacggggaacagcuaagggucgcgauuggaaaaaggacgugaaaaugaugaucguacugaauuuggugcgaggcaacaagccugaggccaugaugaagaaaaugucagaaaagggggcaaguauugucgccaauuuaaucagcguguaccagcugaaagagggaaacccaggccgugauacuauuacgcuauccagaguuucugcugcauuugugccguggaccguccaggcccucagggugcugucggagucacuucccguaagcgguacaacuauggacgcuaucgccgggguuaccuauccucgggcgaugaugcacccaaguuucgcaggaauaaucgaucuggacuugcccaauggcgccggcgcuacaauugccgaugcacaugggcucuuuaugaucgaguucuccaagaccauuaacccuucucugcgcacuaaacaggcuaaugaaguggccgcgacauuugaaaagccaaacauggccgcaaugagcggaagauucuuuaccagggaggacaagaaaaagcugcucaucgcugucgguauaauugaugaggacuuagugcuggccuccgcugugguccggucagccgaaaaauaccgcgcaaagguuggcaaauga

SEQ ID NO: 6218 - RNA, 762 nt, Artificial Sequence
  derived and/or modified CDS sequence (opt3) from SFNV__HM566170.1__N
augagcgaggaaaacuacagagagaucgcccuggcuuuccucgacgaagcagccgauuccggcaccauuacagcgugggugaaugaguuugcuuaucagggguucgaccccaagaggauaguccaacuuguuaaagaacggggaacugccaagggucgcgauuggaaaaaggacgugaaaaugaugaucguacugaacuuggugcgaggcaauaagccugaggcaaugaugaagaaaaugucugagaagggggccggaauugucgcucaguuaaucucaguguaccagcugaaagaaggcaacccaggucgugauacgauuacccuaaguagaguuagcgcagccuuugugccguggacaauccaggcucucaggguccuguccgacucucuucccgugacugggaccacaauggaugccauagcgggaguaaccuauccucgggcaaugaugcacccaucguucgccggcaucauugaccuggauuugcccaaucgcgcuggcgagguuaucgccgacgcacaugggcucuuuaugcuggaguucucaaagacuauuaacccuagccugagaacaaaacaaccaaaugaaaucgcugccaccuuugagaagcccaacauggcggccaugaguggaagguucuuuacgcgggaagauaagaaaaagcucuuaauggcaguggguauacugaaugaggaccuugucuugacuccugcuauugugaaaugcgccgaaaaguacuguuccaaagugggcaaguga

SEQ ID NO: 6219 - RNA, 735 nt, Artificial Sequence; identical to SEQ ID NO: 6208
  derived and/or modified CDS sequence (opt3) from SFNV(Namru)__HM566168.1__N

SEQ ID NO: 6220 - RNA, 762 nt, Artificial Sequence
  derived and/or modified CDS sequence (opt3) from SFNV(NAMRU 840055)__EF201828.1__N
augagcgaggaaaacuacagagagaucgcccuggcuuuccucgacgaagcagccgauuccggcaccauuacagcgugggugaaugaguuugcuuaucagggguucgaccccaagaggauaguccaacuuguuaaagaacggggaacugccaagggucgcgauuggaaaaaggacgugaaaaugaugaucguacugaacuuggugcgaggcaauaagccugaggcaaugaugaagaaaaugucugagaagggggccggaauugucgcucaguuaaucucaguguaccagcugcgugaaggcaacccagguagagauacgauuacccuaaguaggguuagcgcagccuuugugccguggacaauccaggcucucaaaguccuguccgacucucuucccgugacugggaccacaauggaugccauagcgggaguaguuuauccucgggcaaugaugcacccaucguucgccggcaucauugaccuggauuugcccaaucgcgcuggcgaggccaucgcagacgcucaugggcucuuuaugcuggaguucucaaagaccauuaacccuagccugagaacuaaacaaccaaaugaaaucgccgcgacauuugagaagcccaacauggccgcaaugaguggaagguucuuuacccgggaagauaagaaaaagcucuuaauggcuguggguauacugaaugaggaccuugucuugacgccugccauugugaaaugcgcugaaaaguaccgcuccaaagugggcaaguga

SEQ ID NO: 6221 - RNA, 762 nt, Artificial Sequence
  derived and/or modified CDS sequence (opt3) from SFNV(NAMRU 840055)__EF201829.1__N
augagcgaggaaaacuacagagagaucgcccuggcuuuccucgacgaagcagccgauuccggcaccauuacagcgugggugaaugaguuugcuuaucagggguucgaccccaagaggauaguccaacuuguuaaagaacggggaacugccaagggucgcgauuggaaaaaggacgugaaaaugaugaucguacugaacuuggugcgaggcaauaagccugaggcaaugaugaagaaaaugucugagaagggggccggaauugucgcucaguuaaucucaguguaccagcugaaagaaggcaacccaggucgugauacgauuacccuaaguagaguuagcgcagccuuugugccguggacaauccaggcucucaggguccuguccgacucucuucccgugacugggaccacaauggaugccauagcgggaguaaccuauccucgggcaaugaugcacccaucguucgccggcaucauugaccuggauuugcccaaucgcgcuggcgaggccaucgcagacgcucaugggcucuuuaugcuggaguucucaaagacuauuaacccuagccugagaacaaaacaaccaaaugaaaucgccgcgaccuuugagaagcccaacauggccgcaaugaguggaagguucuuuacgcgggaagauaagaaaaagcucuuaauggcuguugguauacugaaugaggaccuuguguugacuccugccauugucaaaugcgcugaaaaguacuguuccaaagugggcaaguga

SEQ ID NO: 6222 - RNA, 762 nt, Artificial Sequence
  derived and/or modified CDS sequence (opt3) from SFNV(P-7101795)__EF201830.1__N
augagcgaggaaaacuacagagagaucgcccuggcuuuccucaaugaagcagccgacuccggcacaauuacagcgugggugaacgaguuugcuuaucagggguucgaucccaagaggauaguccaacuuguuaaagaacggggaacugccaagggucgcgacuggaaaaaggaugugaaaaugaugaucguacugaauuuggugcgaggcaacaagccugagacgaugaugaagaaaaugucugagaagggggcaggaauugucgcccaguuaaucucaguguaccagcugaaagaaggcaauccaggucgugacaccauuacacuaaguagaguuagcgcugcauuugugccguggacuguccaggcccucagggugcuguccgauucucuucccguaaccgggacaaccauggacgcuaucgccggaguuacuuauccucgggcgaugaugcacccaucguucgcaggcauaaucgaucuggacuugcccaaccgcgccggcgagacaauugcugaugcccaugggcucuuuaugcuggaguucucaaagaccaucaauccuagccugagaacgaaacaaccaaacgaaauugcagcuacuuuugagaagcccaauauggccgcgaugaguggaagguucuuuacccgggaagacaagaaaaagcucuuaauggccguggguguccugaacgaggaucuuguguugaccccugcaaucgugaaaugcgcugaaaaguaccgcuccaaagucggcaaguga

SEQ ID NO: 6223 - RNA, 762 nt, Artificial Sequence
  derived and/or modified CDS sequence (opt3) from SFNV(P-7101795)__EF201832.1__N
augagcgaggaaaacuacagagagaucgcccuggcuuuccucgacgaagcagccgauuccggcaccauuacagcgugggugaaugaguuugcuuaucagggguucgaccccaagaggauaguccaacuuguuaaagaacggggaacugccaagggucgcgauuggaaaaaggacgugaaaaugaugaucguacugaacuuggugcgaggcaauaagccugaggcaaugaugaagaaaaugucugagaagggggccggaauugucgcucaguuaaucucaguguaccagcugcgugaaggcaacccagguagagauacgauuacccuaaguaggguuagcgcagccuuugugccguggacaauccaggcucucaaaguccuguccgacucucuucccgugacugggaccacaauggaugccauagcgggaguaauguauccucgggcaaugaugcacccaucguucgccggcaucauugaccuggauuugcccaaucgcgcuggcgaggccaucgcagacgcucaugggcucuuuaugcuggaguucucaaagaccauuaacccuagccugagaacuaaacaaccaaaugaaaucgccgcgacauuugagaagcccaacauggccgcaaugaguggaagguucuuuacccgggaagauaagaaaaagcucuuaauggcuguugguauacugaaugaggaccuuguguugacgccugccauuaucaaaugcgcugaaaaguaccgcuccaaagucggcaaguga

SEQ ID NO: 6224 - RNA, 762 nt, Artificial Sequence
  derived and/or modified CDS sequence (opt3) from Arrabida virus(PoSFPhlebV/126/2008)__KP863801.1__N
augagcgaggacaacuacagaaccaucgcccuggcuuuccucgaugaauccgcagacucuacaacuauuaaugccugggugaacgaguuugcguaucagggcuucgaucccaagaggauaguccaacuuguuaaagaacgggggacggcuaagggacgcgacuggaaaaaggaugugaaaaugaugaucguacugaauuuggugcgagguaacaagccugagucaaugaugaagaaaaugagugaaaagggcgccgcaauugucacccaguuaaucagcacauaccagcugaaagaggggaauccaggacgugacacuauuacccuauccagagugucugccgcuuuuguuccguggacagugcaggcacucaagacccugucggagucacuucccgucacuggcacaaccauggauagcaucgccgguacgacuuauccuaggugcaugaugcacccaaguuucgcugggauaaucgaccuggaauugcccaacaauaccggagccaugcucgcggaugcacauggccuguuuaugcuggaguucuccaaaacaauuaacccuucucuccggacuaagcaaccaaaugaaaucgccgcuaccuuugagaagcccaacauggccgcaaugacaggccgcuucuuuaccagagacgauaaaaagaaauuacugauugcuaucggggugcuugacgaggauuugguaccuaauccagccauagaaaagugugcggagaaauacaaggccaaaguuggaaaguga

SEQ ID NO: 6225 - RNA, 765 nt, Artificial Sequence
  derived and/or modified CDS sequence (opt3) from Gordil virus(Dak ANBr 496d)__KF297902.1__N
augagcgaggaaaacuacagagagaucgccauggcuuucgcaaaugacuccgccgauuuuaacaugauuucugugugggcgaaugacuucgcuuaucagggcuuugaucccaagaggauagucgaacugguucggcaacgcgggcucgccaaagcacgaaacuggaagcaggacgugaaaaugaugaucguacuuaaucugaugcguggaaacaagccugaggccauggugagaaaaaugcaggaaaagggucagaggauugucuuggaguuaaucucaguguacgagcugaaggaaggcaauccagggcgggauaccauuacacuaagucgcguuagcgcugcauucgugccguggacuaucauggcccucagacaacuggcugagaacauacccgucacgggauccaucauggacucuauucuugauggcgccguguauccuagggcgaugaugcacccaucguuugcagguaucauugaccuggaauugcccgaggggcggggagccgagcucgcugaugcccauggccuguucaugaucgaauuuucaaaaaccauaaauccuagccugcgcacaaagagugcaauugagaucgcugccuccuucgaaaaaccaaacauggcggccaugacuggcaacuuuuucaccaaggacgauaaacgaaagcucuuaaagcagauugggauccuggacucugaucuuaaauugacacccguaaucgagaaggcagcugcccuguacagaagcaaaaccaauaaguga

SEQ ID NO: 6226 - RNA, 762 nt, Artificial Sequence
  derived and/or modified CDS sequence (opt3) from Granada virus(GR25)__GU135608.1__N
augagcgaggacaacuacagaaccaucgcccuggcuuuccucgaugaauccgcagacucuacaacuauuaaugccugggugaacgaguuugcguaucagggcuucgaucccaagaggauaguccaacuuguuaaagaacgggggacggcuaagggacgcgacuggaaaaaggaugugaaaaugaugaucguacugaauuuggugcgagguaacaagccugagucaaugaugaagaaaaugagugaaaagggcgccgcaauugucacccaguuaaucagcacauaccagcugaaagaggggaauccaggacgugacacuauuacccuauccagagugucugccgcuuuuguuccguggacagugcaggcacucaagacccugucggagucacuucccgucacuggcacaaccauggauagcaucgccgguacgacuuauccuaggugcaugaugcacccaaguuucgcugggauaaucgaccuggaauugcccaacaauaccggagccaugcucgcggaugcacauggccuguuuaugcuggaguucuccaaaacaauuaacccuucucuccggacuaagcaaccaaaugaaaucgccgcuaccuuugagaagcccaacauggccgcaaugacaggccgcuucuuuaccagagacgauaaaaagaaauuacugauugcuaucggggugcuuaaugaggacuugguaccuaacccagccauagaaaagugugcggagaaauacaaggccaaaguuggaaaguga

SEQ ID NO: 6227 - RNA, 762 nt, Artificial Sequence
  derived and/or modified CDS sequence (opt3) from Massilia virus(127)__KT906102.1__N
augagcgaggacaacuacagaaccaucgcccuguccuuccucgaugaaacagcugugucuacuucaauuaaugcaugcgucaacgaguuugccuaucagggcuucgaccccaagaggauaguucaacuugugaaagaacgggggacggcgaagggacgcgauuggaaaaaggacguaaaaaugaugaucgugcugaauuugguccgagguaacaagccugagaguaugaugaagaaaaugagcgaaaagggcgcugccauugugacccaguuaaucuccacauaccagcugaaagaggggaauccaggacgugauacuauuacccuaucuagaguuucggcagccuuugugccguggacaguccaggcucucaagacccugucagagagccuucccgugacuggcacaaccauggacaguaucgcagguacgacuuauccuagguguaugaugcacccauccuucgccgggauaaucgaucuggaauugcccaacaauaccggagcuaugcucgccgacgcgcauggccuguuuaugcuggaguucucuaaaacaauuaacccuagccuccggacuaagcaaccaaaugaaaucgcagccaccuuugagaagcccaacauggcugccaugacaggccgcuucuuuaccagagaugacaaaaagaaauuacugauugcaaucgggguacuugaugaggacuugguuccuaauccagcuauagaaaagugcgccgagaaauacaaggcgaaagugggaaaguga

SEQ ID NO: 6228 - RNA, 762 nt, Artificial Sequence
  derived and/or modified CDS sequence (opt3) from Massilia virus(130)__KT906103.1__N
augagcgaggacaacuacagaaccaucgcccuguccuuccucgaugaaacagcugacucuacuucaauuaaugcaugcgugaacgaguuugccuaucagggcuucgaucccaagaggauaguccaacuuguuaaagaacgggggacggcgaagggacgcgacuggaaaaaggaugugaaaaugaugaucguacugaauuuggugcgagguaacaagccugagaguaugaugaagaaaaugagcgaaaagggcgcugccauugucacccaguuaaucuccacauaccagcugaaagaggggaauccaggacgugacacuauuacccuaucuagagugucggcagccuuuguuccguggacagugcaggcucucaagacccugucagagagccuucccgucacuggcacaaccauggauaguaucgcagguacgacuuauccuagguguaugaugcacccauccuucgccgggauaaucgaccuggaauugcccaacaauaccggagcuaugcucgccgaugcgcauggccuguuuaugcuggaguucucuaaaacaauuaacccuagccuccggacuaagcaaccaaaugaaaucgcagccaccuuugagaagcccaacauggcugccaugacaggccgcuucuuuaccagagacgauaaaaagaaauuacugauugcaaucggggugcuugacgaggauuugguaccuaauccagcuauagaaaagugcgccgagaaauacaaggcgaaaguuggaaaguga

SEQ ID NO: 6229 - RNA, 762 nt, Artificial Sequence
  derived and/or modified CDS sequence (opt3) from Naples virus(Yu 8/76)__JF920141.1__N
augagcgaggacgauuaccacaagaucgcccuggcuuucgcagaagaguccgccgacgugucuaccauugaaucaugggucaacgauuuugcguaucagggcuucgaccccagaaggauaguucaacucgugaaagagcgggggacagcuaagggacgcgauuggaaaaaggacguaaaaaugaugaucgugcuuaaucugguccgagguaacaagccugaagccaugaugaagaaaaugagugagaagggcgcagccauuguggcucaguugaucagcguuuaccaguuaaaagaggggaauccaggacgugauacuauuacgcuguccagagugucugcagccuuugucccguggaccgugcaggcucuaaggguacucucggaccaucugcccguuacaggcacuaccauggaugccaucgcgggugugacauauccucgggcaaugaugcacccaucauucgccgggauagucgaccuugaacugccccgcaagaccggagagaugaucgcugaugcccauggcuuguuuaugcucgaguucagcaaaacuauuaacccuagucugagaacaaagcaaccaaaugaaaucgcaaccacguuugagaagcccaacauggcugccauguccggcaaauucuuuucuagggaagacaagaaaaagcugcucaugagcguggggauuaucaaugaugacuuacugcuuacugcguccguggucaaaugcgccgagaaguaccgggcaaaaaccggaaaguga

SEQ ID NO: 6230 - RNA, 762 nt, Artificial Sequence
  derived and/or modified CDS sequence (opt3) from Punique virus(P1_B4_2008)__FJ848987.1__N
augagcgaggaaaacuacagagagaucgcccuggcuuuccucgacgaauccgcagauucuggcaccauuucaacaugggugaaugacuuugccuaucagggguucgaucccaagaggauaguccaacuuguuaaagagcggggaacugcgaagggucgcgacuggaaaaaggaugugaaaaugaugaucguacugaacuuggugcgaggcaauaagccugaaaguaugaugaagaaaaugagcgagaagggggcugccauugucgcacaguuaaucgccgcuuaccagcugaaagagggaaacccaggccgugacacgauuacccuauccagagugucugcagccuuuguuccguggacagugcaggcucucaggucgcugucagauagccuucccgucacugguaccacaauggacaguaucgccggggugaccuauccucggugcaugaugcacccauccuucgcgggaauaaucgaucuggacuugcccaaugauacuggcgcaaugcucgccgacgcucauggccuguuuaugcuggaguucucuaagacaauuaacccuagccuccgcaccaaacaagccaaugaaaucgcagcuacguuugaaaagccaaacauggccgcgaugaaugggagauucuuuacuagggaggauaagaaaaaguuacugauugccaucggaguacuuaacgaggacuugauacccguuuccgcaauugcuaaaugugccgaaaaguaccgggcuaaaguggguaaguga

SEQ ID NO: 6231 - RNA, 762 nt, Artificial Sequence
  derived and/or modified CDS sequence (opt3) from Saint Floris virus(Dak ANB512)__JF920138.1__N
augagcgaggaaaccuacgcccagcuggcuauggcauuccucgccgagcccgcggacugguccacacuuucugugugggucaacgaauuugcuuaucaaggcuucgauccuaagagaaucguugagcugauuauggaaagggggaaaaaguuuaaucgggaguggaaaaaggacgugaaaaugaugauaacuuugaacuuaauccgcggaaauaagccagaggccaugaugcgaaagaugucagauaaaggucguaguauuguaagcgaacugaucuccguguacgagcuaaaggaaggcaacccggggagagacacgauuacccucucuagggucucggcagccuucgugcccuggacaguucgggcucugguggcacuucagaaugaucugccugucacuggagccgcuauggacucaaucugcggcgugaccuauccacgcgccaugaugcaccccagcuuugcggguguaauagauuuggagcucccuaacgggguuggagcacagcuggccgacgcucauggccuguucaugcucgaguuuaguaaaacaaucaauccaggcuuaagaaccaagcagcccaacgaaauugccgcaacuuucgagaaaccuaaucuggcugccaugacagggaaguuuuucaccaaggaagauaaaaggaaggugcuuaucuccgucggagugauuaacucugacuugcaaccaaauagcguggucaaaacgugugcggagcuguaccgggcccgcguuaugaaguga

SEQ ID NO: 6232 - RNA, 762 nt, Artificial Sequence
  derived and/or modified CDS sequence (opt3) from Tehran virus(I-47)__JF939848.1__N
augagcgaggaagacuacagagccaucgcucuguccuucucugaugagucagcagacgugggcauuauaaccacaugggucaacgaauuugccuaucagggguucgaucccaagaggaucguucaacucgugaaagagcggggacaggcgaagggucgcgacuggaaaaaggauguaaaaaugaugauugugcuuaaucugauccgaggcaacaagccugacgcuaugaugaagaaaaugagugaaaagggggccgcaacugucgcccaguuggugagcguuuaccaguuaaaagagggaaauccaggccgugauacgauuacccuguccagagugucugcugcauuugucccguggacagugcaagcccuaaagguacucucggagucacugcccguuacugguaccacaauggacaccguggcuggggucacuuauccuagggccaugaugcaccccagcuucgcgggaaucauagaucuugaacugccaggccgggcaggcgaggccaucgcugacgcccauggguuguuuaugcucgaguucaguaaaacaauuaacccuucccugcgcaccaagcagccaaaugaaaucgcagcuacguuugagaagcccaacauggccgcgaugacuggaagauucuuuaccagggaagauaaaaagaaacugcucauugccguggguaucauaaaugacgauuuacugcuuacaccuucuauugcaaagugcgcugagaaauaccgggccaaggugggcaaauga

SEQ ID NO: 6233 - RNA, 762 nt, Artificial Sequence
  derived and/or modified CDS sequence (opt3) from Zerdali virus(37)__KP966618.1__N
augagcgaggaagacuacagagccaucgcucuguccuucucugaugaggcagccgacgugggcaccauuacagcgugggucaacgaauuugcuuaucagggguucgaucccaagaggauaguucaacucgugcgggagcgcggaaucgccaaaggucgagacuggaagaaagauguaaagaugaugauugugcuuaaucugauccguggcaacaaaccugacgcaaugaugaagaagaugucagaaaaaggggccgcuacugucgcacaguuggugaguguuuaccaguuaaaggagggaaauccaggcagagauacgauuaccccgagcaggguguccgccgcuuuuguccccuggacagugcaggcccugaaaguacuaucugagucgcucccuguuacugguaccacaauggacaccaucgcgggggugucauauccacgggcaaugaugcaccccagcuucgccggaauaaucgaucuggaacuuccucgcagagcuggcgaggucauugccgacgcacauggccuguuuauguuggaguucaguaagacuaucaacccaucccucaggacaaaacaacccaaugaaauugcugccaccuuugagaagccuaacauggcggccaugacggggcgguucuuuacucgcgaagauaagaaaaagcugcugaucgcagugggaauaauuaaugacgaucucuuacuggcuccaucuguggccaaaugcgcugagaaguaccgagccaaagucgguaaguga

SEQ ID NO: 6234 - RNA, 762 nt, Artificial Sequence; identical to SEQ ID NO: 6217
  derived and/or modified CDS sequence (opt3) from TOSV(9028)__KU904263.1__N

SEQ ID NO: 6235 - RNA, 762 nt, Artificial Sequence
  derived and/or modified CDS sequence (opt3) from TOSV(SI-121283)__JF330274.1__N
augagcgacgagaacuacagagauaucgcccuggcuuuccucgacgaauccgcagauucuggcaccauuaaugccugggugaacgaguuugcguaucagggguucgaccccaagaggauaguccaacuuguuaaagaacggggaacagcuaagggucgcgauuggaaaaaggacgugaaaaugaugaucguacugaauuuggugcgaggcaacaagccugaggccaugaugaagaaaaugucagaaaagggggcaaguauugucgccaauuuaaucagcguguaccagcugaaagagggaaacccaggccgugauacuauuacgcuauccagaguuucugcugcauuugugccguggaccguccaggcccucagggugcugucggagucacuucccguaagcgguacaacuauggacgcuaucgccgggguuaccuauccucgggcgaugaugcacccaaguuucgcaggaauaaucgaucuggacuugcccaauggcgccggcgcuacaauugccgaugcacaugggcucuuuaugaucgaguucuccaagaccauuaacccuucucugcgcacuaaacaggcuaaugaaguggccgcgacauuugaaaacccaaauauggccgcaaugagcggaagauucuuuaccagggaggacaagaagaaacugcucaucgcugucgguauaauugaugaggacuuagugcuggccuccgcugugguccggucagccgaaaaguaccgcgcaaaaguuggcaaguga

SEQ ID NO: 6236 - RNA, 762 nt, Artificial Sequence
  derived and/or modified CDS sequence (opt3) from TOSV(5963930705)__KU935733.1__N
augagcgacgagaacuacagagauaucgcccuggcuuuccucgacgaauccgcagauucuggcaccauuaaugccugggugaacgaguuugcguaucagggguucgaccccaagaggauaguccaacuuguuaaagaacggggaacagcuaagggucgcgauuggaaaaaggacgugaaaaugaugaucguacugaauuuggugcgaggcaacaagccugaggccaugaugaagaaaaugucagaaaagggggcaaguauugucgccaauuuaaucagcguguaccagcugaaagagggaaacccaggccgugauacuauuacgcuauccagaguuucugcugcauuugugccguggaccguccaggcccucagggugcugucggagucacuucccguaagcgguacaacuauggacgcuaucgccgggguuaccuauccucgggcgaugaugcacccaaguuucgcaggaauaaucgaucuggacuugcccaauggcgccggcgcuacaauugccgaugcacaugggcucuuuaugguggaguucuccaagaccaucaacccuucucugcgcacuaaacaggcuaaugaagucgccgcgacauuugaaaagccaaacauggccgcaaugagcggaagauucuuuaccagggaggacaagaaaaagcugcucauugcuguggguaucauagaugaggacuuagugcuggccuccgcugucguucggucagccgaaaaauaccgcgcaaaggugggcaaauga

SEQ ID NO: 6237 - RNA, 762 nt, Artificial Sequence
  derived and/or modified CDS sequence (opt3) from TOSV(MRS2010-4319501)__KC776214.1__N
augagcgacgagaacuacagagauaucgcccuggcuuuccucgacgaauccgcagauucuggcaccauuaaugccugggugaacgaguuugcguaucagggguucgaccccaagaggauaguccaacuuguuaaagaacggggaacagcuaagggucgcgauuggaaaaaggacgugaaaaugaugaucguacugaauuuggugcgaggcaacaagccugaggccaugaugaagaaaaugucagaaaagggggcaaguauugucgccaauuuaaucagcguguaccagcugaaagagggaaacccaggccgugauacuauuacgcuauccagaguuucugcugcauuugugccguggaccguccaggcccucagggugcugucggagucacuucccguaagcgguacaacuauggacgcuaucgccgggguuaccuauccucgggcgaugaugcacccaaguuucgcaggaauaaucgaucugcauuugcccaauggcgccggcgcuacaauugccgacgcacacgggcucuuuaugaucgaguucuccaagaccauuaacccuucucugcgcacuaaacaggcuaaugaaguggccgcgacauuugaaaagccaaacauggccgcaaugagcggaagauucuuuaccagggaggauaagaaaaagcugcucaucgcugucgguauaauugacgaggauuuagugcuggccuccgcugugguccggucagccgaaaaauaccgcgcaaagguuggcaaauga

SEQ ID NO: 6238 - RNA, 762 nt, Artificial Sequence
  derived and/or modified CDS sequence (opt3) from TOSV(TOSV/Firenze.ITA/1983/2)__KM275765.1__N
augagcgacgagaacuacagagauaucgcccuggcuuuccucgacgaaugcgcagauuccggcaccauuaaugccugggugaacgaguuugcguaucagggguucgaccccaagaggauaguccaacuuguuaaagaacggggaacagcuaagggucgcgauuggaaaaaggacgugaaaaugaugaucguacugaauuuggugcgaggcaacaagccugaggccaugaugaagaaaaugucugaaaagggggcaucaauugucgccaauuuaaucaguguguaccagcugaaagagggaaacccaggccgugauacuauuacgcuaagcagaguuuccgcugcauuugugccguggaccguccaggcccucagggugcugucugagucgcuucccguaucagguacaacuauggacgcuaucgccgggguuaccuauccucgggcgaugaugcaccccagcuucgcaggaauaaucgaucuggacuugccaaauggcgccggcgcuacaauugccgaugcacaugggcucuuuaugaucgaguucaguaagaccauuaacccuucccugcgcacuaaacaggcuaaugaaguggccgcgacauuugaaaagccaaacauggccgcaaugucuggaagauucuuuaccagggaggacaagaaaaagcugcucaucgcugucgguauaauugaugaggacuuagugcuggccagcgcugugguccgguccgccgaaaaauaccgcgcaaagguuggcaaauga

SEQ ID NO: 6239 - RNA, 738 nt, Artificial Sequence
  derived and/or modified CDS sequence (opt3) from SFTSV(HB29)__NC_018137.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucauggcccugcaggaaaaguauggccuuguagagcgagcagaaacccgucuguccauuacaccugugagagucgcccagucuuugccaacuuggaccugcgcugcagccgcugcccucaaagaguaccugccggugggucccgcgguuaugaaucugaagguggagaacuauccuccagaaaugauguguauggcauucgggucgcucauccccacagccggagucucagaggcuaccacuaaaacauuaauggaagccuacagccuguggcaggaugcauuuaccaagacgauaaaugugaagaugaggggcgcuaguaaaacugagguauauaacuccuuccgggacccucuucacgccgcgguuaauucuguguuuuucccaaacgauguccgcgugaagugguugaaagccaagggcauccuggggcccgacggagugccuagcagagcagcugaagucgccgcugccgcauacaggaaucuauga

SEQ ID NO: 6240 - RNA, 738 nt, Artificial Sequence
  derived and/or modified CDS sequence (opt3) from SFTSV(111S)__KP339904.1__N
augagcgagugguccagaaucgccguggaguucggcgaacagcaacugaaccucaccgaacuugaggacuuugcuagggaacuggcauacgagggguuggaucgggccuuaauuauaaagaaacugaaggagacaggaggugacgauugggucaaagacacuaaguucaucauuguuuuugcgcuaacgcgcggcaauaaaaucgugaaggcuucugggaagaugucaaacaguggaagcaaacgacucauggcccugcaggaaaaguauggccuuguagagcgugcagaaaccagacuguccauuacacccgugagggucgcccagucuuugccuacuuggaccugcgcugcagccgcugcccucaaagaguaccugccaguggguccggcgguuaugaaucugaagguggagaacuaucccccugaaaugauguguauggcauucgggucgcucaucccaacagccggagucucagaggcuaccacuaaaacauuaauggaagccuacagccuguggcaggaugcauuuaccaagacgauaaaugugaagaugcggggcgcuaguaaaacugagguauauaacuccuuccgcgacccccuucacgccgcgguuaauucuguguuuuucccuaacgaugucagagugaagugguugaaagccaagggcauccuggggccagacggagugcccagcagggcagcugaagucgccgcugccgcauaccggaaucuauga

SEQ ID NO: 6241 - RNA, 738 nt, Artificial Sequence
  derived and/or modified CDS sequence (opt3) from SFTSV(116S)__KP339905.1__N
augagcgagugguccagaaucgccguggaauuuggcgagcagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucauggcccugcaggaaaaguauggccuuguagagcgagcagaaacccgucuguccauuacaccugugagagucgcccagucuuugccaacuuggaccugcgcugcagccgcugcccucaaagaguaccugccggugggucccgcgguuaugaaucugaagguggagaacuauccuccagaaaugauguguauggcauucgggucgcucauccccacagccggagucucagaggcuaccacuaaaacauuaauggaagccuacagccuguggcaggaugcauuuaccaagacgauaaaugugaagaugaggggcgcuaguaaaacugagaucuauaacuccuuccgggacccucuucacgccgcgguaaauucuguuuucuucccaaacgaugugcgcgucaagugguugaaagccaagggcauucuggggcccgacggagugccuagcagagcagcugaaguggccgcugccgcauacaggaaucuauga

SEQ ID NO: 6242 - RNA, 738 nt, Artificial Sequence
  derived and/or modified CDS sequence (opt3) from SFTSV(132S)__KP339912.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucucuguuuuugcgcuaacgcggggcaauaaaauugugaaggcuucagggaagaugaguaacagcggauccaaacgccucauggcccugcaggaaaaguauggccuuguagagcgagcagaaacccgucugucuaucacaccugugagagucgcccagucguugccaacuuggaccugcgcugcagccgcugcccucaaagaguaccugccggugggucccgcgguuaugaaucugaagguggagaacuauccuccagaaaugauguguauggcauucgggucacucauucccacagccggagucagcgaggcuaccacuaaaacauuaauggaagccuacagucuguggcaggaugcauuuaccaagacgaucaaugugaagaugaggggcgcuuccaaaacugagguauauaacucuuuccgggacccucuucacgccgcgguuaauagcguguuuuucccaaacgauguccgcgugaagugguugaaagccaagggcauacuggggcccgacggagugccuuccagagcagcugaagucgccgcugccgcauacaggaaucuauga

SEQ ID NO: 6243 - RNA, 738 nt, Artificial Sequence
  derived and/or modified CDS sequence (opt3) from SFTSV(2014045S)__KR075923.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucauggcccugcaggaaaaguauggccuuguagagcgagcagaaacccgucuguccauuacaccugugagagucgcccagucuuugccaacuuggaccugcgcugcagccgcugcccucaaagaguaccugccggugggucccgcgguuaugaaucugaagguggagaacuauccuccagaaaugauguguauggcauucgggucgcucauccccacagccggagucucagaggcuaccacuaaaacauuaauggaagccuacagccuguggcaggaugcauuuaccaagacgauaaaugugaagaugaggggcgcuaguaaaacugagguauauaacuccuuccgggacccucuucacgccgcgguuaauucuguguuuuucccaaacgauguccgcgugaagugguugaaagccaagggcauccuggggcccgacggagcaccuagcagagcugccgaaguggcugccgcagccuacaggaaucuauga

SEQ ID NO: 6244 - RNA, 738 nt, Artificial Sequence
  derived and/or modified CDS sequence (opt3) from SFTSV(2014193S)__KR075916.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucauggcccugcaggaaaaguauggccuuguagagcgagcagaaacccgucuguccgugacaccugucagaguggcccagucuuugccaacuuggaccugcgcugcagccgcugcccucaaagaguaccugccgguuggucccgcggugaugaaucugaaggucgagaacuauccuccagaaaugauguguauggcauucgggucgcucauucccacagccggagugucagaggcuaccacuaaaacauuaauggaagccuacagccuguggcaggaugcauuuaccaagacgaucaauguaaagaugaggggcgcuaguaaaacugagguuuauaacuccuuccgggacccucuucacgccgcggucaauucuguguuuuucccaaacgaugugcgcgugaagugguugaaagccaagggcauacuggggcccgacggagucccuagcagagcagcugaaguugccgcugccgcauacaggaaucuauga

SEQ ID NO: 6245 - RNA, 738 nt, Artificial Sequence
  derived and/or modified CDS sequence (opt3) from SFTSV(2015SH232S)__KT736097.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucauggcccugcaggaaaaguauggccuuguagagcgagcagaaacccgucuguccauuacaccugugagagucgcccagucuuugccaacuuggaccugcgcugcagccgcugcccucaaagaguaccugccggugggucccgcgguuaugaaucugaagguggagaacuauccuccagaaaugauguguauggcauucgggucgcucauccccacagccggagucucagaggcuaccacuaaaacauuaauggaagccuacagccuguggcaggaugcauuuaccaagacgauaaaugugaagaugaggggcgcuaguaaaacugagguauauaacuccuuccgggacccucuucacgccgcgguuaauucuguguuuuucccaaacgauguccgcgugagaugguugaaggccaaaggcauccuggggcccgacggagugccuagcagggcagcugaagucgccgcugccgcauaccggaaucuauga

SEQ ID NO: 6246 - RNA, 738 nt, Artificial Sequence
  derived and/or modified CDS sequence (opt3) from SFTSV(2015SYSH33)__KT380653.1__N
augagcgagugguccagaaucgccguggaguucggcgaacagcaacucaaccuuaccgaacuggaggacuuugcuagggaauuggcauacgagggguuagaucccgcccugauuauaaagaaacuaaaggagacaggaggugacgauugggucaaagacacuaaguucaucauuguuuuugcgcucacgcggggcaauaaaaucgugaaggcuucugggaagaugucaaacaguggaagcaaacgccugauggcccuucaggaaaaguauggccugguagagcgagcagaaacccguuuguccauuacaccugugagagucgcccagucucucccaacuuggaccugcgcugcagccgcugcccugaaagaguaccugccggugggucccgcgguuaugaaucucaagguggagaacuauccuccagaaaugauguguauggcauucgggucguuaauccccacagccggagucucagaggcuaccacuaaaacacugauggaagccuacagccuuuggcaggaugcauuuaccaagacgauaaaugugaagaugaggggcgcuaguaaaacugagguauauaacuccuuccgggacccuuugcacgccgcgguuaauucuguguuuuucccaaacgauguccgcgugaaguggcugaaagccaagggcauccuagggcccgacggagugccuagcagagcagcugaagucgccgcugccgcauacaggaaucucuga

SEQ ID NO: 6247 - RNA, 738 nt, Artificial Sequence
  derived and/or modified CDS sequence (opt3) from SFTSV(2015SYSH86)__KT380657.1__N
augagcgagugguccagaaucgccguggaauuuggcgagcagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucauuaaggcuucugggaagaugucaaacaguggaagcaaacgccucauggcccugcaggaaaaguauggccuuguggagcgagcagaaacccgucuguccaucacaccuguaagaguggcccagucuuugccaacuuggaccugcgcugcagccgcugcccucaaagaguaccugccggucggucccgcggugaugaaucugaagguugagaacuauccuccagaaaugauguguauggcauucgggucgcucauacccacagccggagugucagaggcuaccacuaaaacauuaauggaagccuacagccuguggcaggaugcauuuaccaagacgaucaaugucaagaugaggggcgcuaguaaaacugagguguauaacuccuuccgggacccucuucacgccgcgguaaauucuguuuucuucccaaacgaugugcgcgucaagugguugaaagccaagggcauucuggggcccgacggagugccuagcagagcagcugaaguggccgcugccgcauacaggaaucuauga

SEQ ID NO: 6248 - RNA, 738 nt, Artificial Sequence
  derived and/or modified CDS sequence (opt3) from SFTSV(67S)__KP339890.1__N
augagcgagugguccagaaucgccguggaguucgcugaacagcaacugaaccucaccgaacuugaggacuuugcaagggaacuggccuacgagggcuuggaucccgcguuaauuauaaagaaacugaaggagacagggggagacgauugggucaaagacacuaaguucaucauuguuuuugcucuaacgcgggguaauaaaaucgugaaggccucuggcaagaugucaaacagugggagcaaacgccucauggcacugcaggaaaaguauggacuuguagagcgagccgaaacccgucuguccauuacaccugugagagucgcucagucuuugccaacuuggaccugcgcagccgcugccgcgcucaaagaguaccugccggugggccccgcaguuaugaaucugaagguggagaacuauccuccagaaaugauguguauggccuucgguucgcucauccccacagcuggggucucagaggccaccacuaaaacauuaauggaagcauacagccuguggcaggaugcuuuuaccaagacgauaaaugugaagaugaggggagccaguaaaacugagguauauaacuccuuccgggacccucuucacgcggccguuaauucuguguuuuucccaaacgauguccgcgugaagugguugaaagcaaagggcauccugggccccgacggggugccuagcagagcugccgaagucgcugccgcagccuacaggaaucuauga

SEQ ID NO: 6249 - RNA, 738 nt, Artificial Sequence
  derived and/or modified CDS sequence (opt3) from SFTSV(6S)__KP339927.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucauggcccugcaggaaaaguauggccuuguagagcgagcagaaacccguuucuccauuacaccugugagagucgcccagucucugccaacuuggaccugcgcugcagccgcugccuugaaagaguaccucccggugggucccgcgguuaugaaucugaagguggagaacuauccuccagaaaugauguguauggcauuugggucgcugauccccacagccggagucucagaggcuaccacuaaaacacucauggaagccuacagcuuauggcaggaugcauucaccaagacgauaaaugugaagaugaggggcgcuaguaaaacugagguauauaacuccuuucgggacccucugcacgccgcgguuaauucuguguucuuuccaaacgauguccgcgugaaguggcuuaaagccaagggcaucuuggggcccgacggagugccuagcagagcagcugaagucgccgcugccgcauacaggaaucuguga

SEQ ID NO: 6250 - RNA, 738 nt, Artificial Sequence
  derived and/or modified CDS sequence (opt3) from SFTSV(72S)__KP339891.1__N
augagcgagugguccagaaucgccguggaguucggcgaacagcaacugacccucacagaacuugaggacuuugcuagggaacuggcauacgagggguuggaucccgccuuaauuauaaagaaacugaaggagacuggaggugacgauugggucaaagacacgaaguucaucauuguuuuugcgcuaacccggggcaacaaaaucgugaaggcuucugggaagaugucaaauaguggaagcaaacgccucauggcccugcaggaaaaguauggccuuguagagcgagcagaaacacgucuguccauuacuccugugagagucgcccagucuuugccaaccuggacaugcgcugcagccgcugcccucaaagaguaccugccggugggucccgcgguuaugaaccugaagguggagaauuauccuccagaaaugauguguauggcauucgggucgcucauccccaccgccggagucucagaggcuacuacaaaaaccuuaauggaagccuacagccuguggcaggaugcauuuacgaagacuauaaacgugaagaugaggggcgcuaguaaaaccgagguauauaauuccuuccgggacccucuucacgccgcgguuaacucuguguuuuucccaaaugauguccgcgugagaugguugaaggccaaaggcauccuggggcccgacggagugccuagcagggcagcugaagucgccgcugccgcauaccggaaccuauga

SEQ ID NO: 6251 - RNA, 738 nt, Artificial Sequence
  derived and/or modified CDS sequence (opt3) from SFTSV(AP01-Korea-13)__KR612072.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauuggguccgggacacuaaauucaucauuguuuuugcgcuaacgcgcggcaauaagaucgugaaggcuucugggaaaaugucaaacaguggaagcaagcgacucauggcccugcaggaaaaauauggccuuguagagcgugcagaaaccagacuguccauuacaccugugagggucgcccagucuuugccaacuuggaccugcgcugcagccgcugcccucaaggaguaccugccggugggucccgcgguuaugaaucugaaaguggagaacuauccuccagaaaugauguguauggcauucgggucgcucauccccacagccggagucucagaggcuaccacuaagacauuaauggaagccuacagccuguggcaggaugcauuuaccaaaacgauaaaugugaagaugcggggcgcuaguaagacugagguauauaacuccuuccgcgacccucuucacgccgcgguuaauucuguguuuuucccaaacgaugucagagugaaaugguugaaggccaaaggcauccuggggcccgacggagugccuagcagggcagcugaagucgccgcugccgcauaccggaaucuauga

SEQ ID NO: 6252 - RNA, 738 nt, Artificial Sequence
  derived and/or modified CDS sequence (opt3) from SFTSV(JP03-Korea-13)__KR612079.1__N
augagcgagugguccagaaucgccguggaguucggagaacagcaacugaaccucaccgaacuugaggacuuugcuagggaacuggcauacgagggguuggaucccgccuuaauuauaaagaaacugaaggagacaggaggugacgauuggguccgggacacuaaauucaucauuguuuuugcgcuaacgcgcggcaauaagaucgugaaggcuucugggaaaaugucaaacaguggaagcaagcgacucauggcccugcaggaaaaauauggccuuguagagcgugcagaaaccagacuguccauuacaccugugagggucgcccagucuuugccaacuuggaccugcgcugcagccgcugcccucaaggaguaccugccggugggucccgcgguuaugaaucugaaaguggagaacuauccuccagaaaugauguguauggcauucgggucgcucauccccacagccggagucucagaggcuaccacuaagacauuaauggaagccuacagccuguggcaggaugcauuuaccaaaacgauaaaugugaagaugcggggcgcuaguaagacugagguauauaacuccuuccgcgacccucuucacgccgcgguuaauucuguguuuuucccaaacgaugucagagugaaaugguugaaggccaaaggcauccuggggcccgacggcauuccuagcagggcagcugaaguggccgcugccgcauaccggaaucuauga

SEQ ID NO: 6253 - RNA, 738 nt, Artificial Sequence
  derived and/or modified CDS sequence (opt3) from SFTSV(JP07-Korea-13)__KR612088.1__N
augagcgagugguccagaaucgccguggaguucggcgaacaccagcugaaccucaccgaacuugaggacuuugcuagggaacuggcauacgagggguuggaucccgccuuaauuauaaagaaacugaaggagacaggaggugacgauuggguccgggacacuaaauucaucauuguuuuugcgcuaacgcgcggcaauaagaucgugaaggcuucugggaaaaugucaaacaguggaagcaagcgacucauggcccugcaagaaaaauauggccuuguagagcgugcagaaaccagacuguccauuacaccugugagggucgcccagucuuugccaacuuggaccugcgcugcagccgcugcccucaaggaguaccugccggugggucccgcgguuaugaaucugaaaguggagaacuauccuccagaaaugauguguauggcauucgggucgcucauccccacagccggagucucagaggcuaccacuaagacauuaauggaagccuacagccuguggcaggaugcauuuaccaaaacgauaaaugugaagaugcggggcgcuaguaagacugagguauauaacuccuuccgcgacccucuucaugccgcgguuaauucuguguuuuucccaaacgaugucagagugaaaugguugaaggccaaaggcauccuggggcccgacggagugccuagcagggcagcugaagucgccgcugccgcauaccggaaucuauga

SEQ ID NO: 6254 - RNA, 738 nt, Artificial Sequence
  derived and/or modified CDS sequence (opt3) from SFTSV(JS2011-13-2)__KR230790.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaguagcggauccaaacgccucauggcccugcaggaaaaguauggccuuguagagcgagcagaaacccgucugucuauuacaccugugagagucgcccagucguugccaacuuggaccugcgcugcagccgcugcccucaaagaguaccugccggugggucccgcgguuaugaaccugaagguggagaauuauccuccagaaaugauguguauggcauucgggucacucauccccacagccggagucagcgaggcuaccacuaaaacauuaauggaagccuacagucuguggcaggaugcauuuaccaagacgauaaacgugaagaugaggggcgcuuccaaaacugagguauauaauucuuuccgggacccucuucacgccgcgguuaacagcguguuuuucccaaaugauguccgcgugaagugguugaaagccaagggcauccuggggcccgacggagugccuuccagagcagcugaagucgccgcugccgcauacaggaaccuauga

SEQ ID NO: 6255 - RNA, 738 nt, Artificial Sequence
  derived and/or modified CDS sequence (opt3) from SFTSV(JS2014-15)__KR230799.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucauggcccugcaggaaaaguauggccuuguagagcgagcagaaacccgucuguccauuacaccugugagagucgcccagucuuugccaacuuggaccugcgcugcagccgcugcccucaaagaguaccugcugguggguccggcgguuaugaaucucaagguggagaacuaucccccugaaaugauguguauggcauucgggucguuaaucccaacagccggagucucagaggcuaccacuaaaacacugauggaagccuacagccuuuggcaggaugcauuuaccaagacgauaaaugugaagaugaggggcgcuaguaaaacugagguauauaacuccuuccgggaccccuugcacgccgcgguuaauucuguguuuuucccuaacgauguccgcgugaaguggcugaaagccaagggcauccuagggccagacggagugcccagcagagcagcugaagucgccgcugccgcauacaggaaucucuga

SEQ ID NO: 6256 - RNA, 738 nt, Artificial Sequence
  derived and/or modified CDS sequence (opt3) from SFTSV(KASJH)__KP663733.1__N
augagcgagugguccagaaucgccguggaguucggcgaacagcaacugaaccucucugaacuugaggacuuugcuagggaacuggcauacgagggguuggaucccgccuuaauuauaaagaaacugaaggagaccggaggugacgauugggucaaagacacaaaguucaucauuguuuuugcgcuaacucggggcaauaaaaucgugaaggcuucagggaagaugaguaacagcggauccaaacgccucauggcccugcaggaaaaguauggccuuguagagcgagcagaaacgcgucugucuauuaccccugugagagucgcccagucguugccaacauggacuugcgcugcagccgcugcccucaaagaguaccugccggugggucccgcgguuaugaaucugaagguggagaacuauccuccagaaaugauguguauggcauucgggucacucauccccaccgccggagucagcgaggcuacaaccaaaacuuuaauggaagccuacagucuguggcaggaugcauuuacaaagaccauaaaugugaagaugaggggcgcuuccaaaacggagguauauaacucuuuccgggacccucuucacgccgcgguuaauagcguguuuuucccaaacgauguccgcgugaagugguugaaagccaagggcauccuggggcccgacggagugccuuccagagcagcugaagucgccgcugccgcauacaggaaucuauga

SEQ ID NO: 6257 - RNA, 738 nt, Artificial Sequence
  derived and/or modified CDS sequence (opt3) from SFTSV(YSH116)__KT721303.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucauggcccugcaggaaaaguauggccuuguagagcgagcagaaacccgucuguccauuacaccugugagagucgcccagucuuugccaacuuggaccugcgcugcagccgcugcccucaaagaguaccugccggugggucccgcgguuaugaaucugaagguggagaacuauccuccagaaaugauguguauggcauucgggucgcucauccccacagccggagucucagaggcuaccacuaaaacauuaauggaagccuacagccuguggcaggauguguuuaccaagacgauaaauguaaagaugaggggcgcaaguaaaacugagguuuauaacuccuuccgggacccucuucacgcugccgucaauucuguguuuuucccaaacgaugugcgcgugaagugguugaaagcgaagggcauccuggggcccgacggagucccuagcagagccgcagaaguugcugccgcugccuacaggaaucuauga

SEQ ID NO: 6258 - RNA, 738 nt, Artificial Sequence
  derived and/or modified CDS sequence (opt3) from SFTSV(AH-YTY/China/05/2012)__KR017811.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucauggcccugcaggaaaaguauggccuuguagagcgagcagaaacccgucuguccauuacaccugugagagucgcccagucuuugccaacuuggaccugcgcugcagccgcugcccucaaagaguaccugccggugggucccgcgguuaugaaucugaagguggagaacuauccuccagaaaugauguguauggcauucgggucgcucauccccacaaccggagucucagaggccacuacaaaaaccuuaauggaggcuuacagccuguggcaggaugccuuuacgaagacuauaaaugugaagaugaggggcgcaaguaaaaccgaaguauauaacuccuuccgggacccucuucacgcugccguuaauucuguguuuuucccaaacgauguccgcgugaagugguugaaagcgaagggcauccuggggcccgacggagugccuagcagagccgcagaagucgcugccgcugccuacaggaaucuauga

SEQ ID NO: 6259 - RNA, 738 nt, Artificial Sequence
  derived and/or modified CDS sequence (opt3) from SFTSV(DS02/CHN/2013)__KR698319.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauuggguccgggacacuaaauucaucauuguuuuugcgcuaacgcgcggcaauaagaucgugaaggcuucugggaaaaugucaaacaguggaagcaagcgacucauggcccugcaggaaaaauauggccuuguagagaaggcagaaacccgucuguccauuacaccugugagagucgcccagucuuugccaacuuggaccugcgcugcagccgcugcccucaaagaguaccugccggugggucccgcgguuaugaaucugaagguggagaacuauccuccagaaaugauguguauggcauucgggucgcucauccccacagccggagucucagaggcuaccacuaaaacauuaauggaagccuacagccuguggcaggaugcauuuaccaagacgauaaaugugaagaugaggggcgcuaguaaaacugagguauauaacuccuuccgggacccucuucacgccgcgguuaauucuguguuuuucccaaacgauguccgcgugaagugguugaaagccaagggcauccuggggcccgacggagugccuagcagagcagcugaagucgccgcugccgcauacaggaaucuauga

SEQ ID NO: 6260 - RNA, 738 nt, Artificial Sequence
  derived and/or modified CDS sequence (opt3) from SFTSV(HB2014-13)__KU738908.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucauggcccugcaggaaaaguauggccuuguagagcgagcagaaacccgucuguccauuacaccugugagagucgcccagucuuugccaacuuggaccugcgcugcagccgcugcccucaaagaguaccugccggugggucccgcgguuaugaaucugaagguggagaacuauccuccagaaaugauguguauggcauucgggucgcucauccccacaaccggagucucagaggccacuacaaaaaccuuaauggaggcuuacagccuguggcaggaugccuuuacgaagacuauaaaugugaagaugaggggcgcaaguaaaaccgaaguauauaacuccuuccgggacccucuucacgcugccguuaauucuguguuuuucccaaacgauguccgcgugagaugguugaaggcgaaaggcauccuggggcccgacggagugccuagcagggccgcagaagucgcugccgcugccuaccggaaucuauga

SEQ ID NO: 6261 - RNA, 738 nt, Artificial Sequence
  derived and/or modified CDS sequence (opt3) from SFTSV(HB2014-20)__KU738910.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucaugacccugcaggaaaaguauggccuuguagagcgagccgaaacacgucuguccauuacuccugugagagucgcacagucuuugccaaccuggacaugcgccgcugcagccgcucucaaagaguaccugccggugggucccgccguuaugaaucugaagguggagaacuauccuccagaaaugauguguauggcguucgggucgcucauccccaccgcaggagucucagaggccacuacaaaaaccuuaauggaggcuuacagccuguggcaggaugccuuuacgaagacuauaaaugugaagaugaggggcgcaaguaaaaccgaaguauauaacuccuuccgggacccucuucacgcugccguuaauucuguguuuuucccaaacgauguccgcgugaagugguugaaagcgaagggcauccuggggcccgacggagugccuagcagagccgcagaagucgcugccgcugccuacaggaaucuauga

SEQ ID NO: 6262 - RNA, 738 nt, Artificial Sequence
  derived and/or modified CDS sequence (opt3) from SFTSV(LN2012-14)__KF887431.1__N
augagcgagagauccaggaucgccguggaguucggcgaacagcaacugaaccucaccgggcuugaagacuuugcucgggagcuggcauacgaaggauuggaucccgccuuaauuauaaagaaacugaaggagacagguggcgacgauugggucaaagacacuaaguucaucauuguuuuugcgcuaacgcgcgggaauaaaaucgugaaggcuucuggaaagaugucaaacaguggcagcaaacgacucauggcccugcaggagaaguauggucuuguagaacgugcagagaccagacuguccauuacaccugugagggucgcccagucuuugccaacuuggaccugcgcugcagccgcugcccucaaagaauaccugccgguggggcccgcgguuaugaaucugaagguggagaacuauccuccagagaugauguguauggcauucggaucgcucauccccacagccggcgucucagaagcuaccacucggacauuaauggaggccuacagccuguggcaggaugcauuuaccaaaacgauaaaugugaagaugcgcggcgcuaguaagacugaaguauauaacuccuucagagacccucuucacgccgcgguuaauucuguguuuuucccaaacgaugucagggugaaaugguugaaggccaaagggauccugggacccgacggugugccuagccgggcagcugaggucgccgcugccgcauaccgcaaucuauga

SEQ ID NO: 6263 - RNA, 738 nt, Artificial Sequence
  derived and/or modified CDS sequence (opt3) from SFTSV(NB31/CHN/2013)__KR698325.1__N
augagcgagugguccagaaucgccguggaguucggcgaacagcaacugaaccucauugaacuugaggacuuugcuagggaacuggcauacgagggguuggaucccgccuuaauaaucaagaaacugaaggagaccggaggugacgauuggguccgggacacaaaauucauuaucguuuuugcgcuaacucgcggcaauaagauugugaaggcuucugggaaaaugucaaacaguggaagcaagcgacucauggcccugcaggaaaaauauggccuuguagagaaggcagaaacgcgucuguccaucaccccugugagagucgcccagucuuugccaacauggacuugcgcugcagccgcugcccucaaagaguaccugccggugggucccgcgguuaugaaucugaagguggagaacuauccuccagaaaugauguguauggcauucgggucgcucauacccaccgccggagucucaaaaccuacaaccaagacuuuaauggaggcuuacagccuguggcaggaugccuuuacaaagaccaucaaugugaaaaugaggggcgcaaguaagacggaaguauauaacuccuuccgggacccacuucacgcugccguuaauucuguguuuuuccccaacgauguccgcgugaaaugguugaaggcgaaaggcauucuggggccugacggagugccaagcagagccgcagaggucgcugccgcugccuacaggaaucuauga

SEQ ID NO: 6264 - RNA, 738 nt, Artificial Sequence
  derived and/or modified CDS sequence (opt3) from SFTSV(QD7)__KR706565.1__N
augagcgagugguccagaaucgccguggaguucggcguccagcaacugaaccucaccgaacuugaagacuuugcuagggagcuggcauacgaaggguuggaucccgccuuaauuauaaagaaacugaaggagacaggaggugacgauuggguuaaagacacuaaguucaucauuguguuugcgcuaacgcggggcaauaaaaucguaaaggcuucugggaagaugucaaacaguggaagcaaacgccucauggcccugcaggagaaguauggccuuguggaacgagcagagacccgucuguccauuacaccugucagaguggcccagucuuugccaacuuggaccugcgcugcagccgcugcccucaaagaauaccugccgguuggucccgcggugaugaaucugaaggucgagaacuauccuccagagaugauguguauggcauucgggucgcucauccccacagccggagugucagaagcuaccacuaaaacauuaauggaggccuacagccuguggcaggaugcauuuaccaagacgauaaauguaaagaugaggggcgcuaguaaaacugaaguuuauaacuccuuccgggacccucuucacgccgcggucaauucuguguuuuucccaaacgaugugcgcgugaagugguugaaagccaagggcauccuggggcccgacggagucccuagcagagcagcugagguugccgcugccgcauacaggaaucuauga

SEQ ID NO: 6265 - RNA, 738 nt, Artificial Sequence
  derived and/or modified CDS sequence (opt3) from SFTSV(SDLZP06/2011)__JQ693009.1__N
augagcgagugguccagaaccgccguggaguucggcgaacagcaacugaaccucacagaacuugaggacuuugcuagggaacuggcauacgagggguuggaucccgccuuaaucauuaagaaacugaaggagacuggaggugacgauugggucaaagacacgaaguucauaaucguuuuugcgcuaacccggggcaauaaaauugugaaggcuucugggaagaugucaaacaguggaagcaaacgccucauggcccugcaggaaaaguauggccuuguagagcgagcagaaacacgucuguccaucacuccugugagagucgcccagucuuugccaaccuggacaugcgcugcagccgcugcccucaaagaguaccugccggugggucccgcgguuaugaaucugaagguggagaacuauccuccagaaaugauguguauggcauucgggucgcucauucccaccgccggagucucagaggcuacuacaaaaaccuuaauggaagccuacagccuguggcaggaugcauuuacgaagacuaucaaugugaagaugaggggcgcuaguaaaaccgagguauauaacuccuuccgggacccucuucacgccgcgguuaauucuguguuuuucccaaacgauguccgcgugaagugguugaaagccaagggcauacuggggcccgacggagugccuagcagagcagcugaagucgccgcugccgcauacaggaaucuauga

SEQ ID NO: 6266 - RNA, 738 nt, Artificial Sequence
  derived and/or modified CDS sequence (opt3) from SFTSV(ZJZHSH-FDE/China/06/2012)__KR017821.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauuggguccgggacacuaaauucaucauuguuuuugcgcuaacgcgcggcaauaagaucgugaaggcuucugggaaaaugucaaacaguggaagcaagcgacucauggcccugcaggaaaaauauggccuuguagagaaggcagaaacccgucuguccauuacaccugugagagucgcccagucuuugccaacuuggaccugcgcugcagccgcugcccucaaagaguaccugccggugggucccgcgguuaugaaucugaagguggagaacuauccuccagaaaugauguguauggcauucgggucgcucauccccacagccggagucucagaggcuaccacuaaaacauuaauggaagccuacagccuguggcaggaugcauuuaccaagacgauaaaugugaagaugaggggcgcuaguaaaacugagguauauaacuccuuccgggacccucuucacgccgcgguuaauucuguguuguuuccaaacgauguccgcgugaaguggcugaaagccaagggcauccuagggcccgacggagugccuagcagagcagcugaagucgccgcugccgcauacaggaaucucuga

SEQ ID NO: 6267 - RNA, 738 nt, Artificial Sequence
  derived and/or modified CDS sequence (opt3) from SFTSV(ZJZHSH-FZHR/China/07/2013)__KR017824.1__N
augagcgagugguccagaaucgccguggaauuuggcgagcagcaacugaaccucaccgaacuugaggacuuugcuagggaacuggcauacgagggguuggaucccgccuuaauuauaaagaaacugaaggagacaggaggugacgauuggaugaaagacacuaaguucaucauugucuuugcgcuaacgcggggcaauaaaaucguuaaggcuucugggaagaugucaaacaguggaagcaaacgccucauggcccugcaggaaaaguauggccuuguggagcgagcagaaacccgucuguccauuacaccuguaagaguggcccagucuuugccaacuuggaccugcgcugcagccgcugcccucaaagaguaccugccggucggucccgcggugaugaaucugaagguugagaacuauccuccagaaaugauguguauggcauucgggucgcucauccccacagccggagugucagaggcuaccacuaaaacauuaauggaagccuacagccuguggcaggaugcauuuaccaagacgauaaaugucaagaugaggggcgcuaguaaaacugagguguauaacuccuuccgggacccucuucacgccgcgguaaauucuguuuucuucccaaacgaugugcgcgucaagugguugaaagccaagggcauccuggggcccgacggagugccuagcagagcagcugaaguggccgcugccgcauacaggaaucuauga

SEQ ID NO: 6268 - RNA, 738 nt, Artificial Sequence
  derived and/or modified CDS sequence (opt3) from SFTSV(ZJZHSH-HYC/China/05/2012)__KR017809.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauuggguccgggacacuaaauucaucauuguuuuugcgcuaacgcgcggcaauaagaucgugaaggcuucugggaaaaugucaaacaguggaagcaagcgacucauggcccugcaggaaaaauauggccuuguagagaaggcagaaacccgucuguccauuacaccugugagagucgcccagucuuugccaacuuggaccugcgcugcagccgcugcccucaaagaguaccugccggugggucccgcgguuaugaaucugaagguggagaacuauccuccagaaaugauguguauggcauucgggucgcucauccccacagucggagugucagaggccaccacuaaaacauuaauggaggcuuacagccuguggcaggaugccuuuaccaagacgauaaauguaaagaugaggggcgcaaguaaaacugaaguuuauaacuccuuccgggacccucuucacgcugccgucaauucuguguuuuucccaaacgaugugcgcgugaagugguugaaagcgaagggcauccuggggcccgacggagucccuagcagagccgcagaaguugcugccgcugccuacaggaaucuauga

SEQ ID NO: 6269 - RNA, 738 nt, Artificial Sequence
  derived and/or modified CDS sequence (opt3) from SFTSV(SPL003A)__AB817996.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauuggguccgggacacuaaauucaucauuguuuuugcgcuaacgcgcggcaauaagaucgugaaggcuucugggaaaaugucaaacaguggaagcaagcgacucauggcccugcaggaaaaauauggccuuguagagcgugcagaaaccagacuguccauuacaccugugagggucgcccagucuuugccaacuuggaccugcgcugcagccgcugcccucaaggaguaccugccggugggucccgcgguuaugaaucugaaaguggagaacuauccuccagaaaugauguguauggcauucgggucgcucauccccacagccggagucucagaggcuaccacuaagacauuaauggaagccuacagccuguggcaggaugcauuuaccaaaacgauaaaugugaagaugcggggcgcuaguaagacugagguauauaacuccuuccgcgacccucuucacgccgcgguuaauucuguguuuuucccaaacgaugucagagugaaaugguugaaggccaaaggcauccuggggcccgacggagcaccuagcagggcugccgaaguggcugccgcagccuaccggaaucuauga

SEQ ID NO: 6270 - RNA, 738 nt, Artificial Sequence
  derived and/or modified CDS sequence (opt3) from SFTSV(SPL077A)__AB985536.1__N
augagcgaguggcccagaaucgccguggaguucggcgaacagcaacugaaccucaccgaacuugaggacuuugcuagggaacuggcauacgagggguuggauccugccuuaauuauaaagaaacugaaggagacaggaggugacgauuggguccgggacacuaaauucaucauuguuuuugcgcuaacgcgcggcaauaagaucgugaaggcuuccgggaaaaugucuaacucaggaaguaagcgacucauggcccugcaggaaaaauauggccuuguagagcgugcagaaaccagacugagcauuacaccagugagggucgcccaguccuugccgacuuggaccugcgcugcagccgcugcccucaaggaguaccugcccguggguccugcgguuaugaaucugaaaguggagaacuauccacccgaaaugauguguauggcauucgggucucucaucccuacagccggagucucggaggcuaccacuaagacauuaauggaagccuacucacuguggcaggaugcauuuaccaaaacgauaaaugugaagaugcggggcgcuagcaagacugagguauauaacaguuuccgcgacccacuucacgccgcgguuaauuccguguuuuuccccaacgaugucagagugaaaugguugaaggccaaaggcauccuggggccugacggagugccaucuagggcagcugaagucgccgcugccgcauaccggaaucuauga

SEQ ID NO: 6271 - RNA, 738 nt, Artificial Sequence
  derived and/or modified CDS sequence (opt3) from SFTSV(SPL106A)__AB985548.1__N
augagcgacugguccagaaucgccguggaguucggcgaacagcaacugaaccucaccgagcuugaagauuuugcuagggagcuggcauacgaaggguuggaccccgccuuaauuauaaagaaacugaaggagacaggaggugaugacuggguccgggauacuaaauucaucauuguuuuugcgcuaacgcgcggcaauaagaucgugaaggcuucugggaaaaugucaaacaguggaagcaagcgacucauggcccugcaggagaaauauggccuuguagaacgugcagagaccagacuguccauuacaccugugagggucgcccagucuuugccaacuuggaccugcgcugcagccgcugcccucaaggaauaccugccggugggucccgcgguuaugaaucugaaaguggagaacuauccuccagagaugauguguauggcauucgggucgcucauccccacagccggagucucagaagcuaccacuaagacauuaauggaggccuacagccuguggcaggacgcauuuaccaaaacgauaaaugugaagaugcggggcgcuaguaagacugaaguauauaacuccuuccgcgauccucuucacgccgcgguuaauucuguguuuuucccaaacgacgucagagugaaaugguugaaggccaaaggcauccuggggcccgauggagugccuagcagggcagcugaggucgccgcugccgcauaccggaaucuauga

SEQ ID NO: 6272 - RNA, 738 nt, Artificial Sequence
  derived and/or modified CDS sequence (opt3) from SFTSV(SPL114A)__AB985552.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauuggguccgggacacuaaauucaucauuguuuuugcgcuaacgcgcggcaauaagaucgugaaagcuccugggaagaugucuaacucaggaaguaagcgacucauggcccugcaggaaaaauauggccuuguagagcgugcagaaaccagacugagcauuacaccagugagggucgcccaguccuugccgacuuggaccugcgcugcagccgcugcccucaaggaguaccugcccguggguccugcgguuaugaaucugaaaguggagaacuauccacccgaaaugauguguauggcauucgggucucucaucccuacagccggagucucggaggcuaccacuaagacauuaauggaagccuacucacuguggcaggaugcauuuaccaaaacgauaaaugugaagaugcggggcgcuagcaagacugagguauauaacaguuuccgcgacccacuucacgccgcgguuaauuccguguuuuuccccaacgaugucagagugaaaugguugaaggccaaaggcauccuggggccugacggagugccaucuagggcagcugaagucgccgcugccgcauaccggaaucuauga

SEQ ID NO: 6273 - RNA, 738 nt, Artificial Sequence
  derived and/or modified CDS sequence (opt3) from SFTSV(SPL125A)__AB985557.1__N
augagcgagugguccggcguggccgucgaguucggggaacagcaacugaaccucaccgaacuugaggacuuugcuagagaacuggcauacgagggauuggaucccgccuuaaucauuaagaaacugaaggagacagguggcgacgauuggguuagggacacuaaauucauaaucguguuugcgcuaacgcgggggaauaagauuguaaaggcuucuggaaaaaugucaaacaguggcagcaagcgccucauggcccugcaggaaaaauauggucuuguggagcgagcagaaacccgucuguccaucacaccugucagaguggcccagucuuugccaacuuggaccugcgcugcagccgcugcccucaaggaguaccugccgguugggcccgcggugaugaaucugaaagucgagaacuauccuccagaaaugauguguauggcauucggaucgcucauucccacagccggcgugucagaggcuaccacuaagacauuaauggaagccuacagccuguggcaggaugcauuuaccaaaacgaucaauguaaagaugaggggcgcuaguaagacugagguuuauaacuccuuccgggacccucuucacgccgcggucaauucuguguuuuucccaaacgaugugcgcgugaaaugguugaaggccaaagggauacugggacccgacggugucccuagcagagcagcugaaguugccgcugccgcauacaggaaucuauga

SEQ ID NO: 6274 - RNA, 738 nt, Artificial Sequence
  derived and/or modified CDS sequence (opt3) from SFTSV(SPL160A)__AB985571.1__N
augagcgagugguccagaaucgccguggaguucggcgaacagcaacugaaccucaccgaacuugaggacuuugcuagggaacuggcauacgagggguuggaucccgccuuaauuauaacaaagcugaaagagacuggaggugacgauuggguccgggacacgaaguucaucauuguuuuugcgcuaacccgcggcaauaaaaucgugaaggcuucugggaaaaugucaaacaguggaagcaagcgacucauggcccugcaggaaaaguauggccuuguagagcgugcagaaacaagacuguccauuacuccugugagggucgcccagucuuugccaaccuggacaugcgcugcagccgcugcccucaaagaguaccugccggugggucccgcgguuaugaaucugaagguggagaacuauccuccagaaaugauguguauggcauucgggucgcucauccccaccgccggagucucagaggcuacuacaaaaaccuuaauggaagccuacagccuguggcaggaugcauuuacgaagacuauaaaugugaaaaugcggggcgcuaguaagaccgagguauauaacuccuuccgcgacccucuucacgccgcgguuaauucuguguuuuucccaaacgaugucagagugaagugguugaaagccaagggcauccuggggcccgacggagugccuagcagggcagcugaagucgccgcugccgcauaccggaaucuauga

SEQ ID NO: 6275 - RNA, 738 nt, Artificial Sequence
  derived and/or modified CDS sequence (opt3) from SFTSV(SPL163A)__AB985573.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauuggguccgggacacuaaauucaucauuguuuuuccucuaacgcgcggcaauaagaucgugaaagcgucugggaagaugucaaacaguggaagcaagcgacucauggcucugcaggaaaaauauggccuuguagagcgugccgaaaccagacuguccauuacaccagugagggucgcacagucuuugccgacuuggaccugcgccgcugcagccgcucucaaggaguaccugcccguggguccugccguuaugaaucugaaaguggagaacuauccacccgaaaugauguguauggcguucgggucgcucaucccuacagcaggagucucagaggccaccacuaagacauuaauggaggcuuacagccuguggcaggaugccuuuaccaaaacgauaaaugugaagaugcggggcgcaaguaagacugaaguauauaacuccuuccgcgacccacuucacgcugccguuaauucuguguuuuuccccaacgaugucagagugaaaugguugaaggcgaaaggcauccuggggccugacggagugccaagcagggccgcagaagucgcugccgcugccuaccggaaucuauga

SEQ ID NO: 6276 - RNA, 738 nt, Artificial Sequence
  derived and/or modified CDS sequence (opt3) from SFTSV/FTLSV(2011YPQ12)__KF711915.1__N
augagcaagugguccagaaucgccguggaguucggcgaacagcaacugaaccucaccgagcuugaagacuuugcuagggagcuggcauacgaaggguuggaucccgccuuaauuaucaaaaagcugaaagagacaggaggugacgauugggucaaggacacuaaauucauaauuguuuuugcgcuaacgcggggcaauaagaucgugaaggcuucugggaaaaugucaaacaguggaagcaagcgccucauggcccugcaggagaaauauggccuuguagaacgagcaaagacccgucuguccauuacaccugugagagucgcccagucuuugccaacuuggaccugcgcugcagccgcugcccucaaagaguaccugccggugggucccgcgguuaugaaucugaagguggaaaacuauccuccagagaugauguguauggcauucgggucgcucauccccacagccggagucucagaggcuaccacuaagacauuaauggaagccuacagccuguggcaggaugcauuuaccaaaacgauaaaugugaagaugaggggcgcuaguaaaacugagguauauaacuccuuccgggacccucuucacgccgcgguuaauucuguguuuuucccaaacgauguccgcgugaagugguugaaagccaagggcauccuggggcccgacggagugccuagcaaagcagcugaagucgccgcugccgcauacagaaaucuauga

SEQ ID NO: 6277 - RNA, 738 nt, Artificial Sequence
  derived and/or modified CDS sequence (opt3) from SFTSV/FTLSV(2011YXX9)__KF711898.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucauggcccugcaggaaaaguauggccuuguagagcgagcagaaacccgucuguccauuacaccugugagagucgcccagucuuugccaacuuggaccugcgcugcagccgcugcccucaaagaguaccugccggugggucccgcgguuaugaaucugaagguggagaacuauccuccagaaaugauguguauggcauucgggucgcucauccccacagccggagucucagaggcuaccacuaaaacauuaguggaagccuacagccuguggcaggaugcauuuaccaagacgauaaauguaaagaugaggggcgcuaguaaaacugagguuuauaacuccuuccgggacccucuucacgccgcggucaauucuguguuuuucccaaacgaugugcgcgugaagugguugaaagccaagggcauccuggggcccgacggagucccuagcagagcagcugaaguugccgcugccgcauacaggaaucuauga

SEQ ID NO: 6278 - RNA, 738 nt, Artificial Sequence
  derived and/or modified CDS sequence (opt3) from SFTSV/FTLSV(YPQ2)__KF356519.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucauggcccugcaggaaaaguauggccuuguagagcgagcagaaacccgucuguccauuacaccugugagagucgcccagucuuugccaacuuggaccugcgcugcagccgcugcccucaaagaguaccugccggugggucccgcgguuaugaaucugaagguggagaacuauccuccagaaaugauguguauggcauucgggucgcucauccccacagccggagucucagaggcuaccacuaaaacauuaauggaagccuacagccuguggcaggaugcauuuaccaagacgauaaaugugaagaugaggggcgcuaguaaaacugagguauauaacuccuuccgggacccucuucacgccgcgguuaauucuguguuuuucccaaacgauguccgcgugaagugguugaaagccaagggcauccuggggcccaauggagugccuagcagagcagcugaagucgccgcugccgcauacaggaaccuauga

SEQ ID NO: 6279 - RNA, 738 nt, Artificial Sequence
  derived and/or modified CDS sequence (opt3) from SFTSV/Guertu virus(DXM)__KT328591.1__N
augagcgagugguccaagaucgccguggaguucggcgaacagcaacugaacgucauugaacucgaggaauuugcuagagagcuugcauacgaggggcuggaccccgccuugauaaucaaaaaguuaaaagaaguuggaggugaugacuggaugagggauaccaaguucauuaucguguuugcgcugacacggggcaauaaaauucuaaaggcugccgggaagaugucuaacucaggaaguaaacgcaucauggcacuccaggagaaguauggccugguagaacgagccgagacucgucuuagcauaacgccugugagagucgcucagucccugccaaccuggacaugcucugcagccgcugccuugcaggaguaccucccggugggucccgcgguuaugucgcugaaagugucaaauuucccuccagaaaugauguguauggcauuugggagccugauccccgccacuggagucccugagaguaccacaaagauucucauggaggcuuauuccuuauggcaagacgccuucaccaaaacuaucaacgugaagaugaggggcgcaucuaaggcugaaguauacaauagcuuucgggauccacugcacgccgcgguuaacuccguguucuuucccaaugacguccgccuuagaugguugaaaucaaagggcauucuggggccugauggacuaccaaguaaagccguggaaacagcagcugccgcuuauaggaaccucuga

SEQ ID NO: 6280 - RNA, 738 nt, Artificial Sequence
  derived and/or modified CDS sequence (opt3) from SFTSV/Huaiyangshan virus(2010-FQM)__HQ419240.1__N
augagcgagugguccagaaucgccgugaaguucggcgaacagcaacugaaccucaccgagcuugaagacuuugcuagggagcuggcauacgaaggguuggaucccgccuuaauuaucaaaaagcugaaagagacaggaggugacgauugggucaaggacacuaaauucauaauuguuuuugcgcuaacgcggggcaauaagaucgugaaggcuucugggaaaaugucaaacaguggaagcaagcgccucauggcccugcaggagaaauauggccuuguagaacgagcagagacccgucuguccauuacaccugugagagucgcccagucuuugccaacuuggaccugcgcugcagccgcugcccucaaggaauaccugccggugggucccgcgguuaugaaucugaaaguggagaacuauccuccagagaugauguguauggcauucgggucgcucauccccacagccggagucucagaagcuaccacuaagacauuaauggaggccuacagccuguggcaggaugcauuuaccaagacgauaaaugugaaaaugaggggcgcuaguaagacugaaguauauaacuccuuccgggacccucuucacgccgcgguuaauucuguguuuuugccaaacgauguccgcgugaaauggcugaaggccaaaggcauccuagggcccgacggagugccuagcagagcagcugaggucgccgcugccgcauacaggaaucucuga

SEQ ID NO: 6281 - RNA, 738 nt, Artificial Sequence
  derived and/or modified CDS sequence (opt3) from SFTSV/Huaiyangshan virus(2010-ZGQ)__HQ419241.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucaugucccugcaggaaaaguauggccuuguagagcgagccgaaacccgucugucuauuacaccugugagagucgcacagucguugccaacuuggaccugcgccgcugcagccgcucucaaagaguaccugccggugggucccgccguuaugaaucugaagguggagaacuauccuccagaaaugauguguauggcguucgggucacucauccccacagcaggagucagcgaggccaccacuaggacauuaauggaggcuuacagucuguggcaggaugccuuuaccaaaacgauaaaugugaagaugcggggcgcauccaagacugaaguauauaacucuuuccgcgacccucuucacgcugccguuaauagcguguuuuucccaaacgaugucagagugaaaugguugaaggcgaaaggcauccuggggcccgacggagugccuuccagggccgcagaagucgcugccgcugccuaccggaaucuauga

SEQ ID NO: 6282 - RNA, 738 nt, Artificial Sequence
  derived and/or modified CDS sequence (opt3) from SFTSV/Huaiyangshan virus(S-HGX)__HQ171192.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucauggcccugcaggaaaaguauggccuuguagagcgagcagaaacccgucuguccauuacaccugugagagucgcccagucuuugccaacuuggaccugcacagcugcagccgcucucaaagaguaccugccggugggucccgccguuaugaaucugaagguggagaacuauccuccagaaaugauguguauggcguucgagucgcucauccccaccgcaggggucucagaagccacuacaaaaaccuuaauggaggcuuacagccuguggcaggaugccuuuacgaagacuauaaauguggaaaugaggggagcaaguaagaccgagguauauaacuccuuccgggacccucuucacgcugccguuaauucuguguuuuucccaaacgauguccgcgugaaaugguugaaggcgaaaggcauccugggccccgacggggugccuagcagagccgcagaggucgcugccgcugccuacaggaaucuauga

SEQ ID NO: 6283 - RNA, 738 nt, Artificial Sequence
  derived and/or modified CDS sequence (opt3) from SFTSV/Huaiyangshan virus(S-HZM)__HQ171193.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacugaguucaucauuguuuuugcgcuaacgcggggcaauaagaucgugaaggcuucugggaaaaugucaaacaguggaagcaagcgccucauggcccugcaggaaaaauauggccuuguagaacgagcagagacccgucuguccauuacaccugugagagucgcccagucuuugccaacuuggaccugcgcugcagccgcugcccucaaggaguaccugccggugggucccgcgguuaugaaucugaaaguggaaaacuauccuccagagaugauguguauggcauucgggucgcucauccccacaaccggagucucagaagccacuacaaagaccuuaauggaggcuuacagccuguggcaggaugccuuuacgaaaacuauaaaugugaagaugaggggcgcaaguaagaccgaaguauauaacuccuuccgggacccucuucacgcugccguuaauucuguguuuuucccaaacgauuugcgcgucaaauggcugaaggcgaaaggcauccuagggcccgacggagugccuagcagagccgcagagguggcugccgcugccuacaggaaucucuga

SEQ ID NO: 6284 - RNA, 738 nt, Artificial Sequence
  derived and/or modified CDS sequence (opt3) from SFTSV/Huaiyangshan virus(S-WJ)__HQ171191.1__N
augagcgagugguccagaaucgccguggaguucggcgaacagcaacugaaccucaccgaacuugaggacuuugcuagggaacuggcauacgagggguugggacccgccuuaauuauaaagaaacugaaggagacagguggcgaugacugggucaaagauacuaaguucaucauuguuuuugcgcuaacgcgggggaauaaaaucgugaaggcuucuggaaagaugucaaacaguggcagcaaacgccucauggcccugcaggaaaaguauggucuuguagagcgagcagaaacccgucuguccauuacaccugugagagucgcccagucuuugccaacuuggaccugcgcugcagccgcugcccucaaagaguaccugccgguggggcccgcgguuaugaaucugaagguggagaacuauccuccagaaaugauguguauggcauucggaucgcucauccccacagccggcgucucagaggcuaccacuaaaacauuaauggaagccuacagccuguggcaggacgcauuuaccaagacgauaaaugugaagaugaggggcgcuaguaaaacugagguauauaacuccuuccgggauccucuucacgccgcgguuaauucuguguuuuucccaaacgacguccgcgugaagugguugaaagccaaggggauccugggacccgauggugugccuagcagagcagcugaagucgccgcugccgcauacaggaaucuauga

SEQ ID NO: 6285 - RNA, 738 nt, Artificial Sequence
  derived and/or modified CDS sequence (opt3) from SFTSV/Phlebovirus(JS2010-019)__JQ317180.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucauggcccugcaggaaaaguauggccuuguagagcgagcagaaacccgucuguccauuacaccugugagagucgcccagucuuugccaacuuggaccugcgcugcagccgcugcccucaaagaguaccugccggugggucccgcgguuaugaaucugaagguggagaacuauccuccagaaaugauguguauggcauucgggucgcucauccccacagccggagucucagaggcuaccacuaaaacauuaauggaagccuacagccuguggcaggaugcauuuaccaagacgauaaaugugaagaugaggggcgcuaguaaaacugagguauauaacuccuuccgggacccucuucacgccgcgguuaauucuguguuuuucccaaacgauguccgcgugaagugguugaaagccaagggcauccuggggcccgacggagugccuagcagagcagcugaagccgcugccgcagccuacaggaaucuauga

SEQ ID NO: 6286 - RNA, 738 nt, Artificial Sequence
  derived and/or modified CDS sequence (opt3) from SFTSV/Phlebovirus(SD24/China/2010 strain SD24)__HM802205.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucauggcccugcaggaaaaguauggccuuguagagcgagcagaaacccgucuguccauuacaccugugagagucgcccagucuuugccaacuuggaccugcgcugcagccgcugcccucaaagaguaccugccggugggucccgcgguuaugaaucugaagguggagaacuauccuccagaaaugauguguauggcauucgggucgcucauccccacagccggagucaccgaggcuacuacaaaaaccuuaauggaagccuacucacuguggcaggaugcauuuacgaagacuauaaaugugaagaugaggggcgcuagcaaaaccgagguauauaacaguuuccgggacccucuucacgccgcgguuaauuccguguuuuucccaaacgauguccgcgugaagugguugaaagccaagggcauccuggggcccgacggagugccuucuagagcagcugaagucgccgcugccgcauacaggaaucuauga

SEQ ID NO: 6287 - RNA, 738 nt, Artificial Sequence
  derived and/or modified CDS sequence (opt3) from SFTSV/Phlebovirus(ZJ1/China/2011)__HE663216.1__N
augagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauuggguccgggacacuaaauucaucauuguuuuugcgcuaacgcgcggcaauaagaucgugaaggcuucugggaaaaugucaaacaguggaagcaagcgacucauggcccugcaggaaaaauauggccuuguagagaaggcagaaacccgucuguccauuacaccugugagagucgcccagucuuugccaacuuggaccugcgcugcagccgcugcccucaaagaguaccugccggugggucccgcgguuaugaaucugaagguggagaacuauccuccagaaaugauguguauggcauucgggucgcucauccccacagccggagucucagaggcuaccacuaaagccuuaauggaagcauacagccuguggcaggaugcuuuuacaaagaccauaaaugugaagaugaggggcgccaguaaaacggagguauauuccucuuuccgggacccucuucacgcggccguuaacagcguguuuuucccaaaugauguccgcgugaagugguugaaagcaaagggcauccuggggcccgacggagugccuuccagagcugccgaagucgcugccgcagccuacaggaaccuauga

SEQ ID NO: 6288 - RNA, 1287 nt, Artificial Sequence
  derived and/or modified CDS sequence (opt1) from ANDV(Chile-9717869)__AF291702.1__N
augagcacccugcaggagcuccaggagaacaucaccgcccacgagcagcagcuggugacggcccgccagaagcugaaggacgcggagaaggccgucgagguggaccccgacgacgugaacaaguccacccuccagagccggcgcgccgccgucuccacccuggagaccaagcugggcgagcucaagcggcagcuggccgaccugguggcggcccagaagcucgccacgaagccgguggaccccaccgggcuggagcccgacgaccaccugaaggagaaguccagccuccgcuacggcaacguccuggacgugaacagcaucgaccuggaggagcccuccgggcagaccgccgacuggaaggcgaucggcgccuacauccucggguucgccaucccgaucauccugaaggcccuguacaugcucagcacccggggccgccagacggugaaggacaacaagggcacccggauccgcuucaaggacgacuccagcuucgaggaggucaacgggauccggaagcccaagcaccuguacguguccaugcccaccgcccagagcaccaugaaggcggaggagaucacgcccggccgcuuccggaccaucgccugcgggcuguucccggcccaggugaaggcccgcaacaucaucucccccgucaugggcgugaucggguucggcuucuucgugaaggacuggauggaccggaucgaggaguuccucgccgcggagugccccuuccugcccaagccgaaggucgccagcgaggccuucauguccaccaacaagauguacuuccugaaccgccagcgccaggugaacgagagcaaggugcaggacaucaucgaccucaucgaccacgccgagaccgaguccgccacgcuguucaccgagaucgcgacgccccacagcgucuggguguucgccugcgcccccgaccggugcccgcccaccgcccuguacguggccggcguccccgagcucggggcguucuucuccauccugcaggacaugcggaacaccaucauggccagcaagagcgugggcaccgccgaggagaagcugaagaagaaguccgccuucuaccagagcuaccuccgccggacccaguccauggggauccagcuggaccagaagaucaucauccuguacaugcucagcuggggcaaggaggcggugaaccacuuccaccugggcgacgacauggaccccgagcugcgccagcucgcccagucccugaucgacaccaaggucaaggagaucagcaaccaggagccccugaagcucuga

SEQ ID NO: 6289 - RNA, 1287 nt, Artificial Sequence
  derived and/or modified CDS sequence (opt1) from ANDV(Nort)__AF325966.1__N
augagcacccugcaggagcuccaggagaacaucaccgcccacgagcagcagcuggugacggcccgccagaagcugaaggacgcggagaagaccgucgagguggaccccgacgaggugaacaaguccacccuccagagccggcgcgccgccgucuccacccuggagacgaagcugggcgagcucaagcggcagcuggccgaccugguggccgcgcagaagcucgccaccaagccgguggaccccaccgggcuggagcccgacgaccaccugaaggagaaguccagccuccgcuacggcaacguccuggacgugaacagcaucgaccuggaggagcccuccgggcagaccgccgacuggaaggccaucggcgcguacauccucggguucgccaucccgaucauccugaaggcccuguacaugcucagcacgcggggccgccagaccgugaaggacaacaagggcacccggauccgcuucaaggacgacuccagcuucgaggaggucaacgggauccggaagcccaagcaccuguacguguccaugcccaccgcccagagcacgaugaaggccgaggagaucacccccggccgcuuccggaccaucgcgugcgggcuguucccggcccaggugaaggcccgcaacaucaucucccccgucaugggcgugaucggguucagcuucuucgugaaggacuggauggagcggaucgaggacuuccucgccgccgagugccccuuccugcccaagccgaaggcgcuguccgaggccuucauggccaccaacaaggccuacuuccucaaccgccagcggcaggucaacgacagcaaggugcaggacaucguggaccugaucgaccacgccgagaucgaguccgcgacgcuguucaccgacaucgccacgccccacagcgucuggguguucgccugcgcccccgaccgcugcccgcccaccgcccucuacguggcgggcguccccgagcugggcgccuucuucgccauccugcaggacaugcggaacaccaucauggccuccaagagcguggggaccgcggaggagaagcucaagaagaaguccgccuucuaccagagcuaccugcgccggacccaguacaugggcauccagcuggaccagaagaucaucauccucuacaugcugagcugggggaaggaggccgugaaccacuuccaccugggcgacgacauggaccccgagcuccgccagcuggcccagucccugaucgacaccaaggucaaggagaucagcaaccaggagccccucaagcuguga

SEQ ID NO: 6290 - RNA, 1287 nt, Artificial Sequence
  derived and/or modified CDS sequence (opt1) from ANDV(CHI-7913)__AY228237.1__N
augagcacccugcaggagcuccaggagaacaucaccgcccacgagcagcagcuggugacggcccgccagaagcugaaggacgcggagaaggccgucgagguggaccccgacgacgugaacaaguccacccuccagaaccggcgcgccgccgucagcacccuggagaccaagcugggcgagcucaagcggcagcuggccgaccugguggcggcccagaagcucgccacgaagccgguggaccccaccgggcuggagcccgacgaccaccugaaggagaaguccagccuccgcuacggcaacguccuggacgugaacuccaucgaccuggaggagcccagcgggcagaccgccgacuggaaggcgaucggcgccuacauccucggguucgccaucccgaucauccugaaggcccuguacaugcucuccacccggggccgccaggccgugaaggacaacaagggcacgcggauccgcuucaaggacgacagcuccuucgaggaggucaacgggauccggaagcccaagcaccuguacgugagcaugcccaccgcgcaguccaccaugaaggccgaggagaucacccccggccgcuuccggacgaucgccugcgggcuguucccggcccaggugaaggcccgcaacaucaucagccccgucaugggcgugaucggguucggcuucuucgugaaggacuggauggaccggaucgaggaguuccucgcggccgagugccccuuccugcccaagccgaaggucgccuccgaggccuucaugagcaccaacaagauguacuuccugaaccgccagcgccaggugaacgaguccaaggugcaggacaucaucgaccucaucgaccacgccgagaccgagagcgcgacccuguucacggagaucgccacgccccacuccgucuggguguucgccugcgcccccgaccggugcccgcccaccgcccuguacguggcgggcguccccgagcucggggccuucuucagcauccugcaggacaugcggaacaccaucauggccuccaagagcgugggcaccgccgaggagaagcugaagaagaaguccgcguucuaccagagcuaccuccgccggacccagagcauggggauccagcuggaccagaagaucaucauccuguacaugcucuccuggggcaaggaggccgugaaccacuuccaccugggcgacgacauggaccccgagcugcgccagcucgcccagagccugaucgacaccaaggucaaggagaucuccaaccaggagccccugaagcucuga

SEQ ID NO: 6291 - RNA, 1287 nt, Artificial Sequence
  derived and/or modified CDS sequence (opt1) from ANDV(9718133)__AF482712.1__N
augagcacccugcaggagcuccaggagaacaucaccgcccacgagcagcagcuggugacggcccgccagaagcugaaggacgcggagaaggccgucgagguggaccccgacgacgugaacaaguccacccuccagaaccggcgcgccgccgucagcacccuggagaccaagcugggcgagcucaagcggcagcuggccgaccugguggcggcccagaagcucgccacgaagccgguggaccccaccgggcuggagcccgacgaccaccugaaggagaaguccagccuccgcuacggcaacguccuggacgugaacuccaucgaccuggaggagcccagcgggcagaccgccgacuggaaggcgaucggcgccuacauccucggguucgccaucccgaucauccugaaggcccuguacaugcucuccacccggggccgccagacggugaaggacaacaagggcacccggauccgcuucaaggacgacagcuccuucgaggaggucaacgggauccggaagcccaagcaccuguacgugagcaugcccaccgcccaguccaccaugaaggcggaggagaucacgcccggccgcuuccggaccaucgccugcgggcuguucccggcccaggugaaggcccgcaacaucaucagccccgucaugggcgugaucggguucggcuucuucgugaaggacuggauggaccggaucgaggaguuccucgccgcggagugccccuuccugcccaagccgaaggucgccuccgaggccuucaugagcaccaacaagauguacuuccugaaccgccagcgccaggugaacgaguccaaggugcaggacaucaucgaccucaucgaccacgccgagaccgagagcgccacgcuguucaccgagaucgcgacgccccacuccgucuggguguucgccugcgcccccgaccggugcccgcccaccgcccuguacguggccggcguccccgagcucggggcguucuucagcauccugcaggacaugcggaacaccaucauggccuccaagagcgugggcaccgccgaggagaagcugaagaagaaguccgccuucuaccagagcuaccuccgccggacccagagcauggggauccagcuggaccagaagaucaucauccuguacaugcucuccuggggcaaggaggcggugaaccacuuccaccugggcgacgacauggaccccgagcugcgccagcucgcccagagccugaucgacaccaaggucaaggagaucuccaaccaggagccccugaagcucuga

SEQ ID NO: 6292 - RNA, 1278 nt, Artificial Sequence
  derived and/or modified CDS sequence (opt1) from Araraquara virus(9480)__KP202360.1__N
augagcaaccugcaggagcuccaggagaacaucaccgcccacgagcagcagcuggugaccgcccgccagaagcugaaggacgcggagaaggccgucgacguggaccccgacgaggugaacaaguccacgcuccagggccggcgcgccgccgucagcacccuggagaccaagcugggggagcucaagcggcagcuggccgaccugguggcggcccagcgccucgccuccaagccgguggaccccaccggcaucgagcccgacgaccaccugaaggagaaguccagccugcgguacgggaacguccucgacgugaacagcaucgaccuggaggagcccuccggccagacggccgacuggaaggcgaucggggccuacauccugggcuucgccaucccgaucauccucaaggcccuguacaugcugagcacccgcggccggcagaccgugaaggacaacaaggggacccgcauccgguucaaggacgacuccagcuucgaggaggucaacggcauccgcaagcccaagcaccucuacaucuccaugcccacggcccagagcaccaugaaggcggaggagaucacccccgggcgguuccgcaccaucgccugcggccuguucccggcccaggugaaggcccggaacaucaucucccccgugaugggggucaucggcuucgccuucuucgugaaggacuggauggagcgcaucgaggacuuccuggcgagcgagugccccuuccuccccaagccgaagaaccccuccgaggccuucauggccacgaacaaggccuacuuccugaaccggcagaagcaggucgacgagagccaggugcccgacaucguggaccugaucgaccacgccgaggcggaguccgccacccucuucaaggagaucgccagcccccacuccgugugggucuucgccugcgccccggaccgcugcccgcccaccgcgcuguacguggccggcaugcccgagcugggggccuucuucgccauccuccaggacaugcggaacaccaucauggcgagcaagagcgugggcacggccgaggagaagcugaagaagaaguccgccuucuaccagagcuaccugcgccggacccaguccauggggauccagcucgaccagaagaucaucauccuguacaugcugagcuggggcaaggaggccgucaaccacuuccaccucggcgacgacauggaccccgagcugcgccagcuggcccagucccucaucgacaccaaggugaaggagagccagaccaagucccuguga

SEQ ID NO: 6293 - RNA, 1287 nt, Artificial Sequence
  derived and/or modified CDS sequence (opt1) from Araraquara-like virus(P5/Cajuru)__EF571895.1__N
augagcaaccugcaggagcuccaggagaacaucaccgcccacgagcagcagcuggugaccgcccgccagaagcugaaggacgcggagaaggccgucgacguggaccccgacgaggugaacaaguccacgcuccagggccggcgcgccgccgucagcacccuggagaccaagcugggggagcucaagcggcagcuggccgaccugguggcggcccagcgccucgccuccaagccgguggaccccaccggcaucgagcccgacgaccaccugaaggagaaguccagccugcgguacgggaacguccucgacgugaaccccaucgaccuggaggagccgagcggccagacggccgacuggaaggcgaucggggccuacauccugggcuucgccauccccaucauccucaaggcccuguacaugcuguccacccgcggccggcagaccgugaaggacaacaaggggacccgcauccgguucaaggacgacagcuccuucgaggaggucaacggcauccgcaagcccaagcaccucuacaucagcaugcccacggcccaguccaccaugaaggcggaggagaucaccccggggcgguuccgcaccaucgccugcggccuguuccccgcccaggugaaggcccggaacaucaucagccccgugaugggggucaucggcuucggcuucuucgugaaggacuggauggagcgcaucgaggacuuccuggccuccgagugccccuuccucccgaagcccaagaaccccagcgaggcguucauggccacgaacaaggccuacuuccugaaccggcagaagcaggucgacgagucccaggugcccgacaucguggaccugaucgaccacgccgaggccgagagcgcgacccucuucaaggagaucgccuccccgcacagcgugugggucuucgccugcgcccccgaccgcugcccgcccaccgcccuguacguggcggggcugcccgagcucggcgccuucuucgccauccugcaggacaugcggaacaccaucauggccuccaagagcguggggacggcggaggagaagcugaagaagaaguccgccuucuaccagagcuaccuccgccggacccagagcaugggcauccagcuggaccagaagaucaucauccuguacaugcucuccuggggcaaggaggccgucaaccacuuccaccugggggacgacauggaccccgagcugcgccagcucgcccagagccugaucgacaccaaggugaaggagaucuccaaccagggcccccugaagcucuga

SEQ ID NO: 6294 - RNA, 1287 nt, Artificial Sequence
  derived and/or modified CDS sequence (opt1) from BMJV(Oc22531)__AF482713.1__N
augagcacccugcaggagcuccaggagaacaucaccgcccacgagcagcagcuggugacggcccgccagaagcugaaggacgcggagaagaccgucgagguggaccccgacgaggugaacaaguccacccuccagagccggcgcgccgccgucuccacccuggagacgaagcugggcgagcucaagcggcagcuggccgaccugguggccgcgcagaagcucgccaccaagccgguggaccccaccgggcuggagcccgacgaccaccugaaggagaaguccagccuccgcuacggcaacguccuggacgugaacagcaucgaccuggaggagcccuccgggcagaccgccgacuggcggagcaucggcgccuacauccucggguucgcgaucccgaucauccugaaggcccuguacaugcucuccacgcgcggccggcagaccgugaaggacaacaagggcacccgcauccgguucaaggacgacagcuccuucgaggaggucaacgggauccgcaagcccaagcaccuguacgugagcaugcccaccgcccaguccacgaugaaggccgaggagaucacccccggccgguuccgcaccaucgccugcgggcuguucccggcccaggugaaggcgcggaacaucaucagccccgucaugggcgugaucggguucuccuucuucgugaaggacuggauggagcgcaucgaggacuuccucgccgccgagugccccuuccugcccaagccgaaggcccccagcgaggcguucauggccaccaacaaggccuacuuccugaaccggcagcgccaggucaacgaguccaaggugcaggacaucguggaccucaucgaccacgccgagacggagagcgccacccuguucaccgacaucgcgacgccccacuccgucuggguguucgccugcgcccccgaccggugcccgcccaccgcccuguacguggccggcguccccgagcucggcgcguucuucgccauccugcaggacaugcgcaacaccaucauggccagcaagagcguggggaccgccgaggagaagcugaagaagaaguccgcguucuaccagagcuaccuccggcgcacccaguccaugggcauccagcuggaccagaagaucaucauccuguacaugcucagcugggggaaggaggccgugaaccacuuccaccugggcgacgacauggaccccgagcugcggcagcucgcccagucccugaucgacacgaaggucaaggagaucagcaaccaggagccgcugaagcucuga

SEQ ID NO: 6295 - RNA, 1287 nt, Artificial Sequence
  derived and/or modified CDS sequence (opt1) from LECV(22819)__AF482714.1__N
augagcacccugcaggagcuccaggagaacaucaccgcccacgagcagcagcuggugacggcccgccagaagcugaaggacgcggagaagaccgucgagguggaccccgacgaggugaacaaguccacccuccagagccggcgcgccgccgucuccacccuggagacgaagcugggcgagcucaagcggcagcuggccgaccugguggccgcgcagaagcucgccaccaagccgguggaccccaccgggcuggagcccgacgaccaccugaaggagaaguccagccuccgcuacggcaacguccuggacgugaacagcaucgaccuggaggagcccuccgggcagaccgccgacuggcggagcaucggcgccuacauccucggguucgcgaucccgaucauccugaaggcccuguacaugcucuccacgcgcggccggcagaccgugaaggacaacaagggcacccgcauccgguucaaggacgacagcuccuucgaggaggucaacgggauccgcaagcccaagcaccuguacgugagcaugcccaccgcccaguccacgaugaaggccgaggagaucacccccggccgguuccgcaccaucgccugcgggcuguucccggcccaggugaaggcgcggaacaucaucagccccgucaugggcgugaucggguucuccuucuucgugaaggacuggauggagcgcaucgaggacuuccucgccgccgagugccccuuccugcccaagccgaaggcccccagcgaggcguucauggccaccaacaaggccuacuuccugaaccggcagcgccaggucaacgaguccaaggugcaggagaucguggaccucaucgaccacgccgagacggagagcgccacccuguucaccgacaucgcgacgccccacuccgucuggguguucgccugcgcccccgaccggugcccgcccaccgcccuguacguggccggcguccccgagcucggcgcguucuucgccauccugcaggacaugcgcaacaccaucauggccagcaagagcguggggaccgccgaggagaagcugaagaagaaguccgcguucuaccagagcuaccuccggcgcacccaguccaugggcauccagcuggaccagaagaucaucauccuguacaugcucagcugggggaaggaggccgugaaccacuuccaccugggcgacgacauggaccccgagcugcggcagcucgcccagucccugaucgacacgaaggucaaggagaucagcaaccaggagccgcugaagcucuga

SEQ ID NO: 6296 - RNA, 1287 nt, Artificial Sequence
  derived and/or modified CDS sequence (opt1) from MCLV(13796)__AF482716.1__N
augagcaaccugcaggagcuccaggagaacaucaccgcccacgagcagcagcuggugaccgcccgccagaagcugaaggacgcggagaaggccgucgacguggaccccgacgaggugaacaaguccacgcuccagggccggcgcgccgccgucagcacccuggagaccaagcugggggagcucaagcggcagcuggccgaccugguggcggcccagaagcucgccaccaagccgguggaccccacgggcaucgagcccgacgaccaccugaaggagaaguccagccugcgcuacgggaacguccucgacgugaacuccaucgaccuggaggagcccagcggccagaccgccgacuggaaggcgaucggggccuacauccugggcuucgccaucccgaucauccucaaggcccuguacaugcuguccacccggggccgccagaccgugaaggacaacaaggggacgcggauccgcuucaaggacgacagcuccuucgaggaggucaacggcauccggaagcccaagcaccucuacaucagcaugcccaccgcccaguccaccaugaaggcggaggagaucacccccgggcgcuuccggacgaucgugugcggccuguucccggcccaggugaaggcccgcaacaucaucagccccgucaugggggugaucggcuucuccuucuucgugaaggacuggauggagcggaucgagggcuuccuggccgccgagugccccuuccuccccaagccgaagaccgcggccgagaccuucauggccaccaacaaggccuacuucuucaaccgccagcggcaggucgacgagagccaggugcccgacaucguggagcugaucgaccaggccgaguccgagagcgcgacgcuguucaccgagaucgccagcccccacagcgucuggguguucgccugcgcccccgaccgcugcccgcccaccgcccucuacguggcggggguccccgagcugggcgccuucuucgccauccugcaggacaugcggaacaccaucauggccuccaagagcguggggacggcggaggagaagcucaagaagaaguccgccuucuaccaguccuaccugcgccggacccagagcaugggcauccagcuggaccagaagaucaucauccucuacaugcuguccuggggcaaggaggccgugaaccacuuccaccugggggacgacauggaccccgagcuccgccagcuggcccaggcccugaucgacaccaaggucaaggagaucagcaaccaggagccgcucaagcuguga

SEQ ID NO: 6297 - RNA, 1287 nt, Artificial Sequence
  derived and/or modified CDS sequence (opt1) from Neembucu(Neembucu)__DQ345763.1__N
augagcacccugcaggagcuccaggagaacaucaccgcccacgagcagcagcuggugacggcccgccagaagcugaaggacgcggagaagaccgucgagguggaccccgacgaggugaacaaguccacccuccagagccggcgcgccgccgucuccacccuggagacgaagcugggcgagcucaagcggcagcuggccgaccugguggccgcgcagaagcucgccacccgcccgguggaccccaccgggcuggagcccgacgaccaccugaaggagaaguccagccuccgguacggcaacguccuggacgugaacagcaucgaccuggaggagcccuccgggcagaccgccgacuggcgcagcaucggcgccuacauccucggguucgcgaucccgaucauccugaaggcccuguacaugcucuccacgcggggccgccagaccgugaaggacaacaagggcacccggauccgcuucaaggacgacagcuccuucgaggaggucaacgggauccggaagcccaagcaccuguacgugagcaugcccaccgcccaguccacgaugaaggccgaggagaucacccccggccgccugcggaccaucgccugcggccucuucccggcccaggugaaggcgcgcagcaucaucucccccgucaugggggugaucggguucagcuucuucgugaaggacuggauggagcggaucgaggacuuccuggccgccgagugccccuuccugcccaagccgaaggcccccuccgaggcguucauggccaccaacaaggccuacuuccucaaccgccagcggcaggucaacgagagcaaggugcaggacaucguggaccugaucgaccacgccgagacggaguccgccacccuguucaccgacaucgcgacgccccacagcgucuggguguucgccugcgcccccgaccgcugcccgcccaccgcccucuacguggccggcguccccgagcugggcgcguucuucgccauccugcaggacaugcggaacaccaucauggccagcaaguccguggggaccgccgaggagaagcucaagaagaaguccgcguucuaccagagcuaccugcgccggacccagagcaugggcauccagcuggaccagaagaucaucauccucuacaugcuguccugggggaaggaggccgugaaccacuuccaccugggcgacgacauggaccccgagcuccgccagcuggcccagagccugaucgacacgaaggucaaggagaucuccaaccaggagccgcucaagcuguga

SEQ ID NO: 6298 - RNA, 1287 nt, Artificial Sequence
  derived and/or modified CDS sequence (opt1) from ORNV(22996)__AF482715.1__N
augagcacccugcaggagcuccaggagaacaucaccgcccacgagcagcagcuggugacggcccgccagaagcugaaggacgcggagaagaccgucgagguggaccccgacgaggugaacaaguccacccuccagagccggcgcgccgccgucuccacccuggagacgaagcugggcgagcucaagcggcagcuggccgaccugguggccgcgcagaagcucgccaccaagccgguggaccccaccgggcuggagcccgacgaccaccugaaggagaaguccagccuccgcuacggcaacguccuggacgugaacagcaucgaccuggaggagcccuccgggcagaccgccgacuggaaggccaucggcgcguacauccucggguucgccaucccgaucauccugaaggcccuguacaugcucagcacgcggggccgccagaccgugaaggacaacaagggcacccggauccgcuucaaggacgacuccagcuucgaggaggucaacgggauccggaagcccaagcaccuguacguguccaugcccaccgcccagagcacgaugaaggccgaggagaucacccccggccgcuuccggaccaucgcgugcgggcuguucccggcccaggugaaggcccgcaacaucaucucccccgucaugggcgugaucggguucagcuucuucgugaaggacuggauggagcggaucgaggacuuccucgccgccgagugccccuuccugcccaagccgaaggcgcuguccgaggccuucauggccaccaacaaggccuacuuccucaaccgccagcggcaggucaacgacagcaaggugcaggacaucguggaccugaucgaccacgccgagaucgaguccgcgacgcuguucaccgacaucgccacgccccacagcgucuggguguucgccugcgcccccgaccgcugcccgcccaccgcccucuacguggcgggcguccccgagcugggcgccuucuucgccauccugcaggacaugcggaacaccaucauggccuccaagagcguggggaccgcggaggagaagcucaagaagaaguccgccuucuaccagagcuaccugcgccggacccagagcaugggcauccagcuggaccagaagaucaucauccucuacaugcuguccugggggaaggaggccgugaaccacuuccaccugggcgacgacauggaccccgagcuccgccagcuggcccagagccugaucgacaccaaggucaaggagaucuccaaccaggagccccucaagcuguga

SEQ ID NO: 6299 - RNA, 1287 nt, Artificial Sequence
  derived and/or modified CDS sequence (opt1) from PRGV(14403)__AF482717.1__N
augagcacccugcaggagcuccaggagaacaucaccgcccacgagcagcaccuggugacggcccgccagaagcugaaggacgcggagaagaccgucgagguggaccccgacgaggugaacaaguccacccuccagagccggcgcgccgccgucuccacccuggagacgaagcugggcgagcucaagcggcagcuggccgaccugguggccgcgcagaagcucgccgccaagccgguggaccccaccgggcuggagcccgacgaccaccugaaggagaaguccagccuccgcuacggcaacguccuggacgugaacagcaucgaccuggaggagcccuccgggcagaccgccgacuggaaggcgaucggcgccuacauccucggguucgccaucccgaucauccugaaggcccuguacaugcucagcacccggggccgccagacggugaaggacaacaagggcacccggauccgcuucaaggacgacuccagcuucgaggaggucaacgggauccggaagcccaagcaccuguacguguccaugcccaccgcccagagcaccaugaaggcggaggagaucacgcccggccgcuuccggaccaucgccugcgggcuguucccggcccaggugaaggcccgcaacaucaucucccccgucaugggcgugaucggguucagcuucuucgugaaggacuggauggagcggaucgaggacuuccucgccgcggagugccccuuccugcccaagccgaagaccaccuccgaggccuucaugagcacgaacaaggccuacuuccugaaccgccagcggcaggucgacgagucccaggugcccgacaucgccgagcucaucgagcaggccgagagcgaguccgcgacccuguucaccgagaucgccagcccccacagcgugugggucuucgccugcgcccccgaccgcugcccgcccaccgcccuguacguggcgggcgugcccgagcucggcgccuucuucgccauccugcaggacaugcggaacacgaucauggccuccaagagcgucgggaccgcggaggagaagcugaagaagaaguccgccuucuaccagagcuaccuccgccggacccaguccaugggcauccagcuggaccagaagaucaucauccuguacaugcucagcugggggaaggaggccgugaaccacuuccaccugggcgacgacauggaccccgagcugcgccagcucgcccaggcccugaucgacaccaaggugaaggagaucuccaaccaggagccgcugaagcucuga

SEQ ID NO: 6300 - RNA, 1287 nt, Artificial Sequence
  derived and/or modified CDS sequence (opt1) from TUNV(FVB554)__JF750419.1__N
augagcaaccugcaggagcuccaggagaacaucaccgcccacgagcagcagcuggugaccgcccgccagaagcugaaggacgcggagaaggccgucgagauggaccccgacgacgugaacaaguccacgcuccagagccggcgcgccgccguguccacccuggagaccaagcugggcgagcucaagcggcagcuggccgacauggucgcggcccagaagcuggccaccaagccgguggaccccacggggcucgagcccgacgaccaccugaaggagaaguccagccugcgcuacggcaacgugcucgacgucaacagcaucgaccuggaggagcccuccgggcagaccgccgacuggaaguccaucggcgcguacauccugggguucgccaucccgaucauccucaaggcccuguacaugcugagcacccggggccgccagaccgugaaggacaacaagggcacgcggauccgcuucaaggacgacagcuccuucgaggaggugaacgggauccggaagcccaagcaccucuacgucagcaugcccaccgcccaguccaccaugaaggccgaggagaucacccccggccgcuuccggacgaucgcgugcgggcuguucccggcccaggugaaggcccgcaacaucaucagccccgugaugggcgucaucggguucuccuucuucgugaaggacuggauggagcggaucgaggacuuccuggccgacgagugccccuuccuccccaagcccaagagccccuccgaggccuucauggcgaccaacaaggccuacuuccugaaccgccagcgccaggugaacgacagcaagguccaggacaucguggaccugaucgaccacgccgagaccgaguccgccacccucuucacggacaucgccaccccgcacagcgugugggucuucgcgugcgcccccgaccggugcccgcccaccgcccuguacguggccggcgugcccgagcugggcgccuucuucgcgauccuccaggacaugcggaacaccaucauggccagcaaguccgucgggacggccgaggagaagcugaagaagaaguccgccuucuaccagagcuaccugcgccggacccagagcaugggcauccagcucgaccagaagaucaucauccuguacaugcuguccugggggaaggaggcggugaaccacuuccaccucggcgacgacauggaccccgagcugcgccagcuggcccaggcccucaucgacaccaaggugaaggagaucagcaaccaggagccgcugaagcuguga

SEQ ID NO: 6301 - RNA, 1287 nt, Artificial Sequence
  derived and/or modified CDS sequence (opt1) from BCCV(BCCV)__AB689163.1__N
augagcaaccugaaggaggugcaggacaacaucaccacccacgagcagcagcucgucgccgcccgccagaagcugaaggacgcggagcggacggugggcguggaccccgacgacgucaacaaguccacccugcagaaccgccgggccgccgugagcgcccucgaggccaagaucggggagcugaagcgccagcuggcggaccucguggccgcccagaagcuggccaccaaguccgucgacccgaccggcaucgagcccgacgaccaccugaaggagaaguccagccuccgguacgggaacgugcuggacgugaacagcaucgaccuggaggagcccuccggccagacggcggacuggaaggccaucgggaccuacauccucagcuucguccugcccaucgugcugaaggcccucuacaugcuguccacccgcggccggcagaccgugaaggagaacaagggcacgcgcauccgguucaaggacgacagcuccuacgaggacgucaacgggauccgcaagccgaagcaccuguacgugagccuccccaccgcccaguccaccaugaaggccgacgagaucacccccggccgguuccgcacgaucgugugcgggcuguuccccgcgcagaucaaggcccggaacaucaucagcccggucaugggcgugaucggguucuccuucuucgugaaggacugggucgacaagaucgaggacuuccugcgcgccgagugccccuuccuccccaagccccgggcccaggccgagagcuuccuguccaccaacggcgcguacuucaugaaccgccagacccagguggaggagagcaaggugcaggacauccuggaccucaucgacaccgccgaguccggcggggccacgcuguucgacaacaucgccagcccgcagagcgccuggaucuucgcgugcgcccccgaccggugcccgcccaccgcccuguacgucgccggcgugcccgagcucggggccuucuucuccauccugcaggacaugcgcaacaccaucauggcgagcaaguccgugggcaccgccgaggagaagcugaagaagaaguccgccuucuaccagagcuaccuccggcgcacgcagagcaugggcauccagcuggaccagaagaucaucauccuguacaugaucaacugggggaaggaggccgucaaccacuuccaccucggcgacgacauggaccccgagcugcggcagcuggcgcaggcccucguggacaccaaggucaaggagaucuccaaccaggagccccugaagaucuga

SEQ ID NO: 6302 - RNA, 1287 nt, Artificial Sequence
  derived and/or modified CDS sequence (opt1) from BCCV(BCCV)__L39949.1__N
augagcaaccugaaggaggugcaggacaacaucaccacccacgagcagcagcucgucgccgcccgccagaagcugaaggacgcggagcggacgguggagguggaccccgacgacgucaacaaguccacccugcagaaccgccgggccgccgugagcgcccucgaggccaagaucggcgagcugaagcgccagcuggcggaccucguggccgcccagaagcuggccaccaaguccgucgacccgaccgggaucgagcccgacgaccaccugaaggagaaguccagccuccgguacggcaacgugcuggacgugaacagcaucgaccuggaggagcccuccgggcagacggcggacuggaaggccaucggcaccuacauccucagcuucguccugcccaucgugcugaaggcccucuacaugcuguccacccgcgggcggcagaccgugaaggagaacaagggcacgcgcauccgguucaaggacgacagcuccuacgaggacgucaacggcauccgcaagccgaagcaccuguacgugagccuccccaccgcccaguccaccaugaaggccgacgagaucacccccgggcgguuccgcacgaucgugugcggccuguuccccgcgcagaucaaggcccggaacaucaucagcccggucaugggggugaucggcuucuccuucuucgugaaggacugggucgacaagaucgaggacuuccugcgcgccgagugccccuuccuccccaagccccgggcccaggccgagagcuuccuguccaccaacggggcguacuucaugaaccgccagacccagguggaggagagcaaggugcaggacauccuggaccucaucgacaccgccgaguccggcggcgccacgcuguucgacaacaucgccagcccgcagagcgccuggaucuucgcgugcgcccccgaccggugcccgcccaccgcccuguacgucgccggggugcccgagcucggcgccuucuucuccauccugcaggacaugcgcaacaccaucauggcgagcaaguccguggggaccgccgaggagaagcugaagaagaaguccgccuucuaccagagcuaccuccggcgcacgcagagcaugggcauccagcuggaccagaagaucaucauccuguacaugaucaacuggggcaaggaggccgucaaccacuuccaccucggggacgacauggaccccgagcugcggcagcuggcgcaggcccucguggacaccaaggucaaggagaucuccaaccaggagccccugaagaucuga

SEQ ID NO: 6303 - RNA, 1290 nt, Artificial Sequence
  derived and/or modified CDS sequence (opt1) from DOBV(DOBV/Ano-Poroia/Afl9/1999)__NC_005233.1__N
auggccacccuggaggagcuccagaaggagaucaacaaccacgagggccagcuggugaucgcccgccagaaggucaaggacgcggagaagcaguacgagaaggaccccgacgaccugaacaagcgggcccucagcgaccgcgaguccaucgcccagagcauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgugaucgaccucaaccaccuggacaucgacgagcccacgggccagaccgccgacuggcuguccaucgucguguaccucaccagcuucgugguccccauccugcugaaggcccucuacaugcugaccacgcgggggcgccagaccaccaaggacaacaagggcaugcggauccgcuucaaggacgacuccagcuucgaggacgugaacgggauccggaagccgaagcaccuguuccucuccaugcccaacgcccagagcuccaugaaggcggacgagaucacccccggccgcuuccggacggccaucugcgggcuguaccccgcccaggugaaggcccgcaaccugaucagcccggucauguccgugaucggcuuccucgcccuggcgaagaacuggaccgagcggguggaggaguggcuggaccuccccugcaagcugcugagcgagcccucccccaccagccucaccaagggcccguccacgaaccgcgacuaccugaaccagcggcagggggcccuggccaagauggagaccaaggaggcccaggccguccgcaagcacgcgaucgacgccggcugcaaccucaucgaccacaucgacagccccuccagcaucuggguguucgccggggcccccgaccggugcccgccgaccugccuguucaucgccggcauggcggagcugggcgccuucuucgccgugcuccaggacaugcgcaacaccaucauggccagcaagacgaucgggaccuccgaggagaagcugaagaagaaguccagcuucuaccagagcuaccugcggcgcacccaguccaugggcauccagcucgaccagcgcaucaucguccuguucaugguggacugggggaaggaggccguggacagcuuccaccugggcgacgacauggaccccgagcuccgggggcuggcgcaggcccugaucgaccagaaggucaaggagaucuccaaccaggagccccucaagcuguga

SEQ ID NO: 6304 - RNA, 1290 nt, Artificial Sequence
  derived and/or modified CDS sequence (opt1) from DOBV(DOB/Saaremaa/160V)__AJ009773.1__N
auggccacccuggaggagcuccagaaggagaucaacagccacgagggccagcuggugaucgcccgccagaaggucaaggacgcggagaagcaguacgagaaggaccccgacgaccugaacaagcgggcccucuccgaccgcgagagcaucgcccaguccauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgugaucgaccucaaccaccuggacaucgacgagcccacgggccagaccgccgacuggcugagcaucgucaucuaccucaccuccuucguggugcccauccugcugaaggcccucuacaugcugaccacgcgggggcgccagaccaccaaggacaacaagggcaugcggauccgcuucaaggacgacagcuccuucgaggacgucaacgggauccggaagccgaagcaccuguuccucagcaugcccaacgcccaguccagcaugaaggcggacgagaucacccccggccgcuuccggacggccgugugcgggcuguaccccgcccaggugaaggcccgcaaccugaucuccccggucaugagcgugaucggcuuccucacccuggccaagaacuggaccgagcggguggaggaguggcuggaccuccccugcaagcugcuguccgagcccagccccaccucccucacgaagggcccgagcaccaaccgcgacuaccugucccagcggcagggggcgcuggccaagauggagaccaaggaggcccaggucgugcgcaagcacgccaucgacgccggcugcaacaucaucgaccacaucgacagccccagcuccaucuggguguucgcgggggcccccgaccggugcccgccgaccugccucuucaucgccggcauggccgagcugggcgccuucuucgcgguccugcaggacaugcgcaacacgaucauggccagcaagaccaucgggaccuccgaggagaagcuccggaagaaguccagcuucuaccagagcuaccugcgccgcacccaguccaugggcauccagcuggaccagcggaucaucguccucuucaugaucgagugggggaaggaggccguggacagcuuccaccugggcgacgacauggaccccgagauccgcucccuggcccaggcccucaucgaccagaaggugaaggagaucagcaaccaggagccccugaagcuguga

SEQ ID NO: 6305 - RNA, 1290 nt, Artificial Sequence
  derived and/or modified CDS sequence (opt1) from DOBV(Slovakia/400Af/98)__AY168576.1__N
auggccacccuggaggagcuccagaaggagaucaacaaccacgagggccagcuggugaucgcccgccagaaggucaaggacgcggagaagcaguacgagaaggaccccgacgaccugaacaagcgggcccucagcgaccgcgaguccaucgcccagagcauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgugaucgaccucaaccaccuggacaucgacgagcccacgggccagaccgccgacuggcuguccaucgucguguaccucaccagcuucgugguccccauccugcugaaggcccucuacaugcugaccacgcgggggcgccagaccaccaaggacaacaagggcaugcggauccgcuucaaggacgacuccagcuucgaggacgugaacgggauccggaagccgaagcaccuguuccucuccaugcccaacgcccagagcuccaugaaggcggacgagaucacccccggccgcuuccggacggccaucugcgggcuguaccccgcccaggugaaggcccgcaaccugaucagcccggucauguccgugaucggcuuccucgcccuggcgaagaacuggaccgagcggguggaggaguggcuggaccuccccugcaagcugcugagcgagcccucccccaccagccucaccaagggcccguccacgaaccgcgacuaccugaaccagcggcagggggcccuggccaagauggagaccaaggaggcccaggccguccgcaagcacgcgaucgacgccggcugcaaccucaucgaccacaucgacagccccuccagcaucuggguguucgccggggcccccgaccggugcccgccgaccugccuguucaucgccggcauggcggagcugggcgccuucuucgccgugcuccaggacaugcgcaacaccaucauggccagcaagacgaucgggaccuccgaggagaagcugaagaagaaguccagcuucuaccagagccugcuccggcgcacccaguccaugggcauccagcuggaccagcgcaucaucguccuguucaugguggacugggggaaggaggccguggacagcuuccaccucggcgacgacauggaccccgagcugcgggggcuggcgcaggcccucaucgaccagaaggucaaggagaucuccaaccaggagccccugaagcuguga

SEQ ID NO: 6306 - RNA, 1290 nt, Artificial Sequence
  derived and/or modified CDS sequence (opt1) from DOBV(Slovakia-856-Aa)__AJ269549.1__N
auggccacccuggaggagcuccagaaggagaucaacagccacgagggccagcuggugaucgcccgccagaaggucaaggacgcggagaagcaguacgagaaggaccccgacgaccugaacaagcgggcccucuccgaccgcgagagcguggcccaguccauccagagcaagaucgacgagcugcggcgccagcuggccgaccggguggccgcggggaagaacaucggcaaggagcgcgaccccaccgggcucgaccccggcgaccaccugaaggagaaguccaugcugagcuacgggaacgucaucgaccucaaccaccuggacaucgacgagcccacgggccagaccgccgacuggcuguccaucgugguguaccucaccagcuucgucgugcccauccugcugaaggcccucuacaugcugaccacgcggggccgccagaccaccaaggacaacaaggggaugcggauccgcuucaaggacgacuccagcuucgaggacgugaacggcauccggaagccgaagcaccuguuccucuccaugcccaacgcccagagcuccaugaaggcggacgagaucacccccgggcgcuuccggacggccaucugcggccuguaccccgcccaggucaaggcccgcaaccuggugagcccggugauguccgucaucggguucauggcccucgcgaagaacuggaccgagcggguggaggaguggcuggaccugcccugcaagcuccugagcgagcccucccccaccagccugaccaagggcccguccacgaaccgcgacuaccucaaccagcggcagggcgcccuggccaagauggagaccaaggaggcccaggccgugcgcaagcacgcgaucgacgccgggugcaacaucaucgaccacaucgacagccccagcuccaucugggucuucgcccccgcccccgaccggugcccgccgaccugccuguucaucgccggcauggcggagcucggggccuucuucagcgugcugcaggacaugcgcaacaccaucauggccuccaagacgaucggcaccagcgaggagaagcugcggaagaaguccagcuucuaccaguccuaccuccgccgcacccagagcaugggcauccagcuggaccagcggaucaucgugcuguucauggucgacugggggaaggaggccguggacuccuuccaccucggcgacgacauggaccccgagcugcgcgggcuggcccaggcgcucaucgaccagaaggugaaggagaucagcaaccaggagccccugaagcuguga

SEQ ID NO: 6307 - RNA, 1290 nt, Artificial Sequence
  derived and/or modified CDS sequence (opt1) from DOBV(Slovakia-862-Aa)__AJ269550.1__N
auggccacccuggaggagcuccagaaggagaucaacagccacgagggccagcuggugaucgcccgccagaaggucaaggacgcggagaagcaguacgagaaggaccccgacgaccugaacaagcgggcccucuccgaccgcgagagcguggcccaguccauccagagcaagaucgacgagcugcggcgccagcuggccgaccggguggccgcggggaagaacaucggcaaggagcgcgaccccaccgggcucgaccccggcgaccaccugaaggagaaguccaugcugagcuacgggaacgucaucgaccucaaccaccuggacaucgacgagcccacgggccagaccgccgacuggcuguccaucgugguguaccucaccagcuucgucgugcccauccugcugaaggcccucuacaugcugaccacgcggggccgccagaccaccaaggacaacaaggggaugcggauccgcuucaaggacgacuccagcuucgaggacgugaacggcauccggaagccgaagcaccuguuccucuccaugcccaacgcccagagcuccaugaaggcggacgagaucacccccgggcgcuuccggacggccaucugcggccuguaccccgcccaggucaaggcccgcaaccuggugagcccggugauguccgucaucggguucauggcccucgcgaagaacuggaccgagcggguggaggaguggcuggaccugcccugcaagcuccugagcgagcccucccccaccagccugaccaagggcccguccacgaaccgcgacuaccucaaccagcggcagggcgcccuggccaagauggagaccaaggaggcccaggccgugcgcaagcacgcgaucgacgccgggugcaacaucaucgaccacaucgacagccccagcuccaucugggucuucgccggccggcccgaccgcugcccgccgaccugccuguucaucgccgggauggccgagcucggcgcguucuucagcgugcugcaggacaugcggaacaccaucauggccuccaagacgaucggcaccagcgaggagaagcugcgcaagaaguccagcuucuaccaguccuaccuccgccggacccagagcauggggauccagcuggaccagcgcaucaucgugcuguucauggucgacuggggcaaggaggccguggacuccuuccaccucggggacgacauggaccccgagcugcggggccuggcccaggcccucaucgaccagaaggugaaggagaucagcaaccaggagccccugaagcuguga

SEQ ID NO: 6308 - RNA, 1290 nt, Artificial Sequence
  derived and/or modified CDS sequence (opt1) from DOBV(Esl/29Aa/01)__AY533118.2__N
auggccacccuggaggagcuccagaaggagaucaacagccacgagggccagcuggugaucgcccgccagaaggucaaggacgcggagaagcaguacgagaaggaccccgacgaccugaacaagcgggcccucuccgaccgcgagagcguggcccaguccauccagagcaagaucgacgagcugcggcgccagcuggccgaccggguggccgcggggaagaacaucggcaaggagcgcgaccccaccgggcucgaccccggcgaccaccugaaggagaaguccaugcugagcuacgggaacgucaucgaccucaaccaccuggacaucgacgagcccacgggccagaccgccgacuggcuguccaucgugguguaccucaccagcuucgucgugcccauccugcugaaggcccucuacaugcugaccacgcggggccgccagaccaccaaggacaacaaggggaugcggauccgcuucaaggacgacuccagcuucgaggacgugaacggcauccggaagccgaagcaccuguuccucuccaugcccaacgcccagagcuccaugaaggcggacgagaucacccccgggcgcuuccggacggccaucugcggccuguaccccgcccaggucaaggcccgcaaccuggugagcccggugauguccgucaucggguuccucgcccuggcgaagaacuggaccgagcggguggaggaguggcuggaccuccccugcaagcugcugagcgagcccucccccaccagccucaccaagggcccguccacgaaccgcgacuaccugaaccagcggcagggcgcccuggccaagauggagaccaaggaggcccaggccgugcgcaagcacgcgaucgacgccgggugcaacaucaucgaccacaucgacagccccagcuccaucugggucuucgccggcgcccccgaccggugcccgccgaccugccucuucaucgccgggauggcggagcugggcgccuucuucagcgugcugcaggacaugcgcaacaccaucauggccuccaagacgaucggcaccagcgaggagaagcuccggaagaaguccagcuucuaccaguccuaccugcgccgcacccagagcauggggauccagcuggaccagcggaucaucguccucuucaugguggacuggggcaaggaggccguggacuccuuccaccugggggacgacauggaccccgagcugcgcggccucgcccaggcgcugaucgaccagaaggugaaggagaucagcaaccaggagccccugaagcucuga

SEQ ID NO: 6309 - RNA, 1290 nt, Artificial Sequence
  derived and/or modified CDS sequence (opt1) from DOBV(Kurkino/44Aa/98)__AJ131672.1__N
auggccacccuggaggagcuccagaaggagaucaacagccacgagggccagcuggugaucgcccgccagaaggucaaggacgcggagaagcagcacgagaaggaccccgacgaccugaacaagcgggcccucuccgaccgcgagagcguggcccaguccauccagagcaagaucgacgagcugcggcgccagcuggccgaccggguggccgcggggaagaacaucggcaaggagcgcgaccccaccgggcucgaccccggcgaccaccugaaggagaaguccaugcugagcuacgggaacgucaucgaccucaaccaccuggacaucgacgagcccacgggccagaccgccgacuggcuguccaucgugguguaccucaccagcuucgucgugcccauccugcugaaggcccucuacaugcugaccacgcggggccgccagaccaccaaggacaacaaggggaugcggauccgcuucaaggacgacuccagcuucgaggacgugaacggcauccggaagccgaagcaccuguuccucuccaugcccaacgcccagagcuccaugaaggcggacgagaucacccccgggcgcuuccggacggccaucugcggccuguaccccgcccaggucaaggcccgcaaccuggugagcccggugauguccgucaucggguuccucgcccuggcgaagaacuggaccgagcggguggaggaguggcuggaccuccccugcaagcugcugagcgagcccucccccaccagccucaccaagggcccguccacgaaccgcgacuaccugaaccagcggcaggccgcccuggccaagauggagaccaaggaggcccaggcggugcgcaagcacgccaucgacgccggcugcaccaucaucgacuacaucgacagccccagcuccaucugggucuucgccggggcccccgaccggugcccgccgaccugccucuucaucgcgggcauggccgagcugggggccuucuucagcgugcugcaggacaugcgcaacacgaucauggccuccaagaccgugggcaccagcgaggagaagcuccggaagaaguccagcuucuaccaguccuaccugcgccgcacccagagcaugggcauccagcuggaccagcggaucaucguccucuucaugguggacugggggaaggaggccguggacuccuuccaccugggcgacgacauggaccccgagcugcgcgggcucgcgcaggcccugaucgaccagaaggucaaggagaucagcaaccgggagccccugaagcucuga

SEQ ID NO: 6310 - RNA, 1290 nt, Artificial Sequence
  derived and/or modified CDS sequence (opt1) from DOBV(Kurkino/53Aa/98)__AJ131673.1__N
auggccacccuggaggagcuccagaaggagaucaacagccacgagggccagcuggugaucgcccgccagaaggucaaggacgcggagaagcaguacgagaaggaccccgacgaccugaacaagcgggcccucuccgaccgcgagagcguggcccaguccauccagagcaagaucgacgagcugcggcgccagcuggccgaccggguggccgcggggaagaacaucggcaaggagcgcgaccccaccgggcucgaccccggcgaccaccugaaggagaaguccaugcugagcuacgggaacgucaucgaccucaaccaccuggacaucgacgagcccacgggccagaccgccgacuggcuguccaucgugguguaccucaccagcuucgucgugcccauccugcugaaggcccucuacaugcugaccacgcggggccgccagaccaccaaggacaacaaggggaugcggauccgcuucaaggacgacuccagcuucgaggacgugaacggcauccggaagccgaagcaccuguuccucuccaugcccaacgcccagagcuccaugaaggcggacgagaucacccccgggcgcuuccggacggccaucugcggccuguaccccgcccaggucaaggcccgcaaccuggugagcccggugauguccgucaucggguuccucgcccuggcgaagaacuggaccgagcggguggaggaguggcuggaccuccccugcaagcugcugagcgagcccucccccaccagccucaccaagggcccguccacgaaccgcgacuaccugaaccagcggcaggccgcccuggccaagauggagaccaaggaggcccaggcggugcgcaagcacgccaucgacgccggcugcaccaucaucgaccacaucgacagccccagcuccaucugggucuucgccggggcccccgaccggugcccgccgaccugccucuucaucgcgggcauggccgagcugggggccuucuucagcgugcugcaggacaugcgcaacacgaucauggccuccaagaccgugggcaccagcgaggagaagcuccggaagaaguccagcuucuaccaguccuaccugcgccgcacccagagcaugggcauccagcuggaccagcggaucaucguccucuucaugguggacugggggaaggaggccguggacuccuuccaccugggcgacgacauggaccccgagcugcgcgggcucgcgcaggcccugaucgaccagaaggucaaggagaucagcaaccgggagccccugaagcucuga

SEQ ID NO: 6311 - RNA, 1290 nt, Artificial Sequence
  derived and/or modified CDS sequence (opt1) from DOBV(Saar/90Aa/97)__AJ009775.1__N
auggccacccuggaggagcuccagaaggagaucaacagccacgagggccagcuggugaucgcccgccagaaggucaaggacgcggagaagcaguacgagaaggaccccgacgaccugaacaagcgggcccucuccgaccgcgagagcaucgcccaguccauccaggggaagaucgacgagcugcggcgccagcuggccgaccggguggccgcgggcaagaacaucgggcgcgagcgggaccccaccggccucgaccccggggaccaccugaaggagaaguccaugcugagcuacggcaacgugaucgaccucaaccaccuggacaucgacgagcccacgggccagaccgccgacuggcugagcaucgucaucuaccucaccuccuucguggugcccauccugcugaaggcccucuacaugcugaccacgcgcgggcggcagaccaccaaggacaacaagggcaugcgcauccgguucaaggacgacagcuccuucgaggacgucaacgggauccgcaagccgaagcaccuguuccucagcaugcccaacgcccaguccagcaugaaggcggacgagaucacccccggccgguuccgcacggccgugugcgggcuguaccccgcccaggugaaggcccggaaccugaucuccccggucaugagcgugaucggcuuccucacccuggccaagaacuggaccgagcgcguggaggaguggcuggaccuccccugcaagcugcuguccgagcccagccccaccucccucacgaagggcccgagcaccaaccgggacuaccugucccagcgccagggggcgcuggccaagauggagaccaaggaggcccaggccguccggaagcacgccaucgacgcgggcugcaacaucaucgaccacaucgacagccccagcuccaucuggguguucgccggggcccccgaccgcugcccgccgaccugccucuucaucgccggcauggccgagcugggcgcguucuucgccgugcugcaggacaugcggaacacgaucauggccagcaagaccaucgggaccuccgaggagaagcuccgcaagaaguccagcuucuaccagagcuaccugcgccggacccaguccaugggcauccagcuggaccagcgcaucaucguccucuucaugaucgagugggggaaggaggccguggacagcuuccaccugggcgacgacauggaccccgagauccggucccuggcccaggcgcucaucgaccagaaggugaaggagaucagcaaccaggagccccugaagcuguga

SEQ ID NO: 6312 - RNA, 1290 nt, Artificial Sequence
  derived and/or modified CDS sequence (opt1) from DOBV(SK/Aa)__AY961615.1__N
auggccacccuggaggagcuccagaaggagaucaacagccacgagggccagcuggugaucgcccgccagaaggucaaggacgcggagaagcaguacgagaaggaccccgacgaccugaacaagcggacccucuccgaccgcgagagcguggcccaguccauccagagcaagaucgacgagcugcggcgccagcuggccgaccggguggccgccgggaagaacaucggcaaggagcgcgaccccacggggcucgaccccggcgaccaccugaaggagaaguccaugcugagcuacgggaacgucaucgaccucaaccaccuggacaucgacgagcccaccggccagaccgcggacuggcuguccaucgugguguaccucaccagcuucgucgugcccauccugcugaaggcccucuacaugcugacgacccggggccgccagaccaccaaggacaacaaggggaugcggauccgcuucaaggacgacuccagcuucgaggacgugaacggcauccggaagccgaagcaccuguuccucuccaugcccaacgcccagagcuccaugaaggccgacgagaucacgcccgggcgcuuccggaccgcgaucugcggccuguaccccgcccaggucaaggcccgcaaccuggugagcccggugauguccgucaucggguuccucgcccuggccaagaacuggaccgagcggguggaggaguggcuggaccuccccugcaagcugcugagcgagcccucccccaccagccucacgaagggcccguccaccaaccgcgacuaccugaaccagcggcagggcgcgcuggccaagauggagaccaaggaggcccaggccgugcgcaagcacgccaucgacgcggggugcaacaucaucgaccacaucgacagccccagcuccaucugggucuucgccggcgcccccgaccggugcccgccgaccugccucuucaucgccgggauggccgagcugggcgcguucuucagcgugcugcaggacaugcgcaacacgaucauggccuccaagaccaucggcaccagcgaggagaagcuccggaagaaguccagcuucuaccaguccuaccugcgccgcacccagagcauggggauccagcuggaccagcggaucaucguccucuucaugguggacuggggcaaggaggccguggacuccuuccaccugggggacgacauggaccccgagcugcgcggccucgcccaggcccugaucgaccagaaggugaaggagaucagcaaccaggagccccugaagcucuga

SEQ ID NO: 6313 - RNA, 1290 nt, Artificial Sequence
  derived and/or modified CDS sequence (opt1) from DOBV(A35)__GU904030.1__N
auggccacccuggaggagcuccagaaggagaucaacaaccacgagggccagcuggugaucgcccgccagaaggucaaggacgcggagaagcaguacgagaaggaccccgacgaccugaacaagcgggcccucagcgaccgcgaguccaucgcccagagcauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgugaucgaccucaaccaccuggacaucgacgagcccacgggccagaccgccgacuggcuguccaucgucaucuaccucaccagcuucguggugcccauccugcugaaggcccucuacaugcugaccacgcgggggcgccagaccaccaaggacaacaagggcaugcggauccgcuucaaggacgacuccagcuucgaggacgucaacgggauccggaagccgaagcaccuguuccucuccaugcccaacgcccagagcuccaugaaggcggacgagaucacccccggccgcuuccggacggccaucugcgggcuguaccccgcccaggugaaggcccgcaaccugaucagcccggugauguccgucaucggcuucguggcccucgcgaagaacuggaccgagcggguggaggaguggcuggaccugcccugcaagcuccugagcgagcccucccccaccagccugaccaagggcccguccacgaaccgcgacuaccucaaccagcggcagggggcccuggccaagauggagaccaaggaggcccaggccguccgcaagcacgcgaucgacgccggcugcaaccugaucgaccacaucgacagccccuccagcaucuggguguucgccggggcccccgaccggugcccgccgaccugccucuucaucgccggcauggcggagcugggcgccuucuucgccgugcugcaggacaugcgcaacaccaucauggccagcaagacgaucgggaccuccgaggagaagcucaagaagaaguccagcuucuaccagagcuaccugcggcgcacccaguccaugggcauccagcuggaccagcgcaucaucguccucuucaugguggacugggggaaggaggccguggacagcuuccaccugggcgacgacauggaccccgagcugcgggggcucgcgcaggcccugaucgaccagaaggucaaggagaucuccaaccaggagccccugaagcucuga

SEQ ID NO: 6314 - RNA, 1290 nt, Artificial Sequence
  derived and/or modified CDS sequence (opt1) from DOBV(3970/87)__L41916.1__N
auggccacccuggaggagcuccagaaggagaucaacaaccacgagggccagcuggugaucgcccgccagaaggucaaggacgcggagaagcaguacgagaaggaccccgacgaccugaacaagcgggcccucagcgaccgcgaguccaucgcccagagcauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgugaucgaccucaaccaccuggacaucgacgagcccacgggccagaccgccgacuggcuguccaucgucaucuaccucaccagcuucguggugcccauccugcugaaggcccucuacaugcugaccacgcgggggcgccagaccaccaaggacaacaagggcaugcggauccgcuucaaggacgacuccagcuucgaggacgucaacgggauccggaagccgaagcaccuguuccucuccaugcccaacgcccagagcuccaugaaggcggacgagaucacccccggccgcuuccggacggccaucugcgggcuguaccccgcccaggugaaggcccgcaaccugaucagcccggugauguccgucaucggcuucguggcccucgcgaagaacuggaccgagcggguggaggaguggcuggaccugcccugcaagcuccugagcgagcccucccccaccagccugaccaagggcccguccacgaaccgcgacuaccucaaccagcggcagggggcccuggccaagauggagaccaaggaggcccaggccguccgcaagcacgcgaucgacgccggcugcaaccugaucgaccacaucgacagccccuccagcaucuggguguucgccggggcccccgaccggugcccgccgaccugccucuucaucgccggcauggcggagcugggcgccuucuucgccugccugcaggacaugcgcaacaccaucauggccagcaagacgaucgggaccuccgaggagaagcucaagaagaaguccagcuucuaccagagcuaccugcggcgcacccaguccaugggcauccagcuggaccagcgcaucaucguccucuucaugguggacugggggaaggaggccguggacagcuuccaccugggcgacgacauggaccccgagcugcgggggcucgcgcaggcccugaucgaccagaaggugaaggagaucuccaaccaggagccccugaagcucuga

SEQ ID NO: 6315 - RNA, 1290 nt, Artificial Sequence
  derived and/or modified CDS sequence (opt1) from DOBV(Klyuch-2000)__AF442622.1__N
auggccacccuggaggagcuccagaaggagaucaacagccacgagggccagcuggugaucgcccgccggaaggucaaggacgcggagaagcaguacgagaaggaccccgacgaccugaacaagcgcgcccucuccgaccgggagagcguggcccaguccauccaggggaagaucgacgagcugcgccggcagcuggccgaccgcguggccgcgggcaagaacaucgggaaggagcgggaccccaccggccucgaccccggggaccaccugaaggagaaguccaugcugagcuacggcaacgucaucgaccucaaccaccuggacaucgacgagcccacgggccagaccgccgacuggcugagcaucgugguguaccucaccuccuucgucgugcccauccugcugaaggcccucuacaugcugaccacgcgcgggcggcagaccaccaaggacaacaagggcaugcgcauccgguucaaggacgacagcuccuucgaggacgugaacgggauccgcaagccgaagcaccuguuccucagcaugcccaacgcccaguccagcaugaaggcggacgagaucacccccggccgguuccgcacggccgucugcgggcuguaccccgcccaggugaaggcccggaaccugguguccccggucaugagcgugaucggcuucgugucccucgccaagaacuggaccgagcgcgucgaggaguggcuggaccugcccugcaagcuccugagcgagcccucccccaccagccugaccaagggcccguccacgaaccgggacuaccucaaccagcgccagggggcgcuggccaagauggagaccaaggaggcccaggccgugcggaagcacgccaucaacgcgggcugcaaccugguggaccacaucgacagccccagcuccaucugggucuucgccggggcccccgaccgcugcccgccgaccugccucuucguggccggcauggccgagcugggcgcguucuucgccgugcugcaggacaugcggaacaccaucauggccagcaagacgaucgggaccuccgaggagaagcuccgcaagaaguccagcuucuaccagagcuaccugcgccggacccaguccaugggcauccagcuggaccagcgcaucaucguccucuucaugguggacugggggaaggaggccguggacagcuuccaccugggcgacgacauggaccccgagcugcgggggcucgcccaggcgcugaucgagcagaaggucaaggagaucuccaaccaggagccccugaagcucuga

SEQ ID NO: 6316 - RNA, 1290 nt, Artificial Sequence
  derived and/or modified CDS sequence (opt1) from DOBV(10636/Ap)__KP878311.1__N
auggccacccuggaggagcuccagaaggagaucaacaaccacgagggccagcuggugaucgcccgccagaaggucaaggacgcggagaagcaguacgagaaggaccccgacgaccugaacaagcgggcccucagcgaccgcgaguccguggcccagagcauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgucaucgaccucaaccaccuggacaucgacgagcccacgggccagaccgccgacuggcuguccaucgugguguaccucaccagcuucgucgugcccauccugcugaaggcccucuacaugcugaccacgcgggggcgccagaccaccaaggacaacaagggcaugcggauccgcuucaaggacgacuccagcuucgaggacgugaacgggauccggaagccgaagcaccuguuccucuccaugcccaacgcccagagcuccaugaaggcggacgagaucacccccggccgcuuccggacggccgucugcgggcuguaccccgcccaggugaaggcccgcaaccuggugagcccggucauguccgugaucggcuucgugagccucgccaagaacuggaccgagcgggucgaggaguggcuggaccugcccugcaagcuccuguccgagcccagccccaccucccugaccaagggcccgagcacgaaccgcgacuaccucaaccagcggcagggggcgcuggccaagauggagaccaaggaggcccaggccgugcgcaagcacgccaucgacgcgggcugcaaccugguggaccacaucgacucccccagcagcaucugggucuucgccggggcccccgaccggugcccgccgaccugccucuucguggccggcauggccgagcugggcgcguucuucgccgugcugcaggacaugcgcaacaccaucauggccuccaagacgaucgggaccagcgaggagaagcuccggaagaaguccagcuucuaccaguccuaccugcgccgcacccagagcaugggcauccagcuggaccagcggaucaucguccucuucaugguggacugggggaaggaggccguggacuccuuccaccugggcgacgacauggaccccgagcugcgcagccucgcccaggcgcugaucgaccagaaggucaaggagaucuccaaccaggagccccugaagcucuga

SEQ ID NO: 6317 - RNA, 1290 nt, Artificial Sequence
  derived and/or modified CDS sequence (opt1) from DOBV(10645/Ap)__KP878312.1__N
auggccacccuggaggagcuccagaaggagaucaacaaccacgagggccagcuggugaucgcccgccagaaggucaaggacgcggagaagcaguacgagaaggaccccgacgaccugaacaagcgggcccucagcgaccgcgaguccguggcccagagcauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgucaucgaccucaaccaccuggacaucgacgagcccacgggccagaccgccgacuggcuguccaucgugguguaccucaccagcuucgucgugcccauccugcugaaggcccucuacaugcugaccacgcgggggcgccagaccaccaaggacaacaagggcaugcggauccgcuucaaggacgacuccagcuucgaggacgugaacgggauccggaagccgaagcaccuguuccucuccaugcccaacgcccagagcuccaugaaggcggacgagaucacccccggccgcuuccggacggccgucugcgggcuguaccccgcccaggugaaggcccgcaaccuggugagcccggucauguccgugaucggcuucgugagccucgccaagaacuggaccgagcgggucgaggaguggcuggaccugcccugcaagcuccuguccgagcccagccccaccucccugaccaagggcccgagcacgaaccgcgacuaccucaaccagcggcagggggcgcuggccaagauggagaccaaggaggcccaggccgugcgcaagcacgccaucgacgcgggcugcaaccugguggaccacaucgacucccccagcagcaucugggucuucgccggggcccccgaccggugcccgccgaccugccucuucguggccggcauggccgagcugggcgcguucuucgccgugcugcaggacaugcgcaacaccaucauggccuccaagacgaucgggaccagcgaggagaagcuccggaagaaguccagcuucuaccaguccuaccugcgccgcacccagagcaugggcauccagcuggaccagcggaucaucguccucuucaugguggacugggggaaggaggccguggacuccuuccaccugggcgacgacauggaccccgagcugcgcgggcucgcccaggcgcugaucgaccagaaggucaaggagaucagcaaccaggagccccugaagcucuga

SEQ ID NO: 6318 - RNA, 1290 nt, Artificial Sequence
  derived and/or modified CDS sequence (opt1) from DOBV(Aa1854/Lipetsk-02)__EU188452.1__N
auggccacccuggaggagcuccagaaggagaucaacagccacgagggccagcuggugaucgcccgccagaaggucaaggacgcggagaagcaguacgagaaggaccccgacgaccugaacaagcgggcccucuccgaccgcgagagcguggcccaguccauccagagcaagaucgacgagcugcggcgccagcuggccgaccggguggccgcggggaagaacaucggcaaggagcgcgaccccaccgggcucgaccccggcgaccaccugaaggagaaguccaugcugagcuacgggaacgucaucgaccucaaccaccuggacaucgacgagcccacgggccagaccgccgacuggcuguccaucgugguguaccucaccagcuucgucgugcccauccugcugaaggcccucuacaugcugaccacgcggggccgccagaccaccaaggacaacaaggggaugcggauccgcuucaaggacgacuccagcuucgaggacgugaacggcauccggaagccgaagcaccuguuccucuccaugcccaacgcccagagcuccaugaaggcggacgagaucacccccgggcgcuuccggacggccaucugcggccuguaccccgcccaggucaaggcccgcaaccuggugagcccggugauguccgucaucggguuccucgcccuggcgaagaacuggaccgagcggguggaggaguggcuggaccuccccugcaagcugcugagcgagcccucccccaccagccucaccaagggcccguccacgaaccgcgacuaccugaaccagcggcaggccgcccuggccaagauggagaccaaggaggcccaggcggugcgcaagcacgccaucgacgccggcugcaccaucaucgaccacaucgacagccccagcuccaucugggucuucgccggggcccccgaccggugcccgccgaccugccucuucaucgcgggcauggccgagcugggggccuucuucagcgugcugcaggacaugcgcaacacgaucauggccuccaagcccgugggcaccagcgaggagaagcuccggaagaaguccagcuucuaccaguccuaccugcgccgcacccagagcaugggcauccagcuggaccagcggaucaucguccucuucaugguggacugggggaaggaggccguggacuccuuccaccugggcgacgacauggaccccgagcugcgcgggcucgcgcaggcccugaucgaccagaaggucaaggagaucagcaaccaggagccccugaagcucuga

SEQ ID NO: 6319 - RNA, 1290 nt, Artificial Sequence
  derived and/or modified CDS sequence (opt1) from DOBV(Ap/Sochi/43)__JF920151.1__N
auggccacccuggaggagcuccagaaggagaucaacaaccacgagggccagcuggugaucgcccgccagaaggucaaggacgcggagaagcaguacgagaaggaccccgacgaccugaacaagcgggcccucagcgaccgcgaguccguggcccagagcauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgucaucgaccucaaccaccuggacaucgacgagcccacgggccagaccgccgacuggcuguccaucgugguguaccucaccagcuucgucgugcccauccugcugaaggcccucuacaugcugaccacgcgggggcgccagaccaccaaggacaacaagggcaugcggauccgcuucaaggacgacuccagcuucgaggacgugaacgggauccggaagccgaagcaccuguuccucuccaugcccaacgcccagagcuccaugaaggcggacgagaucacccccggccgcuuccggacggccgucugcgggcuguaccccgcccaggugaaggcccgcaaccuggugagcccggucauguccgugaucggcuucgugagccucgccaagaacuggaccgagcgggucgaggaguggcuggaccugcccugcaagcuccuguccgagcccagccccaccucccugaccaagggcccgagcacgaaccgcgacuaccucaaccagcggcagggggcgcuggccaagauggagaccaaggaggcccaggccgugcgcaagcacgccaucgacgcgggcugcaaccugguggaccacaucgacucccccagcagcaucugggucuucgccggggcccccgaccggugcccgccgaccugccucuucguggccggcauggccgagcugggcgcguucuucgccgugcugcaggacaugcgcaacaccaucauggccuccaagacgaucgggaccagcgaggagaagcuccggaagaaguccagcuucuaccaguccuaccugcgccgcacccacagcaugggcauccagcuggaccagcggaucaucguccucuucaugguggacugggggaaggaggccguggacuccuuccaccugggcgacgacauggaccccgagcugcgcgggcucgcccaggcgcugaucgaccagaaggucaaggagaucagcaaccaggagccccugaagcucuga

SEQ ID NO: 6320 - RNA, 1290 nt, Artificial Sequence
  derived and/or modified CDS sequence (opt1) from DOBV(Ap/Sochi/hu)__JF920150.1__N
auggccacccuggaggagcuccagaaggagaucaacaaccacgagggccagcuggugaucgcccgccagaaggucaaggacgcggagaagcaguacgagaaggaccccgacgaccugaacaagcgggcccucagcgaccgcgaguccguggcccagagcauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgucaucgaccucaaccaccuggacaucgacgagcccacgggccagaccgccgacuggcuguccaucgugguguaccucaccagcuucgucgugcccauccugcugaaggcccucuacaugcugaccacgcgggggcgccagaccaccaaggacaacaagggcaugcggauccgcuucaaggacgacuccagcuucgaggacgugaacgggauccggaagccgaagcaccuguuccucuccaugcccaacgcccagagcuccaugaaggcggacgagaucacccccggccgcuuccggacggccgucugcgggcuguaccccgcccaggugaaggcccgcaaccuggugagcccggucauguccgugaucggcuuccucagccuggccaagaacuggaccgagcggguggaggaguggcuggaccuccccugcaagcugcuguccgagcccagccccaccucccucaccaagggcccgagcacgaaccgcgacuaccugaaccagcggcagggggcgcuggccaagauggagaccaaggaggcccaggccguccgcaagcacgccaucgacgcgggcugcaaccucguggaccacaucgacucccccagcagcaucuggguguucgccggggcccccgaccggugcccgccgaccugccuguucgucgccggcauggccgagcugggcgcguucuucgccgugcuccaggacaugcgcaacaccaucauggccuccaagacgaucgggaccagcgaggagaagcugcggaagaaguccagcuucuaccaguccuaccugcgccgcacccacagcaugggcauccagcucgaccagcggaucaucgugcuguucauggucgacugggggaaggaggccguggacuccuuccaccugggcgacgacauggaccccgagcuccgcgggcuggcccaggcgcugaucgaccagaaggugaaggagaucagcaaccaggagccccucaagcuguga

SEQ ID NO: 6321 - RNA, 1290 nt, Artificial Sequence
  derived and/or modified CDS sequence (opt1) from DOBV(Ap1584/Sochi-01)__EU188449.1__N
auggccacccuggaggagcucaagaaggagaucaacaaccacgagggccagcuggugaucgcccgccagaaggucaaggacgcggagaagcaguacgagaaggaccccgacgaccugaacaagcgggcccucagcgaccgcgaguccguggcccagagcauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgucaucgaccucaaccaccuggacaucgacgagcccacgggccagaccgccgacuggcuguccaucgugguguaccucaccagcuucgucgugcccauccugcugaaggcccucuacaugcugaccacgcgggggcgccagaccaccaaggacaacaagggcaugcggauccgcuucaaggacgacuccagcuucgaggacgugaacgggauccggaagccgaagcaccuguuccucuccaugcccaacgcccagagcuccaugaaggcggacgagaucacccccggccgcuuccggacggccgucugcgggcuguaccccgcccaggugaaggcccgcaaccuggugagcccggucauguccgugaucggcuucgugagccucgccaagaacuggaccgagcgggucgaggaguggcuggaccugcccugcaagcuccuguccgagcccagccccaccucccugaccaagggcccgagcacgaaccgcgacuaccucaaccagcggcagggggcgcuggccaagauggagaccaaggaggcccaggccgugcgcaagcacgccaucgacgcgggcugcaaccugguggaccacaucgacucccccagcagcaucugggucuucgccggggcccccgaccggugcccgccgaccugccucuucguggccggcauggccgagcugggcgcguucuucgccgugcugcaggacaugcgcaacaccaucauggccuccaagacgaucgggaccagcgaggagaagcuccggaagaaguccagcuucuaccaguccuaccugcgccgcacccagagcaugggcauccagcuggaccagcggaucaucguccucuucaugguggacugggggaaggaggccguggacuccuuccaccugggcgacgacauggaccccgagcugcgcgggcucgcccaggcgcugaucgaccagaaggucaaggagaucagcaaccaggagccccugaagcucuga

SEQ ID NO: 6322 - RNA, 1290 nt, Artificial Sequence
  derived and/or modified CDS sequence (opt1) from DOBV(DOB/Gola/235Af/07)__KC848495.1__N
auggccacccuggaggagcuccagaaggagaucaacaaccacgagggccagcuggugaucgcccgccagaaggucaaggacgcggagaagcaguacgagaaggaccccgacgaccugaacaagcgggcccucagcgaccgcgaguccaucgcccagagcauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgugaucgaccucaaccaccuggacaucgacgagcccacgggccagaccgccgacuggcuguccaucgucguguaccucaccagcuucgugguccccauccugcugaaggcccucuacaugcugaccacgcgggggcgccagaccaccaaggacaacaagggcaugcggauccgcuucaaggacgacuccagcuucgaggacgugaacgggauccggaagccgaagcaccuguuccucuccaugcccaacgcccagagcucccgcaaggcggacgagaucacccccggccgguuccgcacggccaucugcgggcuguaccccgcccaggugaaggcccggaaccugaucagcccggucauguccgugaucggcuuccucgcccuggcgaagaacuggaccgagcgcguggaggaguggcuggaccuccccugcaagcugcugagcgagcccucccccaccagccucaccaagggcccguccacgaaccgggacuaccugaaccagcgccagggggcccuggccaagauggagaccaaggaggcccaggccguccggaagcacgcgaucgacgccggcugcaaccucaucgaccacaucgacagccccuccagcaucuggguguucgccggggcccccgaccgcugcccgccgaccugccuguucaucgccggcauggcggagcugggcgccuucuucgccgugcuccaggacaugcggaacaccaucauggccagcaagacgaucgggaccuccgaggagaagcugaagaagaaguccagcuucuaccagagcuaccugcgccgcacccaguccaugggcauccagcucgaccagcggaucaucguccuguucaugguggacugggggaaggaggccguggacagcuuccaccugggcgacgacauggaccccgagcuccgcgggcuggcgcaggcccugaucgaccagaaggucaaggagaucuccaaccaggagccccucaagcuguga

SEQ ID NO: 6323 - RNA, 1290 nt, Artificial Sequence
  derived and/or modified CDS sequence (opt1) from DOBV(DOB/Gola/343Af/07)__KC848498.1__N
auggccacccuggaggagcuccagaaggagaucaacaaccacgagggccagcuggugaucgcccgccagaaggucaaggacgcggagaagcaguacgagaaggaccccgacgaccugaacaagcgggcccucagcgaccgcgaguccaucgcccagagcauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgugaucgaccucaaccaccuggacaucgacgagcccacgggccagaccgccgacuggcuguccaucgucguguaccucaccagcuucgugguccccauccugcugaaggcccucuacaugcugaccacgcgggggcgccagaccaccaaggacaacaagggcaugcggauccgcuucaaggacgacuccagcuucgaggacgugaacgggauccggaagccgaagcaccuguuccucuccaugcccaacgcccagagcuccaugaaggcggacgagaucacccccggccgcuuccggacggccaucugcgggcuguaccccgcccaggugaaggcccgcaaccugaucagcccggucauguccgugaucggcuuccucgcccuggcgaagaacuggaccgagcggguggaggaguggcuggaccuccccugcaagcugcugagcgagcccucccccaccagccucaccaagggcccguccacgaaccgcgacuaccugaaccagcggcagggggcccuggccaagauggagaccaaggaggcccaggccguccgcaagcacgcgaccgacgccggcugcaaccucaucgaccacaucgacagccccuccagcaucuggguguucgccggggcccccgaccggugcccgccgaccugccuguucaucgccggcauggcggagcugggcgccuucuucgccgugcuccaggacaugcgcaacacgaucauggccagcaagaccaucgggaccuccgaggagaagcugaagaagaaguccagcuucuaccagagcuaccugcggcgcacccaguccaugggcauccagcucgaccagcgcaucaucguccuguucaugguggacugggggaaggaggccguggacagcuuccaccugggcgacgacauggaccccgagcuccgggggcuggcgcaggcccugaucgaccagaaggucaaggagaucuccaaccaggagccccucaagcuguga

SEQ ID NO: 6324 - RNA, 1290 nt, Artificial Sequence
  derived and/or modified CDS sequence (opt1) from DOBV(DOB/Pecs/27Aa/06)__KC848499.1__N
auggccacccuggaggagcuccagaaggagaucaacagccacgagggccagcuggugaucgcccgccagaaggucaaggacgcggagaagcaguacgagaaggaccccgacgaccugaacaagcgggcccucuccgaccgcgagagcguggcccaguccauccagagcaagaucgacgagcugcggcgccagcuggccgaccggguggccgcggggaagaacaucggcaaggagcgcgaccccaccgggcucgaccccggcgaccaccugaaggagaaguccaugcugagcuacgggaacgucaucgaccucaaccaccuggacaucgacgagcccacgggccagaccgccgacuggcuguccaucgugguguaccucaccagcuucgucgugcccauccugcugaaggcccucuacaugcugaccacgcggggccgccagaccaccaaggacaacaaggggaugcgggugcgcuucaaggacgacuccagcuucgaggacgucaacggcauccggaagccgaagcaccuguuccucuccaugcccaacgcccagagcuccaugaaggcggacgagaucacccccgggcgcuuccggacggccgugugcggccuguaccccgcccaggugaaggcccgcaaccuggucagcccggugauguccgugaucggguuccucgcccuggcgaagaacuggaccgagcgggucgaggaguggcuggaccuccccugcaagcugcugagcgagcccucccccaccagccucaccaagggcccguccacgaaccgcgacuaccugaaccagcggcagggcgcccuggccaagauggagaccaaggaggcccaggccgugcgcaagcacgcgaucgacgccgggugcaacaucaucgaccacaucgacagccccagcuccaucuggguguucgccggcgcccccgaccggugcccgccgaccugccucuucaucgccgggauggcggagcugggcgccuucuucagcguccugcaggacaugcgcaacaccaucauggccuccaagacgaucggcaccagcgaggagaagcuccggaagaaguccagcuucuaccaguccuaccugcgccgcacccagagcauggggauccagcuggaccagcggaucaucguccucuucaugguggacuggggcaaggaggccguggacuccuuccaccugggggacgacauggaccccgagcugcgcggccucgcccaggcgcugaucgaccagaaggugaaggagaucagcaaccaggagccccugaagcucuga

SEQ ID NO: 6325 - RNA, 1290 nt, Artificial Sequence
  derived and/or modified CDS sequence (opt1) from DOBV(DOB/Pecs/31Aa/06)__KC848500.1__N
auggccacccuggaggagcuccagaaggagaucaacagccacgagggccagcuggugaucgcccgccagaaggucaaggacgcggagaagcaguacgagaaggaccccgacgaccugaacaagcgggcccucuccgaccgcgagagcguggcccaguccauccagagcaagaucgacgagcugcggcgccagcuggccgaccggguggccgcggggaagaacaucggcaaggagcgcgaccccaccgggcucgaccccggcgaccaccugaaggagaaguccaugcugagcuacgggaacgucaucgaccucaaccaccuggacaucgacgagcccacgggccagaccgccgacuggcuguccaucgugguguaccucaccagcuucgucgugcccauccugcugaaggcccucuacaugcugaccacgcggggccgccagaccaccaaggacaacaaggggaugcggauccgcuucaaggacgacuccagcuucgaggacgugaacggcauccggaagccgaagcaccuguuccucuccaugcccaacgcccagagcuccaugaaggcggacgagaucacccccgggcgcuuccggacggccgucugcggccuguaccccgcccaggugaaggcccgcaaccuggugagcccggucauguccgugaucggguuccucgcccuggcgaagaacuggaccgagcggguggaggaguggcuggaccuccccugcaagcugcugagcgagcccucccccaccagccucaccaagggcccguccacgaaccgcgacuaccugaaccagcggcagggcgcccuggccaagauggagaccaaggaggcccaggccguccgcaagcacgcgaucgacgccgggugcaacaucaucgaccacaucgacagccccagcuccaucuggguguucgccggcgcccccgaccggugcccgccgaccugccucuucaucgccgggauggcgcagcugggcgccuucuucagcgugcugcaggacaugcgcaacaccaucauggccuccaagacgaucggcaccagcgaggagaagcuccggaagaaguccagcuucuaccaguccuaccugcgccgcacccagagcauggggauccagcuggaccagcggaucaucguccucuucaugguggacuggggcaaggaggccguggacuccuuccaccugggggacgacauggaccccgagcugcgcggccucgcccaggcgcugaucgaccagaagaugaaggagaucagcaaccaggagccccugaagcucuga

SEQ ID NO: 6326 - RNA, 1290 nt, Artificial Sequence
  derived and/or modified CDS sequence (opt1) from DOBV(DOB/Sarmellek/77Aa/06)__KC848501.1__N
auggccacccuggaggagcuccagaaggagaucaacagccacgagggccagcuggugaucgcccgccagaaggucaaggacgcggagaagcaguacgagaaggaccccgacgaccugaacaagcgggcccucuccgaccgcgagagcguggcccaguccauccagagcaagaucgacgagcugcggcgccagcuggccgaccggguggccuccgggaagaacaucggcaaggagcgcgaccccaccgggcucgaccccggcgaccaccugacggagaaguccaugcugagcuacgggaacgucaucgaccucaaccaccuggacaucgacgagcccaccggccagaccgcggacuggcugagcaucgugguguaccucaccuccuucgucgugcccauccugcugaaggcccucuacaugcugacgacccggggccgccagaccaccaaggacaacaaggggaugcggauccgcuucaaggacgacagcuccuucgaggacgugaacggcauccggaagccgaagcaccuguuccucagcaugcccaacgcccaguccagcaugaaggccgacgagaucacgcccgggcgcuuccggaccgcgaucugcggccuguaccccgcccaggucaaggcccgcaaccugguguccccggugaugagcgucaucggguuccucgcccuggccaagaacuggaccgagcggguggaggaguggcuggaccuccccugcaagcugcuguccgagcccagccccaccucccucacgaagggcccgagcaccaaccgcgacuaccugaaccagcggcagggcgcgcuggccaagauggagaccaaggaggcccaggccgugcgcaagcacgccaucgacgcggggugcaacaucaucgaccacaucgacagccccuccagcaucugggucuucgccggcgcccccgaccggugcccgccgaccugccucuucaucgccgggauggccgagcugggcgcguucuucuccgugcugcaggacaugcgcaacacgaucauggccagcaagaccgugggcaccuccgaggagaagcuccggaagaaguccagcuucuaccagagcuaccugcgccgcacccaguccauggggauccagcuggaccagcggaucaucguccucuucaugguggacuggggcaaggaggccguggacagcuuccaccugggggacgacauggaccccgagcugcgcucccucgcccaggcccugaucgaccagaaggucaaggagaucagcaaccaggagccccugaagcucuga

SEQ ID NO: 6327 - RNA, 1290 nt, Artificial Sequence
  derived and/or modified CDS sequence (opt1) from DOBV(GER/05/239/Aa)__GQ205405.1__N
auggccacccuggaggagcuccagaaggagaucaacagccacgagggccagcuggugaucgcccgccagaaggucaaggacgcggagaagcaguacgagaaggaccccgacgaccugaacaagcgggcccucuccgaccgcgagagcguggcccaguccauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgucaucgaccucaaccaccuggacaucgacgagcccacgggccagaccgccgacuggcugagcaucgugguguaccucaccuccuucgucgugcccauccugcugaaggcccucuacaugcugaccacgcgggggcgccagaccaccaaggacaacaagggcaugcggauccgcuucaaggacgacagcuccuucgaggacgugaacgggauccggaagccgaagcaccuguuccucagcaugcccaacgcccaguccagcaugaaggcggacgagaucacccccggccgcuuccggacggccaucugcgggcuguaccccgcccaggucaaggcccgcaaccugguguccccggugaugagcgucaucggcuuccucgcccuggcgaagaacuggaccgagcggguggaggaguggcuggaccuccccugcaagcugcuguccgagcccagccccaccucccucaccaagggcccgagcacgaaccgcgacuaccugucccagcggcagggggcccuggccaagauggagaccaaggaggcccaggccgugcgcaagcacgcgaucgacgccggcugcaacaucaucgaccacaucgacagccccagcuccaucugggucuucgccggggcccccgaccggugcccgccgaccugccucuucaucgccggcauggcggagcugggcgccuucuucgccgugcugcaggacaugcgcaacaccaucauggccagcaagacgaucgggaccuccgaggagaagcuccggaagaaguccagcuucuaccagagcuaccugcgccgcacccaguccaugggcauccagcuggaccagcggaucaucguccucuucaugguggacugggggaaggaggccguggacagcuuccaccugggcgacgacauggaccccgagcugcgcucccucgcgcaggcccugaucgaccagaaggugaaggagaucagcaaccaggagccccugaagcucuga

SEQ ID NO: 6328 - RNA, 1290 nt, Artificial Sequence
  derived and/or modified CDS sequence (opt1) from DOBV(GER/05/477/Af)__GQ205406.1__N
auggccacccuggaggagcuccagaaggagaucaacagccacgagggccagcuggugaucgcccgccagaaggucaaggacgcggagaagcaguacgagaaggaccccgacgaccugaacaagcgggcccucuccgaccgcgagagcguggcccaguccauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgucaucgaccucaaccaccuggacaucgacgagcccacgggccagaccgccgacuggcugagcaucgugguguaccucaccuccuucgucgugcccauccugcugaaggcccucuacaugcugaccacgcgggggcgccagaccaccaaggacaacaagggcaugcggauccgcuucaaggacgacagcuccuucgaggacgugaacgggauccggaagccgaagcaccuguuccucagcaugcccaacgcccaguccagcaugaaggcggacgagaucacccccggccgcuuccggacggccaucugcgggcuguaccccgcccaggucaaggcccgcaaccugguguccccggugaugagcgucaucggcuuccucgcccuggcgaagaacuggaccgagcggguggaggaguggcuggaccuccccugcaagcugaucuccgagcccagccccaccucccugaccaagggcccgagcacgaaccgcgacuaccucucccagcggcagggggcccuggccaagauggagaccaaggaggcccaggccgugcgcaagcacgcgaucgacgccggcugcaacaucaucgaccacaucgacagccccagcuccaucugggucuucgccggggcccccgaccggugcccgccgaccugccuguucaucgccggcauggcggagcucggcgccuucuucgccgugcugcaggacaugcgcaacaccaucauggccagcaagacgaucgggaccuccgaggagaagcugcggaagaaguccagcuucuaccagagcuaccuccgccgcacccaguccaugggcauccagcuggaccagcggaucaucgugcuguucauggucgacugggggaaggaggccguggacagcuuccaccucggcgacgacauggaccccgagcugcgcucccuggcgcaggcccucaucgaccagaaggugaaggagaucagcaaccaggagccccugaagcuguga

SEQ ID NO: 6329 - RNA, 1290 nt, Artificial Sequence
  derived and/or modified CDS sequence (opt1) from DOBV(GER/07/293/Aa)__GQ205401.1__N
auggccacccuggaggagcuccagaaggagaucaacagccacgagggccagcuggugaucgcccgccagaaggucaaggacgcggagaagcaguacgagaaggaccccgacgaccugaacaagcgggcccucuccgaccgcgagagcguggcccaguccauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgucaucgaccucaaccaccuggacaucgacgagcccacgggccagaccgccgacuggcugagcaucgugguguaccucaccuccuucgucgugcccauccugcugaaggcccucuacaugcugaccacgcgggggcgccagaccaccaaggacaacaagggcaugcggauccgcuucaaggacgacagcuccuucgaggacgugaacgggauccggaagccgaagcaccuguuccucagcaugcccaacgcccaguccagcaugaaggcggacgagaucacccccggccgcuuccggacggccaucugcgggcuguaccccgcccaggucaaggcccgcaaccugguguccccggugaugagcgucaucggcuuccucgcccuggcgaagaacuggaccgagcggguggaggacuggcuggaccuccccugcaagcugcuguccgagcccagccccaccucccucaccaagggcccgagcacgaaccgcgacuaccugaaccagcggcagggggcccuggccaagauggagaccaaggaggcccaggccgugcgcaagcacgcgaucgacgccggcugcaacaucaucgaccacaucgacucccccagcagcaucugggucuucgccggggcccccgaccggugcccgccgaccugccucuucaucgccggcauggcggagcugggcgccuucuucgccgugcugcaggacaugcgcaacaccaucauggccuccaagacgaucgggaccagcgaggagaagcuccggaagaaguccagcuucuaccaguccuaccugcgccgcacccagagcaugggcauccagcuggaccagcggaucaucgugcuccugauggucgacugggggaaggaggccguggacuccuuccaccugggcgacgacauggaccccgagcuccgcgggcuggcgcaggcccugaucgaccagaaggugaaggagaucagcaaccaggagccccucaagcuguga

SEQ ID NO: 6330 - RNA, 1290 nt, Artificial Sequence
  derived and/or modified CDS sequence (opt1) from DOBV(GER/07/424/Aa)__GQ205403.1__N
auggccacccuggaggagcuccagaaggagaucaacagccacgagggccagcuggugaucgcccgccagaaggucaaggacgcggagaagcaguacgagaaggaccccgacgaccugaacaagcgggcccucuccgaccgcgagagcguggcccaguccauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgucaucgaccucaaccaccuggacaucgacgagcccacgggccagaccgccgacuggcugagcaucgugguguaccucaccuccuucgucgugcccauccugcugaaggcccucuacaugcugaccacgcgggggcgccagaccaccaaggacaacaagggcaugcggauccgcuucaaggacgacagcuccuucgaggacgugaacgggauccggaagccgaagcaccuguuccucagcaugcccaacgcccaguccagcaugaaggcggacgagaucacccccggccgcuuccggacggccaucugcgggcuguaccccgcccaggucaaggcccgcaaccugguguccccggugaugagcgucaucggcuuccucgcccuggcgaagaacuggaccgagcggguggaggacuggcuggaccuccccugcaagcugcuguccgagcccagccccaccucccucaccaagggcccgagcacgaaccgcgacuaccugaaccagcggcagggggcccuggccaagauggagaccaaggaggcccaggccgugcgcaagcacgcgaucgacgccggcugcaacaucaucgaccacaucgacucccccagcagcaucugggucuucgccggggcccccgaccggugcccgccgaccugccucuucaucgccggcauggcggagcugggcgccuucuucgccgugcugcaggacaugcgcaacaccaucauggccuccaagacgaucgggaccagcgaggagaagcuccggaagaaguccagcuucuaccaguccuaccugcgccgcacccagagcaugggcauccagcuggaccagcggaucaucguccucuucaugguggacugggggaaggaggccguggacuccuuccaccugggcgacgacauggaccccgagcugcgcgggcucgcgcaggcccugaucgaccagaaggugaaggagaucagcaaccaggagccccugaagcucuga

SEQ ID NO: 6331 - RNA, 1290 nt, Artificial Sequence
  derived and/or modified CDS sequence (opt1) from DOBV(GER/08/118/Aa)__GQ205407.1__N
auggccacccuggaggagcuccagaaggagaucaacagccacgagggccagcuggugaucgcccgccagaaggucaaggacgcggagaagcaguacgagaaggaccccgacgaccugaacaagcgggcccucuccgaccgcgagagcguggcccaguccauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgucaucgaccucaaccaccuggacaucgacgagcccacgggccagaccgccgacuggcugagcaucgugguguaccucaccuccuucgucgugcccauccugcugaaggcccucuacaugcugaccacgcgggggcgccagaccaccaaggacaacaagggcaugcggauccgcuucaaggacgacagcuccuucgaggacgugaacgggauccggaagccgaagcaccuguuccucagcaugcccaacgcccaguccagcaugaaggcggacgagaucacccccggccgcuuccggacggccaucugcgggcuguaccccgcccaggucaaggcccgcaaccugguguccccggugaugagcgucaucggcuuccucgcccuggcgaagaacuggaccgagcggguggaggacuggcuggaccuccccugcaagcugcuguccgagcccagccccaccucccucaccaagggcccgagcacgaaccgcgacuaccugaaccagcggcagggggcccuggccaagauggagaccaaggaggcccaggccgugcgcaagcacgcgaucgacgccggcugcaacaucaucgaccacaucgacucccccagcagcaucugggucuucgccggggcccccgaccggugcccgccgaccugccucuucaucgccggcauggcggagcugggcgccuucuucgccgugcugcaggacaugcgcaacaccaucauggccuccaagacgguggggaccagcgaggagaagaugcggaagaaguccagcuucuaccaguccuaccuccgccgcacccagagcaugggcauccagcuggaccagcggaucaucguccuguucaugguggacugggggaaggaggccguggacuccuuccaccucggcgacgacauggaccccgagcugcgcgggcuggcgcaggcccucaucgaccagaaggucaaggagaucagcaaccaggagccccugaagcuguga

SEQ ID NO: 6332 - RNA, 1290 nt, Artificial Sequence
  derived and/or modified CDS sequence (opt1) from DOBV(GER/08/131/Af)__GQ205408.1__N
auggccacccuggaggagcuccagaaggagaucaacagccacgagggccagcuggugaucgcccgccagaaggucaaggacgcggagaagcaguacgagaaggaccccgacgaccugaacaagcgggcccucuccgaccgcgagagcguggcccaguccauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgucaucgaccucaaccaccuggacaucgacgagcccacgggccagaccgccgacuggcugagcaucgugguguaccucaccuccuucgucgugcccauccugcugaaggcccucuacaugcugaccacgcgggggcgccagaccaccaaggacaacaagggcaugcggauccgcuucaaggacgacagcuccuucgaggacgugaacgggauccggaagccgaagcaccuguuccucagcaugcccaacgcccaguccagcaugaaggcggacgagaucacccccggccgcuuccggacggccgucugcgggcuguaccccgcccaggugaaggcccgcaaccugguguccccggucaugagcgugaucggcuuccucgcccuggcgaagaacuggaccgagcggguggaggacuggcuggaccuccccugcaagcugcuguccgagcccagccccaccucccucaccaagggcccgagcacgaaccgcgacuaccugaaccagcggcagggggcccuggccaagauggagaccaaggaggcccaggccguccgcaagcacgcgaucgacgccggcugcaacaucaucgaccacaucgacucccccagcagcaucuggguguucgccggggcccccgaccggugcccgccgaccugccucuucaucgccggcauggcggagcugggcgccuucuucgccgugcugcaggacaugcgcaacaccaucauggccuccaagacgaucgggaccagcgaggagaagcuccggaagaaguccagcuucuaccaguccuaccugcgccgcacccagagcaugggcauccagcuggaccagcggaucaucguccucuucaugguggacugggggaaggaggccguggacuccuuccaccugggcgacgacauggaccccgagcugcgcgggcucgcgcaggcccugaucgaccagaaggucaaggagaucagcaaccaggagccccugaagcucuga

SEQ ID NO: 6333 - RNA, 1290 nt, Artificial Sequence
  derived and/or modified CDS sequence (opt1) from HTNV(76-118/POR)__KT885049.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccaaccgcgaggggguggccgugagcauccaggccaagaucgacgagcucaagaugcagcuggcggaccggaucgccacgggcaagaaccuggggaaggagcaggaccccaccggcgucgagcccggggaccaccucaaggagcgcuccaugcugagcuacggcaacgugcuggaccucaaccaccuggacaucgacgagcccaccggccagaccgccgacuggcuguccaucaucguguaccucacgagcuucgucgugcccauccugcugaaggcccucuacaugcugaccacccgggggcgccagaccacgaaggacaacaagggcacccggauccgcuucaaggacgacuccagcuucgaggacgugaacgggauccggaagccgaagcaccuguacgucucccuccccaacgcgcagagcuccaugaaggccgaggagaucacccccggccgcuaccggaccgccgugugcgggcuguaccccgcccagaucaaggcccgccagaugaucagcccggugauguccgucaucggcuuccuggcgcucgccaaggacuggagcgaccggaucgagcaguggcugaucgagcccugcaagcugcuccccgacacggccgccgugucccugcugggcgggcccgccaccaaccgcgacuaccuccggcagcgccagguggcgcugggcaacauggagaccaaggagagcaaggccauccggcagcacgccgaggccgccgggugcuccaugaucgaggacaucgagagcccguccagcaucugggucuucgcgggcgcccccgaccgcugcccgccgaccugccuguucaucgccggcaucgccgagcucggggccuucuucuccauccugcaggacaugcggaacacgaucauggcgagcaagaccgugggcaccagcgaggagaagcugcgcaagaaguccagcuucuaccaguccuaccuccgccggacccagagcauggggauccagcuggaccagcgcaucaucgugcuguucauggucgccuggggcaaggaggccguggacaacuuccaccucggggacgacauggaccccgagcugcggacgcuggcccagucccucaucgacgugaaggucaaggagaucagcaaccaggagccccugaagcuguga

SEQ ID NO: 6334 - RNA, 1290 nt, Artificial Sequence
  derived and/or modified CDS sequence (opt1) from HTNV(A16)__AF288646.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggcucgccgccagcauccaggcgaagaucgacgagcugaagcggcagcuggccgaccgcaucgccacgggcaagaaccucgggaaggagcaggaccccaccggcguggagcccggggaccaccugaaggagcgguccaugcugagcuacggcaacgugcucgaccugaaccaccuggacaucgacgagcccaccggccagaccgccgacuggcucuccaucgucaucuaccugacgagcuucguggugcccauccugcucaaggcgcuguacaugcugaccacccgcgggcggcagaccacgaaggacaacaagggcacccgcauccgguucaaggacgacuccagcuucgaggacgucaacgggauccgcaagccgaagcaccucuacgugucccugcccaacgcccagagcuccaugaaggccgaggagaucacccccggccgguaccgcaccgccaucugcgggcuguaccccgcccagaucaaggcgcggcagaugaucagcccggugauguccgucaucggcuuccucgcccuggccaaggacuggagcgaccgcaucgagcaguggcuguccgagcccugcaagcuccugcccgacacggccgccgugagccugcacggcgggcccgcgaccaaccgggacuaccuccgccagcgccagguggcccugggcaacauggagaccaaggaguccaaggccauccggcagcacgccgagagcgccgggugcuccauggucgaggacaucgagagcccguccagcaucuggguguucgcgggcgcccccaaccggugcccgccgaccugccuguucaucgccggcaucgccgagcucggggccuucuucagcauccugcaggacaugcgcaacacgaucauggcguccaagaccgugggcaccagcgaggagaagcugcgcaagaaguccagcuucuaccaguccuaccuccggcgcacccagagcauggggauccagcuggaccagcggaucaucguccuguucaugguggccuggggcaaggaggccguggacaacuuccaccucggggacgacauggaccccguccugcgcacgcuggcccagucccucaucgacgugaaggugaaggagaucagcaaccaggagccccugaagcuguga

SEQ ID NO: 6335 - RNA, 1290 nt, Artificial Sequence
  derived and/or modified CDS sequence (opt1) from HTNV(CA09082007)__HQ834499.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgccagcauccaggcgaagaucgacgagcucaagcggcagcuggccgaccgcaucgccacgggcaagaaccuggggaaggagcaggaccccaccggcguggagcccggggaccaccucaaggagcgguccaugcugagcuacggcaacguccuggaccucaaccaccuggacaucgacgagcccaccggccagaccgccgacuggcuguccaucgugaucuaccucacgagcuucgugguccccauccugcugaaggcgcucuacaugcugaccacccgcgggcggcagaccacgaaggacaacaagggcacccgcauccgguucaaggacgacuccagcuucgaggacgugaacgggauccgcaagccgaagcaccuguacgugucccuccccaacgcccagagcuccaugaaggccgaggagaucacccccggccgguaccgcaccgccaucugcgggcuguaccccgcccagaucaaggcgcggcagaugaucagcccggucauguccgugaucggcuuccuggcccucgccaaggacuggagcgaccgcaucgagcaguggcuguccgagcccugcaagcugcuccccgacacggccgccgugagccugcacggcgggcccgcgaccaaccgggacuaccugcgccagcggcaggucgcccucggcaacauggagaccaaggaguccaaggccauccgccagcacgccgagagcgccgggugcuccaugguggaggacaucgagagcccguccagcaucuggguguucgcgggcgcccccgaccggugcccgccgaccugccuguucaucgccggcaucgccgagcugggggccuucuucagcauccuccaggacaugcgcaacacgaucauggcguccaagaccgucggcaccagcgaggagaagcugcgcaagaaguccagcuucuaccaguccuacauccggcgcacccagagcauggggauccagcuggaccagcggaucaucguccucuucaugguggccuggggcaaggaggccguggacaacuuccaccugggggacgacauggaccccgagcugcgcacgcucgcccagucccugaucgaccugaaggugaaggagaucagcaaccaggagccccucaagcuguga

SEQ ID NO: 6336 - RNA, 1290 nt, Artificial Sequence
  derived and/or modified CDS sequence (opt1) from HTNV(CA10081109)__HQ834500.1__N
augcccaccagcggcgagcugcagcgcgagaucaacgcccacgaggggcagcucgugaucgcccggcagaagguccgcgacgcggagaagcaguacgagaaggaccccgacgagcugaacaagcgggcccugaccgaccgcgagggcguggccgccuccauccaggccaagaucgacgagcucaagcggcagcuggcggaccgcaucgccacggggaagaaccugggcaaggagcaggaccccaccgggguggagcccggcgaccaccucaaggagcggagcaugcuguccuacggcaacguccuggaccucaaccaccuggacaucgacgagcccaccgggcagaccgccgacuggcugagcaucgugaucuaccucacguccuucguggucccgauccugcugaaggcccucuacaugcugaccacccgcggccggcagaccacgaaggacaacaaggggacccgcauccgguucaaggacgacagcuccuucgaggacgugaacggcauccgcaagcccaagcaccuguacgugagccuccccaacgcgcaguccagcaugaaggccgaggagaucacccccgggcgguaccgcaccgccaucugcgagcuguacccggcccagaucaaggccuccaagaugaucagccccgucauguccgugaucggcuuccuggcgcucgccaaggacuggagcgaccggaucgagcaguggcuguccgagcccugcaagcugcuccccgacacggccgccgugagccugcacggcgggccggccaccaaccgcgacuaccugcggcagcgccaggucgcgcucggcaacauggagaccaaggaguccaaggccauccggcagcacgccgagagcgccgggugcuccaugguggaggacaucgagagccccagcuccaucuggguguucgccggcgcgcccgaccgcugcccgccgaccugccuguucaucgccggcaucgccgagcugggggccuucuucagcauccuccaggacaugcggaacacgaucauggccuccaagaccgucggcaccagcgaggagaagcugcgcaagaaguccagcuucuaccaguccuaccugcgccggacccagagcauggggauccagcucgaccagcgcaucaucgugcuguucaugguggcguggggcaaggaggccgucgacaacccccacgccggggacgacguggaccccucccugggcaugcucgcccagagccugaucgacgugaaggucaaggagaucuccaaccaggagccccugaagcucuga

SEQ ID NO: 6337 - RNA, 1290 nt, Artificial Sequence
  derived and/or modified CDS sequence (opt1) from HTNV(CA10081113)__HQ834501.1__N
auggccaccagcggcgagcugcagcgcgagaucaacgcccacgaggggcagcucgugaucgcgcggcagaagguccgcgacgccgagaagcaguacgagaaggaccccgacgagcugaacaagcgggcccugaccgaccgcgagggcguggccgccuccauccaggcgaagaucgacgagcucaagcggcagcuggccgaccgcaucgccacggggaagaaccugggcaaggagcaggaccccaccgggguggagcccggcgaccaccucaaggagcggagcaugcuguccuacggcaacguccuggaccucaaccaccuggacaucgacgagcccaccgggcagaccgccgacuggcugagcaucgugaucuaccucacguccuucgugguccccauccugcugaaggcgcucuacaugcugaccacccgcggccggcagaccacgaaggacaacaaggggacccgcauccgguucaaggacgacagcuccuucgaggacgugaacggcauccgcaagccgaagcaccuguacgugagccuccccaacgcccaguccagcaugaaggccgaggagaucacccccgggcgguaccgcaccgccaucuucgagcuguaccccgcccagaucaaggcgcggcagaugaucuccccggucaugagcgugaucggcuuccuggcccucgccaaggacugguccgaccgcaucgagcaguggcugagcgagcccugcaagcugcuccccgacacggccgccgugucccugcacggcgggcccgcgaccaaccgggacuaccugcgccagcggcaggucgcccucggcaacauggagaccaaggagagcaaggccauccgccagcacgccgaguccgccgggugcagcaugguggaggacaucgaguccccgagcagcaucuggguguucgcgggcgcccccgaccggugcccgccgaccugccuguucaucgccggcaucgccgagcugggggccuucuucuccauccuccaggacaugcgcaacacgaucauggcgagcaagaccgucggcaccuccgaggagaagcugcgcaagaaguccagcuucuaccagagcuaccugcggcgcacccaguccauggggauccagcucgaccagcggaucaucgugcuguucaugguggccuggggcaaggaggccgucgacaaccgccaccugaugaacaucguggaccccgagccccgggcccucgcgcagagccugaucgacgugaaggucaaggagaucuccaaccaggagccccugaagcucuga

SEQ ID NO: 6338 - RNA, 1290 nt, Artificial Sequence
  derived and/or modified CDS sequence (opt1) from HTNV(CA10081203)__HQ834502.1__N
auggccaccaacggcgagcugcagcgcgagaucaacgcccacgaggggcagcucgugaucgcgcggcagaagguccgcgacgccgagaagcaguacgagaaggaccccgacgagcugaacaagcgggcccugaccgaccgcgagggcguggccgccagcauccaggcgaagaucgacgagcucaagcggcagcuggccgaccgcaucgccacggggaagaaccugggcaaggagcaggaccccaccgggguggagcccggcgaccaccucaaggagcgguccaugcugagcuacggcaacguccuggaccucaaccaccuggacaucgacgagcccaccgggcagaccgccgacuggcuguccaucgugaucuaccucacgagcuucgugguccccauccugcugaaggcgcucuacaugcugaccacccgcggccggcagaccacgaaggacaacaaggggacccgcauccgguucaaggacgacuccagcuucgaggacgugaacggcauccgcaagccgaagcaccuguacgugucccuccccaacgcccagagcuccaugaaggccgaggagaucacccccgggcgguaccgcaccgccaucuucggccuguaccccgcccagaucaaggcgcggcagaugaucagcccggucauguccgugaucggcuuccuggcccucgccaaggacuggagcgaccgcaucgagcaguggcuguccgagcccugcaagcugcuccccgacacggccgccgugagccugcacgggggccccgcgaccaaccgggacuaccugcgccagcggcaggucgcccucgggaacauggagaccaaggaguccaaggccauccgccagcacgccgagagcgccggcugcuccaugguggaggacaucgagagcccguccagcaucuggguguucgcgggcgcccccgaccggugcccgccgaccugccuguucaucgccgggaucgccgagcugggcgccuucuucagcauccuccaggacaugcgcaacacgaucauggcguccaagaccgucgggaccagcgaggagaagcugcgcaagaaguccagcuucuaccaguccuaccugcggcgcacccagagcaugggcauccagcucgaccagcggaucaucgugcuguucaugguggccugggggaaggaggccgucgacgagcugcacuccggcgacggcgagcaccacgccagccgcacgcucgcgcagucccugaucgacgugaaggugaaggagaucagcaaccaggagccccugaagcucuga

SEQ ID NO: 6339 - RNA, 1290 nt, Artificial Sequence
  derived and/or modified CDS sequence (opt1) from HTNV(CA10081206)__HQ834503.1__N
auggccaccaucgaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgccagcauccaggcgaagaucgacgagcucaagcggcagcuggccgaccgcaucgccacgggcaagaaccuggggaaggagcaggaccccaccggcguggagcccggggaccaccucaaggagcgguccaugcugagcuacggcaacguccuggaccucaaccaccuggacaucgacgagcccaccggccagaccgccgacuggcuguccaucgugaucuaccucacgagcuucgugguccccauccugcugaaggcgcucuacaugcugaccacccgcgggcggcagaccacgaaggacaacaagggcacccgcauccgguucaaggacgacuccagcuucgaggacgugaacgggauccgcaagccgaagcaccuguacgugucccuccccaacgcccagagcuccaugaaggccgaggagaucacccccggccgguaccgcaccgccaucugcgggcuguaccccgcccagaucaaggcgcggcagaugaucagcccggucauguccgugaucggcuuccuggcccucgccaaggacuggagcgaccgcaucgagcaguggcuguccgagcccugcaagcugcuccccgacacggccgccgugagccugcacggcgggcccgcgaccaaccgggacuaccugcgccagcggcaggucgcccucggcaacauggagaccaaggaguccaaggccauccgccagcacgccgagagcgccgggugcuccaugguggaggacaucgagagcccguccagcaucuggguguucgcgggcgcccccgaccggugcccgccgaccugccuguucaucgccggcaucgccgagcugggggccuucuucagcauccuccaggacaugcgcaacacgaucauggcguccaagaccgucggcaccagcgaggagaagcugcgcaagaaguccagcuucuaccaguccuaccugcggcgcacccagagcauggggauccagcucgaccagcggaucaucgugcuguucaugguggccuggggcaaggaggccgucgacaacuuccacgccugggacgggauggaccccgagcugcgcacgcucgcgcagucccugaucgacgugaaggugaaggagaucagcaaccaggagccccugaagcucuga

SEQ ID NO: 6340 - RNA, 1290 nt, Artificial Sequence
  derived and/or modified CDS sequence (opt1) from HTNV(CA10081708)__HQ834504.1__N
augcccaccagcggcgagcugcagcgcgagaucaacgcccacgaggggcagcucgugaucgcccggcagaagguccgcgacgcggagaagcaguacgagaaggaccccgacgagcugaacaagcgggcccugaccgaccgcgagggcguggccgccuccauccaggccaagaucgacgagcucaagcggcagcuggcggaccgcaucgccacggggaagaaccugggcaaggagcaggaccccaccgggguggagcccggcgaccaccucaaggagcggagcaugcuguccuacggcaacguccuggaccucaaccaccuggacaucgacgagcccaccgggcagaccgccgacuggcugagcaucgugaucuaccucacguccuucguggucccgauccugcugaaggcccucuacaugcugaccacccgcggccggcagaccacgaaggacaacaaggggacccgcauccgguucaaggacgacagcuccuucgaggacgugaacggcauccgcaagcccaagcaccuguacgugagccuccccaacgcgcaguccagcaugaaggccgaggagaucacccccgggcgguaccgcaccgccaucuucgagcuguacccggcccagaucaaggcccggaagaugaucucccccgucaugagcgugaucggcuuccuggcgcucgccaaggacugguccgaccgcaucgagcaguggcugagcgagcccugcaagcugcuccccgacacggccgccgugucccugcacggcgggccggccaccaaccgggacuaccugcgccagcggcaggucgcgcucggcaacauggagaccaaggagagcaaggccauccgccagcacgccgaguccgccgggugcagcaugguggaggacaucgagucccccagcagcaucuggguguucgccggcgcgcccgaccggugcccgccgaccugccuguucaucgccggcaucgccgagcugggggccuucuucuccauccuccaggacaugcgcaacacgaucauggccagcaagaccgucggcaccuccgaggagaagcugcgcaagaaguccagcuucuaccagagcuaccugcggcgcacccaguccauggggauccagcucgaccagcggaucaucgugcuguucaugguggcguggggcaaggaggccgucgacaacccccacacgggggacgacgccgaccccgagcugcgcacccucgcccagagccugaucgacgugaaggugaaggagaucuccaaccaggagccccugaagcucuga

SEQ ID NO: 6341 - RNA, 1290 nt, Artificial Sequence
  derived and/or modified CDS sequence (opt1) from HTNV(CA10081905)__HQ834505.1__N
auggccaccagcggcgagcugcagcgcgagaucaacgcccacgaggggcagcucgugaucgcgcggcagaagguccgcgacgccgagaagcaguacgagaaggaccccgacgagcugaacaagcgggcccugaccgaccgcgagggcguggccgccuccauccaggcgaagaucgacgagcucaagcggcagcuggccgaccgcaucgccacggggaagaaccugggcaaggagcaggaccccaccgggguggagcccggcgaccaccucaaggagcggagcaugcuguccuacggcaacguccuggaccucaaccaccuggacaucgacgagcccaccgggcagaccgccgacuggcugagcaucgugaucuaccucacguccuucgugguccccauccugcugaaggcgcucuacaugcugaccacccgcggccggcagaccacgaaggacaacaaggggacccgcauccgguucaaggacgacagcuccuucgaggacgugaacggcauccgcaagccgaagcaccuguacgugagccuccccaacgcccaguccagcaugaaggccgaggagaucacccccgggcgguaccgcaccgccaucuucgagcuguaccccgcccagaucaaggcgcggaagaugaucuccccggucaugagcgugaucggcuuccuggcccucgccaaggacugguccgaccgcaucgagcaguggcugagcgagcccugcaagcugcuccccgacacggccgccgugucccugcacggcgggcccgcgaccaaccgggacuaccugcgccagcggcaggucgcccucggcaacauggagaccaaggagagcaaggccauccgccagcacgccgaguccgccgggugcagcaugguggaggacaucgaguccccgagcagcaucuggguguucgcgggcgcccccgaccggugcccgccgaccugccuguucaucgccggcaucgccgagcugggggccuucuucuccauccuccaggacaugcgcaacacgaucauggcgagcaagaccgucggcaccuccgaggagaagcugcgcaagaaguccagcuucuaccagagcuaccugcggcgcacccaguccauggggauccagcucgaccagcggaucaucgugcuguucaugguggccuggggcaaggaggccgucgacaaccaccaccugaucaacgccggggaccacgagcuccgcacgcuggcgcagagccugaucgacgugaaggugaaggagaucuccaaccaggagccccucaagcuguga

SEQ ID NO: 6342 - RNA, 1290 nt, Artificial Sequence
  derived and/or modified CDS sequence (opt1) from HTNV(E142)__AF288644.1__N
auggccaccauggaggagcugcagcgcgagaucaacgcccacgagggccagcucgugaucgcgcggcagaagguccgcgacgccgagaagcgguacgagaaggaccccgacgagcugaacaagcgcacccugacggaccgggaggggguggccgccagcauccaggccaagaucgacgagcucaagcgccagcuggcggaccggaucgccaccggcaagaaccuggggaaggagcaggacccgaccggcguggagcccggggaccaccucaaggagcgcuccaugcugagcuacggcaacguccuggaccucaaccaccuggacaucgacgagcccaccggccagacggccgacuggcuguccaucgugaucuaccucaccagcuucgugguccccauccugcugaaggcccucuacaugcugaccacccgggggcgccagacgaccaaggacaacaagggcacccggauccgcuucaaggacgacuccagcuccgaggacgugaacgggauccggaagccgaagcaccuguacgugagccuccccaacgcgcaguccagcaugaaggccgaggagaucacccccggccgcuaccggacggccaucugcgggcuguaccccgcccagaucaaggcccgccagaugaucuccccggucaugagcgugaucggcuuccuggcgcucgccaaggacugguccgaccggaucgagcaguggcugagcgagcccugcaagcugcuccccgacaccgccgccgugucccugcacggcgggcccgccaccaaccgcgacuaccugcggcagcgccaggucgcgcucggcaacauggagaccaaggagagcaaggccauccggcagcacgccgaguccgccgggugcagcaugaucgaggacaucgaguccccgagcagcaucuggguguucgccggcgcgcccgaccgcugcccgcccacgugccuguucaucgccggcaucgccgagcugggggccuucuucuccauccuccaggacaugcgcaacaccaucauggccagcaagaccgugggcaccuccgaggagaagcugcggaagaaguccagcuucuaccagagcuaccugcgccggacgcaguccauggggauccagcucgaccagcgcaucaucguccuguucaugguggcguggggcaaggagguggucgacaacuuccaccugggggacgacauggaccccgagcuccggacccuggcccagagccugaucgacgugaaggugaaggagaucuccaaccaggagccccucaagcuguga

SEQ ID NO: 6343 - RNA, 1290 nt, Artificial Sequence
  derived and/or modified CDS sequence (opt1) from HTNV(H10150)__HQ834506.1__N
auggccaccaugggcgagcugcagcgcgagaucaacgcccacgaggggcagcucgugaucgcgcggcagaagguccgcgacgccgagaagcaguacgagaaggaccccgacgagcugaacaagcgggcccugaccgaccgcgagggcguggccgccagcauccaggcgaagaucgacgagcucaagcggcagcuggccgaccgcaucgccacggggaagaaccugggcaaggagcaggaccccaccgggguggagcccggcgaccaccucaaggagcgguccaugcugagcuacggcaacguccuggaccucaaccaccuggacaucgacgagcccaccgggcagaccgccgacuggcuguccaucgugaucuaccucacgagcuucgugguccccauccugcugaaggcgcucuacaugcugaccacccgcggccggcagaccacgaaggacaacaaggggacccgcauccgguucaaggacgacuccagcuucgaggacgugaacggcauccgcaagccgaagcaccuguacgugucccuccccaacgcccagagcuccaugaaggccgaggagaucacccccgggcgguaccgcaccgccaucuucggccuguaccccgcccagaucaaggcgcggcagaugaucagcccggucauguccgugaucggcuuccuggcccucgccaaggacuggagcgaccgcaucgagcaguggcuguccgagcccugcaagcugcuccccgacacggccgccgugagccugcacgggggccccgcgaccaaccgggacuaccugcgccagcggcaggucgcccucgggaacauggagaccaaggaguccaaggccauccgccagcacgccgagagcgccggcugcuccaugguggaggacaucgagagcccguccagcaucuggguguucgcgggcgcccccgaccggugcccgccgaccugccuguucaucgccgggaucgccgagcugggcgccuucuucagcauccuccaggacaugcgcaacacgaucauggcguccaagaccgucgggaccagcgaggagaagcugcgcaagaaguccagcuucuaccaguccuaccugcggcgcacccagagcaugggcauccagcucgaccagcggaucaucgugcuguucaugguggccugggggaaggaggccgucgacaaccaccacugggccaacgcgaucggcuccgagcugcgcacgcucgcccagagccugaucgacgugaaggugaaggagaucuccaaccaggagccccugaagcucuga

SEQ ID NO: 6344 - RNA, 1290 nt, Artificial Sequence
  derived and/or modified CDS sequence (opt1) from HTNV(Aa03-161)__KT935024.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggcggcagaccacgaaggacaacaagggcacccgcauccgguucaaggacgacuccagcuucgaggacgucaacgggauccgcaagccgaagcaccuguacgugucccuccccaacgcgcagagcuccaugaaggccgaggagaucacccccggccgguaccgcaccgccgugugcgggcuguaccccgcccagaucaaggcccggcagaugaucagcccggucauguccgugaucggcuuccuggcgcucgccaaggacuggagcgaccgcaucgagcaguggcuguccgagcccugcaagcugcuccccgacgccgccgccgugagccugcugggcgggcccgcgacgaaccgggacuaccuccgccagcggcaggucgcccugggcaacauggagaccaaggaguccaaggccauccgccagcacgccgaggccgcggggugcagcaugaucgaggacaucgaguccccgagcuccaucuggguguucgccggcgcccccgaccggugcccgccgaccugccuguucaucgccggcaucgccgagcucggggcguucuucagcauccugcaggacaugcgcaacaccaucauggccagcaagacggugggcaccuccgaggagaagcugcgcaagaaguccagcuucuaccagagcuaccuccggcgcacccaguccauggggauccagcuggaccagcggaucaucguccuguucaugguggccuggggcaaggaggccguggacaacuuccaccucggggacgacauggaccccgagcugcgcacccuggcgcagagccucaucgacgucaaggugaaggagaucuccaaccaggagccccugaagcuguga

SEQ ID NO: 6345 - RNA, 1290 nt, Artificial Sequence
  derived and/or modified CDS sequence (opt1) from HTNV(Aa04-722)__KU207190.1__N
auggccaccauggaggagcugcagcgcgagaucaacgcccacgagggccagcucgugaucgcgcggcagaagguccgcgacgccgagcggcaguacgagaaggaccccgacgagcugaacaagcgcgcccugaccgaccgggaggggguggccgugagcauccaggccaagaucgacgagcucaagcgccagcuggcggaccggaucgccacgggcaagaaccuggggaaggagcaggaccccaccggcgucgagcccggggaccaccucaaggagcgcuccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgggggcgccagaccacgaaggacaacaagggcacccggauccgcuucaaggacgacuccagcuucgaggacgucaacgggauccggaagccgaagcaccuguacgugucccuccccaacgcgcagagcuccaugaaggccgaggagaucacccccggccgcuaccggaccgccgugugcgggcuguaccccgcccagaucaaggcccgccagaugaucagcccggucauguccgugaucggcuuccuggcgcucgccaaggacuggagcgaccggaucgagcaguggcuguccgagcccugcaagcugcuccccgacacggccgccgugagccugcugggcgggcccgccaccaaccgcgacuaccuccggcagcgccaggucgcgcugggcaacauggagaccaaggaguccaaggccauccggcagcacgccgaggccgccgggugcagcaugaucgaggacaucgaguccccgagcuccaucuggguguucgcgggcgcccccgaccgcugcccgccgaccugccuguucaucgccggcaucgccgagcucggggccuucuucagcauccugcaggacaugcgcaacacgaucauggcgagcaagaccgugggcaccuccgaggagaagcugcggaagaaguccagcuucuaccagagcuaccuccgccggacccaguccauggggauccagcuggaccagcgcaucaucguccuguucaugguggccuggggcaaggaggccguggacaacuuccaccucggggacgacauggaccccgagcugcggacgcuggcccagagccucaucgacgucaaggugaaggagaucuccaaccaggagccccugaagcuguga

SEQ ID NO: 6346 - RNA, 1290 nt, Artificial Sequence
  derived and/or modified CDS sequence (opt1) from HTNV(Aa05-190)__KT935027.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggcggcagaccacgaaggacaacaagggcacccgcauccgguucaaggacgacuccagcuucgaggacgucaacgggauccgcaagccgaagcaccuguacgugucccuccccaacgcgcagagcuccaugaaggccgaggagaucacccccggccgguaccgcaccgccgugugcgggcuguaccccgcccagaucaaggcccggcagaugaucagcccggucauguccgugaucggcuuccuggcgcucgccaaggacuggagcgaccgcaucgagcaguggcuguccgagcccugcaagcugcuccccgacacggccgccgugagccugcugggcgggcccgccaccaaccgggacuaccuccgccagcggcaggucgcgcugggcaacauggagaccaaggaguccaaggccauccgccagcacgccgaggccgccgggugcagcaugaucgaggacaucgaguccccgagcuccaucuggguguucgcgggcgcccccgaccggugcccgccgaccugccuguucaucgccggcaucgccgagcucggggccuucuucagcauccugcaggacaugcgcaacacgaucauggcgagcaagaccgugggcaccuccgaggagaagcugcgcaagaaguccagcuucuaccagagcuaccuccggcgcacccaguccauggggauccagcuggaccagcggaucaucguccuguucaugguggccuggggcaaggaggccguggacaacuuccaccucggggacgacauggaccccgagcugcgcacgcuggcccagagccucaucgacgucaaggugaaggagaucuccaaccaggagccccugaagcuguga

SEQ ID NO: 6347 - RNA, 1290 nt, Artificial Sequence
  derived and/or modified CDS sequence (opt1) from HTNV(Aa10-123)__KT935036.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggacccgaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggcggcagaccacgaaggacaacaagggcacccgcauccgguucaaggacgacuccagcuucgaggacgucaacgggauccgcaagccgaagcaccuguacgugucccuccccaacgcgcagagcuccaugaaggccgaggagaucacccccggccgguaccgcaccgccgugugcgggcuguaccccgcccagaucaaggcccggcagaugaucagcccggucauguccgugaucggcuuccuggcgcucgccaaggacuggagcgaccgcaucgagcaguggcuguccgagcccugcaagcugcuccccgacacgaccgccgugagccugcugggcgggcccgccaccaaccgggacuaccuccgccagcggcaggucgcccugggcaacauggagaccaaggaguccaaggcgauccgccagcacgccgaggccgccgggugcagcaugaucgaggacaucgaguccccgagcuccaucuggguguucgccggcgcgcccgaccggugcccgcccacgugccuguucguggccggcaucgccgagcucggggccuucuucagcauccugcaggacaugcgcaacaccaucauggccagcaagaccgucggcaccuccgaggagaagcugcgcaagaaguccagcuucuaccagagcuaccuccggcgcacgcaguccauggggauccagcuggaccagcggaucaucgugcuguucaugguggcguggggcaaggaggccgucgacaacuuccaccucggggacgacauggaccccgagcugcgcacccuggcccagagccucaucgacgugaaggugaaggagaucuccaaccaggagccccugaagcuguga

SEQ ID NO: 6348 - RNA, 1290 nt, Artificial Sequence
  derived and/or modified CDS sequence (opt1) from HTNV(Aa10-265)__KU207194.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggcggcagaccacgaaggacaacaagggcacccgcauccgguucaaggacgacuccagcuucgaggacgucaacgggauccgcaagccgaagcaccuguacgugucccuccccaacgcgcagagcuccaugaaggccgaggagaucacccccggccgguaccgcaccgccgugugcgggcuguaccccgcccagaucaaggcccggcagaugaucagcccggucauguccgugaucggcuuccuggcgcucgccaaggacuggagcgaccgcaucgagcaguggcuguccgagcccugcaagcugcuccccgacacggccgccgugagccugcugggcgggcccgccaccaaccgggacuaccuccgccagcggcaggucgcgcugggcaacauggagaccaaggaguccaaggccauccgccagcacgccgaggccgccgggugcagcaugaucgaggacaucgaguccccgagcuccaucuggguguucgcgggcgcccccgaccggugcccgccgaccugccuguucguggccggcaucgccgagcucggggccuucuucagcauccugcaggacaugcgcaacacgaucauggcgagcaagaccgucggcaccuccgaggagaagcugcgcaagaaguccagcuucuaccagagcuaccuccggcgcacccaguccauggggauccagcuggaccagcggaucaucgugcuguucaugguggccuggggcaaggaggccgucgacaacuuccaccucggggacgacauggaccccgagcugcgcacgcuggcccagagccucaucgacgugaaggugaaggagaucuccaaccaggagccccugaagcuguga

SEQ ID NO: 6349 - RNA, 1290 nt, Artificial Sequence
  derived and/or modified CDS sequence (opt1) from HTNV(AA1028)__AF427318.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggcggcagaccacgaaggacaacaagggcacccgcauccgguucaaggacgacuccagcuucgaggacgucaacgggauccgcaagccgaagcaccuguacgugucccuccccaacgcgcagagcuccaugaaggccgaggagaucacccccggccgguaccgcaccgccaucugcgggcuguaccccgcccagaucaaggcccggcagaugaucagcccggugauguccgucaucggcuuccuggcgcucgccaaggacuggagcgaccgcaucgagcaguggcuguccgagcccugcaagcugcuccccgacacggccgccgugagccugcugggcgggcccgccaccaaccgggacuaccuccgccagcgccagguggcgcugggcaacauggagaccaaggaguccaaggccauccggcagcacgccgaggccgccgggugcagcaugaucgaggacaucgaguccccgagcuccaucugggucuucgcgggcgcccccgaccggugcccgccgaccugccuguucaucgccggcaucgccgagcucggggccuucuucagcauccugcaggacaugcgcaacacgaucauggcgagcaagaccgugggcaccuccgaggagaagcugcgcaagaaguccagcuucuaccagagcuaccuccggcgcacccaguccauggggauccagcuggaccagcggaucaucgugcuguucauggucgccuggggcaaggaggccguggacaacuuccaccucggggacgacauggaccccgagcugcgcacgcuggcccagagccucaucgacgugaaggucaaggagaucuccaaccaggagccccugaagcuguga

SEQ ID NO: 6350 - RNA, 1290 nt, Artificial Sequence
  derived and/or modified CDS sequence (opt1) from HTNV(Aa10-434)__KT935038.1__N
auggccaccauggaggagcugcagcgcgagaucaacgcccacgagggccagcucgugaucgcgcggcagaagguccgcgacgccgagaagcaguacgggaaggaccccgacgagcugaacaagcgggcccugaccgaccgcgagggcguggccgugagcauccaggccaagaucgacgagcucaagcggcagcuggcggaccgcaucgccacggggaagaaccugggcaaggagcaggaccccaccggggucgagcccggcgaccaccucaaggagcgguccaugcugagcuacggcaacgugcuggaccucaaccaccuggacaucgacgagcccaccgggcagaccgccgacuggcuguccaucguggucuaccucacgagcuucguggugcccauccugcugaaggcccucuacaugcugaccacccgcggccggcagaccacgaaggacaacaaggggacccgcauccgguucaaggacgacuccagcuucgaggacgucaacggcauccgcaagccgaagcaccuguacgugucccuccccaacgcgcagagcuccaugaaggccgaggagaucacccccgggcgguaccgcaccgccgugugcggccuguaccccgcccagaucaaggcccggcagaugaucagcccggucauguccgugaucggcuuccuggcgcucgccaaggacuggagcgaccgcaucgagcaguggcuguccgagcccugcaagcugcuccccgacacggccgccgugagccugcucgggggccccgccaccaaccgggacuaccugcgccagcggcaggucgcgcuggggaacauggagaccaaggaguccaaggccauccgccagcacgccgaggccgccggcugcagcaugaucgaggacaucgaguccccgagcuccaucuggguguucgcgggcgcccccgaccggugcccgccgaccugccuguucaucgccgggaucgccgagcucggcgccuucuucagcauccugcaggacaugcgcaacacgaucauggcgagcaagaccguggggaccuccgaggagaagcugcgcaagaaguccagcuucuaccagagcuaccuccggcgcacccaguccaugggcauccagcuggaccagcggaucaucguccuguucaugguggccugggggaaggaggccguggacaacuuccaccucggcgacgacauggaccccgagcugcgcacgcuggcccagagccucaucgacgucaaggugaaggagaucuccaaccaggagccccugaagcuguga

SEQ ID NO: 6351 - RNA, 1290 nt, Artificial Sequence
  derived and/or modified CDS sequence (opt1) from HTNV(Aa14-362)__KT935049.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggcggcagaccacgaaggacaacaagggcacccgcauccgguucaaggacgacuccagcuucgaggacgucaacgggauccgcaagccgaagcaccuguacgugucccuccccaacgcgcagagcuccaugaaggccgaggagaucacccccggccgguaccgcaccgccgugugcgggcuguaccccgcccagaucaaggcccggcagaugaucagcccggucauguccgugaucggcuuccuggcgcucgccaaggacuggagcgaccgcguggagcaguggcuguccgagcccugcaagcugcuccccgacacggccgccgucagccugcugggcgggcccgccaccaaccgggacuaccuccgccagcgccagguggcgcugggcaacauggagaccaaggaguccaaggccauccggcagcacgccgaggccgccgggugcagcaugaucgaggacaucgaguccccgagcuccaucuggguguucgcgggcgcccccgaccggugcccgccgaccugccuguucaucgccggcaucgccgagcucggggccuucuucagcauccugcaggacaugcgcaacacgaucauggcgagcaagaccgucggcaccuccgaggagaagcugcgcaagaaguccagcuucuaccagagcuaccuccggcgcacccaguccauggggauccagcuggaccagcggaucaucgugcuguucaugguggccuggggcaaggaggccgucgacaacuuccaccucggggacgacauggaccccgagcugcgcacgcuggcccagagccucaucgacgugaaggugaaggagaucuccaaccaggagccccugaagcuguga

SEQ ID NO: 6352 - RNA, 1290 nt, Artificial Sequence
  derived and/or modified CDS sequence (opt1) from HTNV(Aa14-404)__KT935052.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggcggcagaccacgaaggacaacaagggcacccgcauccgguucaaggacgacuccagcuucgaggacgucaacgggauccgcaagccgaagcaccuguacgugucccuccccaacgcgcagagcuccaugaaggccgaggagaucacccccggccgguaccgcaccgccgugugcgggcuguaccccgcccagaucaaggcccggcagaugaucagcccggucauguccgugaucggcuuccuggcgcucgccaaggacuggagcgaccgcaucgagcaguggcuguccgagcccugcaagcugcuccccgacacggccgccgugagccugcugggcgggcccgccaccaaccgggacuaccuccgccagcggcaggucgcgcugggcaacauggagaccaaggaguccaaggccauccgccagcacgccgaggccgccgggugcagcaugaucgaggacaucgaguccccgagcuccaucuggguguucgcgggcgcccccgaccggugcccgccgaccugccuguucaucgccggcaucgccgagcucggggccuucuucagcauccugcaggacaugcgcaacacgaucauggcgagcaagaccgugggcaccuccgaggagaagcugcgcaagaaguccagcuucuaccagagcuaccuccggcgcacccaguccauggggauccagcuggaccagcggaucaucguccuguucaugguggccuggggcaaggaggccguggacaacuuccaccucggggacgacauggaccccgagcugcgcacgcuggcccagagccucaucgacgucaaggugaaggagaucuccagccaggagccccugaagcuguga

SEQ ID NO: 6353 - RNA, 1290 nt, Artificial Sequence
  derived and/or modified CDS sequence (opt1) from HTNV(Aa15-56)__KU207195.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggcggcagaccacgaaggacaacaagggcacccgcauccgguucaaggacgacuccagcuucgaggacgucaacgggauccgcaagccgaagcaccuguacgugucccuccccaacgcgcagagcuccaugaaggccgaggagaucacccccggccgguaccgcaccgccgugugcgggcuguaccccgcccagaucaaggcccggcagaugaucagcccggucauguccgugaucggcuuccuggcgcucgccaaggacuggagcgaccgcaucgagcaguggcugaacgagcccugcaagcugcuccccgacacggccgccgugucccugcugggcgggcccgccaccaaccgggacuaccuccgccagcggcaggucgcgcugggcaacauggagaccaaggagagcaaggccauccgccagcacgccgaggccgccgggugcuccaugaucgaggacaucgagagcccguccagcaucuggguguucgcgggcgcccccgaccggugcccgccgaccugccuguucaucgccggcaucgccgagcucggggccuucuucuccauccugcaggacaugcgcaacacgaucauggcgagcaagaccgugggcaccagcgaggagaagcugcgcaagaaguccagcuucuaccaguccuaccuccggcgcacccagagcauggggauccagcuggaccagcggaucaucguccuguucaugguggccuggggcaaggaggccguggacaacuuccaccucggggacgacauggaccccgagcugcgcacgcuggcccagucccucaucgacgucaaggugaaggagaucagcaaccaggagccccugaagcuguga

SEQ ID NO: 6354 - RNA, 1290 nt, Artificial Sequence
  derived and/or modified CDS sequence (opt1) from HTNV(AA1719)__AF427319.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggcggcagaccacgaaggacaacaagggcacccgcauccgguucaaggacgacuccagcuucgaggacgucaacgggauccgcaagccgaagcaccuguacgugucccuccccaacgcgcagagcuccaugaaggccgaggagaucacccccggccgguaccgcaccgccaucugcgggcuguaccccgcccagaucaaggcccggcagaugaucagcccggugauguccgucaucggcuuccuggcgcucgccaaggacuggagcgaccgcaucgagcaguggcuguccgagcccugcaagcugcuccccgacacggccgccgugagccugcugggcgggcccgccaccaaccgggacuaccuccgccagcgccagguggcgcugggcaacauggagaccaaggaguccaaggccauccggcagcacgccgaggccgccgggugcagcaucaucgaggacaucgaguccccgagcuccaucugggucuucgcgggcgcccccgaccggugcccgccgaccugccuguucaucgccggcaucgccgagcucggggccuucuucagcauccugcaggacaugcgcaacacgaucauggcgagcaagaccgugggcaccuccgaggagaagcugcgcaagaaguccagcuucuaccagagcuaccuccggcgcacccaguccauggggauccagcuggaccagcggaucaucgugcuguucauggucgccuggggcaaggaggccguggacaacuuccaccucggggacgacauggaccccgagcugcgcacgcuggcccagagccucaucgacgugaaggucaaggagaucuccaaccaggagccccugaagcuguga

SEQ ID NO: 6355 - RNA, 1290 nt, Artificial Sequence
  derived and/or modified CDS sequence (opt1) from HTNV(AP1168)__AF427323.1__N
auggccaccauggaggagcugcagaaggagaucaacgcccacgagggccagcucgugaucgcgcgccagaagguccgggacgccgagcgccaguacgagaaggaccccgacgagcugaacaagcgggcccugaccgaccgcgaggggguggccgccagcauccaggcgaagaucgacgagcucaagcggcagcuggccgaccgcaucgccacgggcaagaaccuggggaaggagcaggacccgaccggcguggagcccggggaccaccucaaggagcgguccaugcugagcuacggcaacguccuggaccucaaccaccuggacaucgacgagcccaccggccagaccgccgacuggcuguccaucgugguguaccucacgagcuucgucgugcccauccugcugaaggcgcucuacaugcugaccacccgcgggcggcagaccacgaaggacaacaagggcacccgcauccgguucaaggacgacuccagcuucgaggacgugaacgggauccgcaagccgaagcaccuguacgucucccuccccaacgcccagagcuccaugaaggccgaggagaucacccccggccgguaccgcaccgccaucugcgggcuguaccccgcccagaucaaggcgcggcagauggugagcccggugauguccgucaucggcuuccuggcccucgccaaggacuggggcgaccgcaucgagcaguggcugagcgagcccugcaagcugcuccccgacacggccgccgugucccugcacgggggccccgcgaccaaccgggacuaccugcgccagcggcaggccgcccucgggaacauggagaccaaggagagcaaggccauccgccagcacgccgagaccgcgggcugcuccaugaucgaggacaucgagagcccguccagcaucuggguguucgccggcgcccccgaccggugcccgcccacgugccuguucaucgccgggaucgccgagcugggcgcguucuucuccauccuccaggacaugcgcaacaccaucauggccagcaagaccgucgggaccagcgaggagaagcugcgcaagaaguccagcuucuaccaguccuaccugcggcgcacgcagagcaugggcauccagcucgaccagcggaucaucgugcuguucaugguggccugggggaaggaggccgucgacaacuuccaccugggcgacgacauggaccccgagcuccgcacccuggcgcagucccugaucgaccucaaggugaaggagaucagcaaccaggagccccugaagcuguga

SEQ ID NO: 6356 - RNA, 1290 nt, Artificial Sequence
  derived and/or modified CDS sequence (opt1) from HTNV(AP708)__AF427322.1__N
auggccaccauggaggagcugcagaaggagaucaacgcccacgagggccagcucgugaucgcgcgccagaagguccgggacgccgagcgccaguacgagaaggaccccgacgagcugaacaagcgggcccugaccgaccgcgaggggguggccgccagcauccaggcgaagaucgacgagcucaagcggcagcuggccgaccgcaucgccacgggcaagaaccuggggaaggagcaggacccgaccggcguggagcccggggaccaccucaaggagcgguccaugcugagcuacggcaacguccuggaccucaaccaccuggacaucgacgagcccaccggccagaccgccgacuggcuguccaucgugguguaccucacgagcuucgucgugcccauccugcugaaggcgcucuacaugcugaccacccgcgggcggcagaccacgaaggacaacaagggcacccgcauccgguucaaggacgacuccagcuucgaggacgugaacgggauccgcaagccgaagcaccuguacgucucccuccccaacgcccagagcuccaugaaggccgaggagaucacccccggccgguaccgcaccgccaucugcgggcuguaccccgcccagaucaaggcgcggcagauggugagcccggugauguccgucaucggcuuccuggcccucgccaaggacuggggcgaccgcaucgagcaguggcugagcgagcccugcaagcugcuccccgacacggccgccgugucccugcacgggggccccgcgaccaaccgggacuaccugcgccagcggcaggccgcccucgggaacauggagaccaaggagagcaaggccauccgccagcacgccgagaccgcgggcugcuccaugaucgaggacaucgagagcccguccagcgugugggucuucgccggcgcccccgaccggugcccgcccacgugccuguucaucgccgggaucgccgagcugggcgcguucuucuccauccuccaggacaugcgcaacaccaucauggccagcaagaccguggggaccagcgaggagaagcugcgcaagaaguccagcuucuaccaguccuaccugcggcgcacgcagagcaugggcauccagcucgaccagcggaucaucgugcuguucauggucgccugggggaaggaggccguggacaacuuccaccugggcgacgacauggaccccgagcuccgcacccuggcgcagucccugaucgaccucaaggugaaggagaucagcaaccaggagccccugaagcuguga

SEQ ID NO: 6357 - RNA, 1290 nt, Artificial Sequence
  derived and/or modified CDS sequence (opt1) from HTNV(DandongHu-32)__KC570386.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggcggcagaccacgaaggacaacaagggcacccgcauccgguucaaggacgacuccagcuucgaggacgucaacgggauccgcaagccgaagcaccuguacgugucccuccccaacgcgcagagcuccaugaaggccgaggagaucacccccggccgguaccgcaccgccaucugcgggcuguaccccgcccagaucaaggcccggcagaugaucagcccggugauguccgucaucggcuuccuggcgcucgccaaggacuggagcgaccgcaucgagcaguggcuguccgagcccugcaagcugcuccccgacacggccgccgugagccugcugggcgggcccgccaccaaccgggacuaccuccgccagcgccagguggcgcugggcaacauggagaccaaggaguccaaggccauccggcagcacgccgaggccgccgggugcagcaugaucgaggacaucgaguccccgagcuccaucugggucuucgcgggcgcccccgaccggugcccgccgaccugccuguucaucgccggcaucgccgagcucggggccuucuucagcauccugcaggacaugcgcaacacgaucauggcgagcaagaccgugggcaccuccgaggagaagcugcgcaagaaguccagcuucuaccagagcuaccuccggcgcacccaguccauggggauccagcuggaccagcggaucaucgugcuguucauggucgccuggggcaaggaggccguggacaacuuccaccucggggacgacauggaccccgagcugcgcauccuggcccagagccucaucgacgugaaggucaaggagaucuccaaccaggagccccugaagcuguga

SEQ ID NO: 6358 - RNA, 1290 nt, Artificial Sequence
  derived and/or modified CDS sequence (opt1) from HTNV(DandongHu-34)__KC570387.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggcggcagaccacgaaggacaacaagggcacccgcauccgguucaaggacgacuccagcuucgaggacgucaacgggauccgcaagccgaagcaccuguacgugucccuccccaacgcgcagagcuccaugaaggccgaggagaucacccccggccgguaccgcaccgccaucugcgggcuguaccccgcccagaucaaggcccggcagaugaucagcccggugauguccgucaucggcuuccuggcgcucgccaaggacuggagcgaccgcaucgagcaguggcuguccgagcccugcaagcugcuccccgacacggccgccgugagccugcugggcgggcccgccaccaaccgggacuaccuccgccagcgccagguggcgcugggcaacauggagaccaaggaguccaaggccauccggcagcacgccgaggccgccgggugcagcaugaucgaggacaucgaguccccgagcuccaucugggucuucgcgggcgcccccgaccggugcccgccgaccugccuguucaucgccggcauggccgagcucggggccuucuucagcauccugcaggacaugcgcaacacgaucauggcgagcaagaccgugggcaccuccgaggagaagcugcgcaagaaguccagcuucuaccagagcuaccuccggcgcacccaguccauggggauccagcuggaccagcggaucaucgugcuguucauggucgccuggggcaaggaggccguggacaacuuccaccucggggacgacauggaccccgagcugcgcacgcuggcccagagccucaucgacgugaaggucaaggagaucuccaaccaggagccccugaagcuguga

SEQ ID NO: 6359 - RNA, 1290 nt, Artificial Sequence
  derived and/or modified CDS sequence (opt1) from HTNV(DandongHu-89)__KC570389.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggcggcagaccacgaaggacaacaagggcacccgcauccgguucaaggacgacuccagcuucgaggacgucaacgggauccgcaagccgaagcaccugugcgugucccuccccaacgcgcagagcuccaugaaggccgaggagaucacccccggccgguaccgcaccgccaucugcgggcuguaccccgcccagaucaaggcccggcagaugaucagcccggugauguccgucaucggcuuccuggcgcucgccaaggacuggagcgaccgcaucgagcaguggcuguccgagcccugcaagcugcuccccgacacggccgccgugagccugcugggcgggcccgccaccaaccgggacuaccuccgccagcgccagguggcgcugggcaacauggagaccaaggaguccaaggccauccggcagcacgccgaggccgccgggugcagcaugaucgaggacaucgaguccccgagcuccaucugggucuucgcgggcgcccccgaccggugcccgccgaccugccuguucaucgccggcaucgccgagcucggggccuucuucagcauccugcaggacaugcgcaacacgaucauggcgagcaagaccgugggcaccuccgaggagaagcugcgcaagaaguccagcuucuaccagagcuaccuccggcgcacccaguccauggggauccagcuggaccagcggaucaucgugcuguucauggucgccuggggcaaggaggccguggacaacuuccaccucggggacgacauggaccccgagcugcgcacgcuggcccagagccucaucgacgugaaggucaaggagaucuccaaccaggagccccugaagcuguga

SEQ ID NO: 6360 - RNA, 1290 nt, Artificial Sequence
  derived and/or modified CDS sequence (opt1) from HTNV(DandongHu-91)__KC570390.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuggggaucgugaucuaccucacguccuucgucgugcccauccugcugaaggcccucuacaugcugaccacccgcggccggcagaccacgaaggacaacaaggggacccgcauccgguucaaggacgacagcuccuucgaggacgugaacggcauccgcaagccgaagcaccuguacgucagccuccccaacgcgcaguccagcaugaaggccgaggagaucacccccgggcgguaccgcaccgccaucugcggccuguaccccgcccagaucaaggcccggcagaugaucuccccggugaugagcgugaucggcuuccuggcgcucgccaaggacugguccgaccgcaucgagcaguggcugagcgagcccugcaagcugcuccccgacacggccgccgucucccugcucgggggccccgccaccaaccgggacuaccugcgccagcgccagguggcgcuggggaacauggagaccaaggagagcaaggccauccggcagcacgccgaggccgccggcugcuccaugaucgaggacaucgagagcccguccagcaucuggguguucgcgggcgcccccgaccggugcccgccgaccugccuguucaucgccgggauggccgagcucggcgccuucuucuccauccugcaggacaugcgcaacacgaucauggcgagcaagaccgucgggaccagcgaggagaagcugcgcaagaaguccagcuucuaccaguccuaccuccggcgcacccagagcaugggcauccagcuggaccagcggaucaucgugcuguucaugguggccugggggaaggaggccgucgacaacuuccaccucggcgacgacauggaccccgagcugcgcacgcuggcccagucccucaucgacgugaaggugaaggagaucagcaaccaggagccccugaagcuguga

SEQ ID NO: 6361 - RNA, 1290 nt, Artificial Sequence
  derived and/or modified CDS sequence (opt1) from HTNV(Fuyuan-Aa-145)__KJ857349.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggcggcagaccacgaaggacaacaagggcacccgcauccgguucaaggacgacuccagcuucgaggacgucaacgggauccgcaagccgaagcaccuguacgugucccuccccaacgcgcagagcuccaugaaggccgaggagaucacccccggccgguaccgcaccgccaucugcgggcugcaccccgcccagaucaaggcccggcagaugaucagcccggugauguccgucaucggcuuccuggcgcucgccaaggacuggagcgaccgcaucgagcaguggcuguccgagcccugcaagcugcuccccgacacggccgccgugagccugcugggcgggcccgccaccaaccgggacuaccuccgccagcgccagguggcgcugggcaacauggagaccaaggaguccaaggccauccggcagcacgccgaggccgccgggugcagcaugaucgaggacaucgaguccccgagcuccaucugggucuucgcgggcgcccccgaccggugcccgccgaccugccuguucaucgccggcaucgccgagcucggggccuucuucagcauccugcaggacaugcgcaacacgaucauggcgagcaagaccgugggcaccuccgaggagaagcugcgcaagaaguccagcuucuaccagagcuaccuccggcgcacccaguccauggggauccagcuggaccagcggaucaucgugcuguucauggucgccuggggcaaggaggccguggacaacuuccaccucggggacgacauggaccccgagcugcgcacgcuggcccagagccucaucgacgugaaggucaaggagaucuccaaccaggagccccugaagcuguga

SEQ ID NO: 6362 - RNA, 1290 nt, Artificial Sequence
  derived and/or modified CDS sequence (opt1) from HTNV(Fuyuan-Aa-26)__KJ857347.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucgccgugcccauccugcugaaggcgcucuacaugcugaccacccgcgggcggcagaccacgaaggacaacaagggcacccgcauccgguucaaggacgacuccagccuggaggacgugaacgggauccgcaagccgaagcaccucuacgucucccugcccaacgcccagagcuccaugaaggccgaggagaucacccccggccgguaccgcaccgccaucugcgggcuguaccccgcccagaucaaggcgcggcagaugaucagcccggugauguccgugaucggcuuccucgcccuggccaaggacuggagcgaccgcaucgagcaguggcuguccgagcccugcaagcuccugcccgacacggccgccgucagccugcucggcgggcccgcgaccaaccgggacuaccugcgccagcgccagguggcccugggcaacauggagaccaaggaguccaaggccauccggcagcacgccgaggccgcggggugcagcaugaucgaggacaucgaguccccgagcuccaucuggguguucgccggcgcccccgaccggugcccgccgaccugccccuucaucgccggcaucgccgagcucggggcguucuucagcauccugcaggacaugcgcaacacgaucauggccagcaagaccgucggcaccuccgaggagaagcugcgcaagaaguccagcuucuaccagagcuaccuccggcgcacccaguccauggggauccagcuggaccagcggaucaucgugcuguucaugguggccuggggcaaggaggccgucgacaacuuccaccucggggacgacauggaccccgagcugcgcacgcuggcgcagagccucaucgacgugaaggugaaggagaucuccaaccaggagccccugaagcuguga

SEQ ID NO: 6363 - RNA, 1290 nt, Artificial Sequence
  derived and/or modified CDS sequence (opt1) from HTNV(JS1)__KP970572.1__N
auggccaccauggaggagcugcagcgcgagaucaacgcccacgagggccagcucgugaucgcgcggcagaagguccgcgacgccgagaagcaguacgagaacgaccccgacgagcugaacaagcgggcccugaccaaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucaucguguaccucacgagcuucgucgugcccauccugcugaaggcccucuacaugcugaccacccgcgggcggcagaccacgaaggacaacaagggcacccgcauccgguucaaggacgacuccagcuucgaggacgugaacgggauccgcaagccgaagcaccuguacgucucccuccccaacgcgcagagcuccaugaaggccgaggagaucacccccggccgguaccgcaccgccgugugcgggcuguaccccgcccagaucaaggcccggcagaugaucagcccggugauguccgucaucggcuuccuggcgcucgccaaggacuggagcgaccgcaucgagcaguggcugaucgagcccugcaagcugcuccccgacacggccgccgugucccugcugggcgggcccgccaccaaccgggacuaccuccgccagcgccagguggcgcugggcaacauggagaccaaggagagcaaggccauccggcagcacgccgaggccgccgggugcuccaugaucgaggacaucgagagcccguccagcaucugggucuucgcgggcgcccccgaccggugcccgccgaccugccuguucaucgccggcaucgccgagcucggggccuucuucuccauccugcaggacaugcgcaacacgaucauggcgagcaagaccgugggcaccagcgaggagaagcugcgcaagaaguccagcuucuaccaguccuaccuccggcgcacccagagcauggggauccagcuggaccagcggaucaucgugcuguucauggucgccuggggcaaggaggccguggacaacuuccaccucggggacgacauggaccccgagcugcgcacgcuggcccagucccucaucgacgugaaggucaaggagaucagcaaccaggagccccugaagcuguga

SEQ ID NO: 6364 - RNA, 1290 nt, Artificial Sequence
  derived and/or modified CDS sequence (opt1) from HTNV(LongquanAa-08-150)__JQ912697.1__N
auggccaccauggaggagcugcagcgcgagaucgacgcccacgagggccagcucgugaucgcgcggcagaagguccgcgacgccgagaagcaguacgagaaggaccccgacgagcugaacaagcgggcccugaccgaccgcgaggggguggccgccagcauccaggcgaagaucgacgagcucaagcggcagcuggccgaccgcaucgccacgggcaagaaccuggggaaggagcaggacccgaccggcguggagcccggggaccaccucaaggagcgguccaugcugagcuacggcaacguccuggaccucaaccaccuggacaucgacgagcccaccggccagaccgccgacuggcuguccaucgugguguaccucacgagcuucgucgugcccauccugcugaaggcgcucuacaugcugaccacccgcgggcggcagaccacgaaggacaacaagggcacccgcauccgguucaaggacgacuccagcuucgaggacgugaacgggauccgcaagccgaagcaccuguacgucucccuccccaacgcccagagcuccaugaaggccgaggagaucacccccggccgguaccgcaccgccaucugcgggcuguaccccgcccagaucaaggcgcggcagaugaucagcccggugauguccgugaucggcuuccuggcccucgccaaggacugggccgaccgcaucgagcaguggcugagcgagcccugcaagcugcuccccgacacggccgcggucucccugcacggcgggcccgccaccaaccgggacuaccugcgccagcgccagguggcccucggcaacauggagaccaaggagagcaaggccauccggcagcacgccgagaccgcggggugcuccaugaucgaggacaucgagagcccguccagcaucuggguguucgccggcgcccccgaccggugcccgcccacgugccuguucaucgccggcaucgccgagcugggggcguucuucuccauccuccaggacaugcgcaacaccaucauggccagcaagaccgucggcaccagcgaggagaagcugcgcaagaaguccagcuucuaccaguccuaccugcggcgcacgcagagcauggggauccagcucgaccagcggaucaucgugcuguucaugguggccuggggcaaggaggccgucgacaacuuccaccugggggacgacauggaccccgagcuccgcacccuggcgcagucccugaucgacgugaaggugaaggagaucagcaaccaggagccccucaagcuguga

SEQ ID NO: 6365 - RNA, 1290 nt, Artificial Sequence
  derived and/or modified CDS sequence (opt1) from HTNV(LongquanAa-08-157)__JQ912698.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgccagcauccaggcgaagaucgacgagcucaagcggcagcuggccgaccgcaucgccacgggcaagaaccuggggaaggagcaggacccgaccggcguggagcccggggaccaccucaaggagcgguccaugcugagcuacggcaacguccuggaccucaaccaccuggacaucgacgagcccaccggccagaccgccgacuggcuguccaucgugguguaccucacgagcuucgucgugcccauccugcugaaggcgcucuacaugcugaccacccgcgggcggcagaccacgaaggacaacaagggcacccgcauccgguucaaggacgacuccagcuucgaggacgugaacgggauccgcaagccgaagcaccuguacgucucccuccccaacgcccagagcuccaugaaggccgaggagaucacccccggccgguaccgcaccgccaucugcgggcuguaccccgcccagaucaaggcgcggcagaugaucagcccggugauguccgugaucggcuuccuggcccucgccaaggacugggccgaccgcaucgagcaguggcugagcgagcccugcaagcugcuccccgacacggccgcggucucccugcacggcgggcccgccaccaaccgggacuaccugcgccagcgccagguggcccucggcaacauggagaccaaggagagcaaggccauccggcagcacgccgagaccgcggggugcuccaugaucgaggacaucgagagcccguccagcaucuggguguucgccggcgcccccgaccggugcccgcccacgugccuguucaucgccggcaucgccgagcugggggcguucuucuccauccuccaggacaugcgcaacaccaucauggccagcaagaccgucggcaccagcgaggagaagcugcgcaagaaguccagcuucuaccaguccuaccugcggcgcacgcagagcauggggauccagcucgaccagcggaucaucgugcuguucaugguggccuggggcaaggaggccgucgacaacuuccaccugggggacgacauggaccccgagcuccgcacccuggcgcagucccugaucgacgugaaggugaaggagaucagcaaccaggagccccucaagcuguga

SEQ ID NO: 6366 - RNA, 1290 nt, Artificial Sequence
  derived and/or modified CDS sequence (opt1) from HTNV(LongquanAa-08-314)__JQ912709.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgccagcaugcaggcgaagaucgacgagcucaagcggcagcuggccgaccgcaucgccacgggcaagaaccuggggaaggagcaggacccgaccggcguggagcccggggaccaccucaaggagcgguccaugcugagcuacggcaacguccuggaccucaaccaccuggacaucgacgagcccaccggccagaccgccgacuggcuguccaucgugguguaccucacgagcuucgucgugcccauccugcugaaggcgcucuacaugcugaccacccgcgggcggcagaccacgaaggacaacaagggcacccgcauccgguucaaggacgacuccagcuucgaggacgugaacgggauccgcaagccgaagcaccuguacgucucccuccccaacgcccagagcuccaugaaggccgaggagaucacccccggccgguaccgcaccgccaucugcgggcuguaccccgcccagaucaaggcgcggcagaugaucagcccggugauguccgugaucggcuuccuggcccucgccaaggacugggccgaccgcaucgagcaguggcugagcgagcccugcaagcugcuccccgacacggccgcggucucccugcacggcgggcccgccaccaaccgggacuaccugcgccagcgccagguggcccucggcaacauggagaccaaggagagcaaggccauccggcagcacgccgagaccgcggggugcuccaugaucgaggacaucgagagcccguccagcaucuggguguucgccggcgcccccgaccggugcccgcccacgugccuguucaucgccggcaucgccgagcugggggcguucuucuccauccuccaggacaugcgcaacaccaucauggccagcaagaccgucggcaccagcgaggagaagcugcgcaagaaguccagcuucuaccaguccuaccugcggcgcacgcagagcauggggauccagcucgaccagcggaucaucgugcuguucaugguggccuggggcaaggaggccgucgacaacuuccaccugggggacgacauggaccccgagcuccgcacccuggcgcagucccugaucgacgugaaggugaaggagaucagcaaccaggagccccucaagcuguga

SEQ ID NO: 6367 - RNA, 1290 nt, Artificial Sequence
  derived and/or modified CDS sequence (opt1) from HTNV(LongquanAa-08-573)__JQ912714.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgccagcauccaggcgaagaucgacgagcucaagcggcagcuggccgaccgcaucgccacgggcaagaaccuggggaaggagcaggacccgaccggcguggagcccggggaccaccucaaggagcgguccaugcugagcuacggcaacguccuggaccucaaccaccuggacaucgacgagcccaccggccagaccgccgacuggcuguccaucgugguguaccucacgagcuucgucgugcccauccugcugaaggcgcucuacaugcugaccacccgcgggcggcagaccacgaaggacaacaagggcacccgcauccgguucaaggacgacuccagcuucgaggacgugaacgggauccgcaagccgaagcaccuguacgucucccuccccaacgcccagagcuccaugaaggccgaggagaucacccccggccgguaccgcaccgccaucugcgggcuguaccccgcccagaucaaggcgcggcagaugaucagcccggugauguccgugaucggcuuccuggcccucgccaaggacugggccgaccgcaucgagcaguggcugagcgagcccugcaagcugcuccccgacacggccgcggucucccugcacggcgggcccgccaccaaccgggacuaccugcgccagcgccagguggcccucggcaacauggagaccaaggagagcaaggccauccggcagcacgccgcgaccgccgggugcuccaugaucgaggacaucgagagcccguccagcaucuggguguucgccggcgcccccgaccggugcccgcccacgugccuguucaucgccggcaucgcggagcugggggccuucuucuccauccuccaggacaugcgcaacaccaucauggccagcaagaccgucggcaccagcgaggagaagcugcgcaagaaguccagcuucuaccaguccuaccugcggcgcacgcagagcauggggauccagcucgaccagcggaucaucgugcuguucaugguggccuggggcaaggaggcggucgacaacuuccaccugggggacgacauggaccccgagcuccgcacccuggcccagucccugaucgacgugaaggugaaggagaucagcaaccaggagccccucaagcuguga

SEQ ID NO: 6368 - RNA, 1290 nt, Artificial Sequence
  derived and/or modified CDS sequence (opt1) from HTNV(LongquanAa-09-113)__JQ912716.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgccagcauccaggcgaagaucgacgagcucaagcggcagcuggccgaccgcaucgccacgggcaagaaccuggggaaggagcaggaccccaccggcguggagcccggggaccaccucaaggagcgguccaugcugagcuacggcaacguccuggaccucaaccaccuggacaucgacgagcccaccggccagaccgccgacuggcuguccaucgugguguaccucacgagcuucgucgugcccauccugcugaaggcgcucuacaugcugaccacccgcgggcggcagaccacgaaggacaacaagggcacccgcauccgguucaaggacgacuccagcuucgaggacgugaacgggacccgcaagccgaagcaccuguacgucucccuccccaacgcccagagcuccaugaaggccgaggagaucacccccggccgguaccgcacggccaucugcgggcuguaccccgcccagaucaaggcgcggcagaugaucagcccggugauguccgugaucggcuuccuggcccucgccaaggacugggccgaccgcaucgagcaguggcugagcgagcccugcaagcugcuccccgacaccgccgcggucucccugcacggcgggcccgccaccaaccgggacuaccugcgccagcgccagguggcccucggcaacauggagaccaaggagagcaaggccauccggcagcacgccgagacggcggggugcuccaugaucgaggacaucgagagcccguccagcaucuggguguucgccggcgcccccgaccggugcccgccgaccugccuguucaucgccggcaucgccgagcugggggcguucuucuccauccuccaggacaugcgcaacaccaucauggccagcaagaccgucggcacgagcgaggagaagcugcgcaagaaguccagcuucuaccaguccuaccugcggcgcacccagagcauggggauccagcucgaccagcggaucaucgugcuguucaugguggccuggggcaaggaggccgucgacaacuuccaccugggggacgacauggaccccgagcuccgcacccuggcgcagucccugaucgacgugaaggugaaggagaucagcaaccaggagccccucaagcuguga

SEQ ID NO: 6369 - RNA, 1290 nt, Artificial Sequence
  derived and/or modified CDS sequence (opt1) from HTNV(LongquanAa-09-191)__JQ912719.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgccagcauccaggcgaagaucgacgagcucaagcggcagcuggccgaccgcaucgccacgggcaagaaccuggggaaggagcaggaccccaccggcguggagcccggggaccaccucaaggagcgguccaugcugagcuacggcaacguccuggaccucaaccaccuggacaucgacgagcccaccggccagaccgccgacuggcuguccaucgugguguaccucacgagcuucgucgugcccauccugcugaaggcgcucuacaugcugaccacccgcgggcggcagaccaucaaggacaacaagggcacgcgcauccgguucaaggacgacuccagcuucgaggacgugaacgggauccgcaagccgaagcaccuguacgucucccuccccaacgcccagagcuccaugaaggccgaggagaucacccccggccgguaccgcaccgccaucugcgggcuguaccccgcccagaucaaggcgcggcagaugaucagcccggugauguccgugaucggcuuccuggcccucgccaaggacugggccgaccgcaucgagcaguggcugagcgagcccugcaagcugcuccccgacaccgccgcggucucccugcacggcgggcccgccacgaaccgggacuaccugcgccagcgccagguggcccucggcaacauggagaccaaggagagcaaggccauccggcagcacgccgagaccgcggggugcuccaugaucgaggacaucgagagcccguccagcaucuggguguucgccggcgcccccgaccggugcccgccgaccugccuguucaucgccggcaucgccgagcugggggcguucuucuccauccuccaggacaugcgcaacacgaucauggccagcaagaccgucggcaccagcgaggagaagcugcgcaagaaguccagcuucuaccaguccuaccugcggcgcacccagagcauggggauccagcucgaccagcggaucaucgugcuguucaugguggccuggggcaaggaggccgucgacaacuuccaccugggggacgacauggaccccgagcuccgcacgcuggcgcagucccugaucgacgugaaggugaaggagaucagcaaccaggagccccucaagcuguga

SEQ ID NO: 6370 - RNA, 1290 nt, Artificial Sequence
  derived and/or modified CDS sequence (opt1) from HTNV(LongquanAa-09-192)__JQ912720.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgccagcaugcagggcaagaucgacgagcucaagcggcagcuggcggaccgcaucgccacggggaagaaccugggcaaggagcaggacccgaccgggguggagcccggcgaccaccucaaggagcgguccaugcugagcuacggcaacguccuggaccucaaccaccuggacaucgacgagcccaccgggcagaccgccgacuggcuguccaucgugguguaccucacgagcuucgucgugcccauccugcugaaggcccucuacaugcugaccacccgcggccggcagaccacgaaggacaacaaggggacccgcauccgguucaaggacgacuccagcuucgaggacgugaacggcauccgcaagccgaagcaccuguacgucucccuccccaacgcgcagagcuccaugaaggccgaggagaucacccccgggcgguaccgcaccgccaucugcggccuguaccccgcccagaucaaggcccggcagaugaucagcccggugauguccgugaucggcuuccuggcgcucgccaaggacugggccgaccgcaucgagcaguggcugagcgagcccugcaagcugcuccccgacacggccgccgucucccugcacgggggccccgcgaccaaccgggacuaccugcgccagcgccagguggcccucgggaacauggagaccaaggagagcaaggccauccggcagcacgccgagaccgccggcugcuccaugaucgaggacaucgagagcccguccagcaucuggguguucgcgggcgcccccgaccggugcccgcccacgugccuguucaucgccgggaucgccgagcugggcgccuucuucuccauccuccaggacaugcgcaacaccaucauggcgagcaagaccgucgggaccagcgaggagaagcugcgcaagaaguccagcuucuaccaguccuaccugcggcgcacgcagagcaugggcauccagcucgaccagcggaucaucgugcuguucaugguggccugggggaaggaggccgucgacaacuuccaccugggcgacgacauggaccccgagcuccgcacccuggcccagucccugaucgacgugaaggugaaggagaucagcaaccaggagccccucaagcuguga

SEQ ID NO: 6371 - RNA, 1290 nt, Artificial Sequence
  derived and/or modified CDS sequence (opt1) from HTNV(LongquanAa-10-46)__JQ912754.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgccagcauccaggcgaagaucgacgagcucaagcggcagcuggccgaccgcaucgccacgggcaagaaccuggggaaggagcaggacccgaccggcguggagcccggggaccaccucaaggagcgguccaugcugagcuacggcaacguccuggaccucaaccaccuggacaucgacgagcccaccggccagaccgccgacuggcuguccaucgugguguaccucacgagcuucgucgugcccauccugcugaaggcgcucuacaugcugaccacccgcgggcggcagaccacgaaggacaacaagggcacccgcauccgguucaaggacgacuccagcuucgaggacgugaacgggauccgcaagccggagcaccuguacgucucccuccccaacgcccagagcuccaugaaggccgaggagaucacccccggccgguaccgcaccgccaucugcgggcuguaccccgcccagaucaaggcgcggcagaugaucagcccggugauguccgugaucggcuuccuggcccucgccaaggacugggccgaccgcaucgagcaguggcugagcgagcccugcaagcugcuccccgacacggccgcggucucccugcacggcgggcccgccaccaaccgggacuaccugcgccagcgccagguggcccucggcaacauggagaccaaggagagcaaggccauccggcagcacgccgagaccgcggggugcuccaugaucgaggacaucgagagcccguccagcaucuggguguucgccggcgcccccgaccggugcccgcccacgugccuguucaucgccggcaucgccgagcugggggcguucuucuccauccuccaggacaugcgcaacaccaucauggccagcaagaccgucggcaccagcgaggagaagcugcgcaagaaguccagcuucuaccaguccuaccugcggcgcacgcagagcauggggauccagcucgaccagcggaucaucgugcuguucaugguggccuggggcaaggaggccgucgacaacuuccaccugggggacgacauggaccccgagcuccgcacccuggcgcagucccugaucgacgugaaggugaaggagaucagcaaccaggagccccucaagcuguga

SEQ ID NO: 6372 - RNA, 1290 nt, Artificial Sequence
  derived and/or modified CDS sequence (opt1) from HTNV(LongquanAa-11-745)__KC344237.1__N
auggccaccauggaggagcugcagaaggagaucaacgcccacgagggccagcucgugaucgcgcgccagaagguccgggacgccgagaagcaguacgagaaggaccccgacgagcugaacaagcgcgcccugaccgaccgggaggggguggccgccagcauccaggcgaagaucgacgagcucaagcgccagcuggccgaccggaucgccacgggcaagaaccuggggaaggagcaggacccgaccggcguggagcccggggaccaccucaaggagcgcuccaugcugagcuacggcaacguccuggaccucaaccaccuggacaucgacgagcccaccggccagaccgccgacuggcuguccaucgugguguaccucacgagcuucgucgugcccauccugcugaaggcgcucuacaugcugaccacccgggggcgccagaccacgaaggacaacaagggcacccggauccgcuucaaggacgacuccagcuucgaggacgugaacgggauccggaagccgaagcaccuguacgucucccuccccaacgcccagagcuccaugaaggccgaggagaucacccccggccgcuaccggaccgccaucugcgggcuguaccccgcccagaucaaggcgcgccagaugaucagcccggugauguccgugaucggcuuccuggcccucgccaaggacugggccgaccggaucgagcaguggcugagcgagcccugcaagcugcuccccgacacggccgcggucucccugcacggcgggcccgccaccaaccgcgacuaccugcggcagcgccagguggcccucggcaacauggagaccaaggagagcaaggccauccggcagcacgccgagaccgcggggugcuccaugaucgaggacaucgagagcccguccagcaucuggguguucgccggcgcccccgaccgcugcccgcccacgugccuguucaucgccggcaucgccgagcugggggcguucuucuccauccuccaggacaugcggaacaccaucauggccagcaagaccgucggcaccagcgaggagaagcugcgcaagaaguccagcuucuaccaguccuaccugcgccggacgcagagcauggggauccagcucgaccagcgcaucaucgugcuguucaugguggccuggggcaaggaggccgucgacaacuuccaccugggggacgacauggaccccgagcuccggacccuggcgcagucccugaucgacgugaaggugaaggagaucagcaaccaggagccccucaagcuguga

SEQ ID NO: 6373 - RNA, 1290 nt, Artificial Sequence
  derived and/or modified CDS sequence (opt1) from HTNV(ROKA14-11)__KU207207.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggcggcagaccacgaaggacaacaagggcacccgcauccgguucaaggacgacuccagcuucgaggacgucaacgggauccgcaagccgaagcaccuguacgugucccuccccaacgcgcagagcuccaugaaggccgaggagaucacccccggccgguaccgcaccgccgugugcgggcuguaccccgcccagaucaaggcccggcagaugaucagcccggucauguccgugaucggcuuccuggcgcucgccaaggacuggagcgaccgcaucgagcaguggcuguccgagcccugcaagcugcuccccgacacggccgccgugagccugcugggcgggcccgccaccaaccgggacuaccuccgccagcggcaggucgcgcugggcaacauggagaccaaggaguccaaggccauccgccagcacgccgaggccgccgggugcagcaugaucgaggacaucgaguccccgagcuccaucuggguguucgcgggcgcccccgaccggugcccgccgaccugccuguucguggccggcaucgccgagcucggggccuucuucagcauccugcaggacaugcgcaacacgaucauggcgagcaagaccgucggcaccuccgaggagaagaugcgcaagaaguccagcuucuaccagagcuaccugcggcgcacccaguccauggggauccagcucgaccagcggaucaucgugcuguucaugguggccuggggcaaggaggccgucgacaacuuccaccugggggacgacauggaccccgagcuccgcacgcuggcccagagccugaucgacgugaaggugaaggagaucuccaaccaggagccccucaagcuguga

SEQ ID NO: 6374 - RNA, 1290 nt, Artificial Sequence
  derived and/or modified CDS sequence (opt1) from HTNV(US8A14-2)__KU207208.1__N
auggccaccauggaggagcugcagcgcgagaucaacgcccacgagggccagcucgugaucgcgcggcagaagguccgcgacgccgagaagcaggacgggaaggaccccgacgagcugaacaagcgggcccugaccgaccgcgagggcguggccgugagcauccaggccaagaucgacgagcucaagcggcagcuggcggaccgcaucgccacggggaagaaccugggcaaggagcaggaccccaccggggucgagcccggcgaccaccucaaggagcgguccaugcugagcuacggcaacgugcuggaccucaaccaccuggacaucgacgagcccaccgggcagaccgccgacuggcuguccaucguggucuaccucacgagcuucguggugcccauccugcugaaggcccucuacaugcugaccacccgcggccggcagaccacgaaggacaacaaggggacccgcauccgguucaaggacgacuccagcuucgaggacgucaacggcauccgcaagccgaagcaccuguacgugucccuccccaacgcgcagagcuccaugaaggccgaggagaucacccccgggcgguaccgcaccgccgugugcggccuguaccccgcccagaucaaggcccggcagaugaucagcccggucauguccgugaucggcuuccuggcgcucgccaaggacuggagcgaccgcaucgagcaguggcuguccgagcccugcaagcugcuccccgacacggccgccgugagccugcucgggggccccgccaccaaccgggacuaccugcgccagcggcaggucgcgcuggggaacauggagaccaaggaguccaaggccauccgccagcacgccgaggccgccggcugcagcaugaucgaggacaucgaguccccgagcuccaucuggguguucgcgggcgcccccgaccggugcccgccgaccugccuguucaucgccgggaucgccgagcucggcgccuucuucagcauccugcaggacaugcgcaacacgaucauggcgagcaagaccguggggaccuccgaggagaagcugcgcaagaaguccagcuucuaccagagcuaccuccggcgcacccaguccaugggcauccagcuggaccagcggaucaucguccuguucaugguggccugggggaaggaggccguggacaacuuccaccucggcgacgacauggaccccgagcugcgcacgcuggcccagagccucaucgacgucaaggugaaggagaucuccaaccaggagccccugaagcuguga

SEQ ID NO: 6375 - RNA, 1290 nt, Artificial Sequence
  derived and/or modified CDS sequence (opt1) from HTNV(US8A15-1)__KU207209.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggcggcagaccacgaaggacaacaagggcacccgcauccgguucaaggacgacuccagcuucgaggacgucaacgggauccgcaagccgaagcaccuguacgugucccuccccaacgcgcagagcuccaugaaggccgaggagaucacccccggccgguaccgcaccgccgugugcgggcuguaccccgcccagaucaaggcccggcagaugaucagcccggucauguccgugaucggcuuccuggcgcucgccaaggacuggagcgaccgcaucgagcaguggcuguccgagcccugcaagcugcuccccgacacggccgccgugagccugcugggcgggcccgccaccaaccgggacuaccuccgccagcggcaggucgcgcugggcaacauggagaccaaggaguccaaggccauccgccagcacgccgaggccgccgggugcagcaugaucgaggacaucgaguccccgagcuccaucuggguguucgcgggcgcccccgaccggugcccgccgaccugccuguucaucgccggcaucgccgagcucggggccuucuucagcauccugcaggacaugcgcaacacgaucauggcgagcaagaucgugggcaccuccgaggagaagcugcgcaagaaguccagcuucuaccagagcuaccuccggcgcacccaguccauggggauccagcuggaccagcggaucaucguccuguucaugguggccuggggcaaggaggccguggacaacuuccaccucggggacgacauggaccccgagcugcgcacccuggcccagagccucaucgacgucaaggugaaggagaucuccaaccaggagccccugaagcuguga

SEQ ID NO: 6376 - RNA, 1290 nt, Artificial Sequence
  derived and/or modified CDS sequence (opt1) from HTNV(YaluRiver13)__HQ611981.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggggccagaccacgaaggacaacaaggggacccggauccgcuucaaggacgacuccagcuucgaggacgucaacggcauccggaagccgaagcaccuguacgugucccuccccaacgcgcagagcuccaugaaggccgaggagaucacccccgggcgcuaccggaccgccaucugcggccuguaccccgcccagaucaaggcccgccagaugaucagcccggugauguccgucaucggcuuccuggcgcucgccaaggacuggagcgaccggaucgagcaguggcuguccgagcccugcaagcugcuccccgacacggccgccgugagccugcucgggggccccgccaccaaccgcgacuaccugcggcagcgccagguggcgcuggggaacauggagaccaaggaguccaaggccauccggcagcacgccgaggccgccggcugcagcaugaucgaggacaucgaguccccgagcuccaucugggucuucgcgggcgcccccgaccgcugcccgccgaccugccuguucaucgccagcaucggggagcucggcgccuucuucagcauccugcaggacaugcggaacacgaucauggccuccaagaccguggggaccagcgaggagaagcugcgcaagaaguccagcuucuaccaguccuaccuccgccggacccagagcaugggcauccagcuggaccagcgcaucaucgugcuguucauggucuccugggggaaggaggcgguggacaacuuccaccucggcgacgacauggaccccgagcugcggacgcuggcccagagccucaucgacgugaaggucaaggagauccccaaccaggagccccugaagcuguga

SEQ ID NO: 6377 - RNA, 1290 nt, Artificial Sequence
  derived and/or modified CDS sequence (opt1) from HTNV(84FLi)__AY017064.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgccagcauccaggccaagaucgacgagcucaagcggcagcuggcggaccgcaucgccaccggcaagaaccuggggaaggagcaggacccgaccggcguggagcccggggaccaccucaaggagcgguccaugcugagcuacggcaacguccuggaccucaacuaccuggacaucgacgagcccaccggccagacggccgacuggcuguccaucgugaucuaccucaccagcuucgugguccccauccugcugaaggcccucuacaugcugaccacccgcgggcggcagacgaccaaggacaacaagggcacccgcauccgguucaaggacgacuccagcuucgaggacgugaacgggauccgcaagccgaagcaccuguacgugucccuccccaacgcgcagagcuccaugaaggccgaggagaucacccccggccgguaccgcacggccaucugcgggcuguaccccgcccagaucaaggcccggcagaugaucagcccggucauguccgugaucggcuuccuggcgcucgccaaggacuggagcgaccgcaucgagcaguggcuguccgagcccugcaagcugcuccccgacaccgccgccgugagccugcacggcgggcccgccaccaaccgggacuaccugcgccagcggcaggucgcgcucggcaacauggagaccaaggaguccaaggccauccgccagcacgccgagagcgccgggugcuccaugaucgaggacaucgagagcccguccagcaucuggguguucgccggcgcgcccgaccggugcccgcccacgugccuguucaucgccggcaucgccgagcugggggccuucuucagcauccuccaggacaugcgcaacaccaucauggccuccaagaccgugggcaccagcgaggagaagcugcgcaagaaguccagcuucuaccaguccuaccugcggcgcacgcagagcauggggauccagcucgaccagcggaucaucguccuguucaugguggcguggggcaaggaggccguggacaacuuccaccugggggacgacauggaccccgagcuccgcacccuggcccagucccugaucgacgucaaggugaaggagaucagcaaccaggagccccucaagcuguga

SEQ ID NO: 6378 - RNA, 1290 nt, Artificial Sequence
  derived and/or modified CDS sequence (opt1) from HTNV(Bao14)__AB127998.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgugagcauccaggccaagaucgacgagcucaagcggcagcuggccgaccgcaucgcgaccggcaagaaccuggggaaggagcaggacccgaccggcgucgagcccggggaccaccucaaggagcgguccaugcugagcuacggcaacgugcuggaccucaaccaccuggacaucgacgagcccaccggccagacggccgacuggcuguccaucguggucuaccucaccagcuucguggugcccauccugcugaaggcccucuacaugcugaccacccgcgggcggcagacgaccaaggacaacaagggcacccgcauccgguucaaggacgacuccagcuucgaggacgucaacgggauccgcaagccgaagcaccuguacgugucccuccccaacgcccagagcuccaugaaggcggaggagaucacccccggccgguaccgcacggccaucugcgggcuguaccccgcccagaucaaggcccggcagaugaucagcccggugauguccgucaucggcuuccuggcccucgcgaaggacuggagcgaccgcaucgagcaguggcuguccgagcccugcaagcugcuccccgacaccgccgccgugagccugcugggcgggcccgccaccaaccgggacuaccuccgccagcgccagguggcccugggcaacauggagaccaaggaguccaaggcgauccggcagcacgccgaggccgccgggugcagcaugaucgaggacaucgaguccccgagcuccaucugggucuucgccggcgcgcccgaccggugcccgcccacgugccuguucaucgccggcaucgccgagcucggggccuucuucagcauccugcaggacaugcgcaacaccaucauggccagcaagaccgugggcaccuccgaggagaagcugcgcaagaaguccagcuucuaccagagcuaccuccggcgcacgcaguccauggggauccagcuggaccagcggaucaucgugcuguucauggucgcguggggcaaggaggccguggacaacuuccaccucggggacgacauggaccccgagcugcgcacccuggcccagagccucaucgacgugaaggucaaggagaucuccaaccaggagccccugaagcuguga

SEQ ID NO: 6379 - RNA, 1290 nt, Artificial Sequence
  derived and/or modified CDS sequence (opt1) from HTNV(Chen4)__AB027101.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgccagcauccaggccaagaucgacgagcucaagcggcagcuggcggaccgcaucgccaccggcaagaaccuggggaaggagcaggacccgaccggcguggagcccggggaccaccucaaggagcgguccaugcugagcuacggcaacguccuggaccucaaccaccuggacaucgacgagcccaccggccagacggccgacuggcuguccaucgugaucuaccucaccagcuucgugguccccauccugcugaaggcccucuacaugcugaccacccgcgggcggcagacgaccaaggacaacaagggcacccgcauccgguucaaggacgacuccagcuucgaggacgugaacgggauccgcaagccgaagcaccuguacgugucccuccccaacgcgcagagcuccaugaaggccgaggagaucacccccggccgguaccgcacggccaucugcgggcuguaccccgcccagaucaaggcccggcagaugaucagcccggucauguccgugaucggcuuccuggcgcucgccaaggacuggagcgaccgcaucgagcaguggcuguccgcccccugcaagcugcuccccgacaccgccgccgugagccugcacggcgggcccgcgaccaaccgggacaaccugcgccagcggcaggucgcccucggcaacauggagaccaaggaguccaaggccauccgccagcacgccgagagcgccgggugcuccaugaucgaggacaucgagagcccguccagcaucuggguguucgcgggcgcccccgaccggugcccgcccacgugccuguucaucgccggcaucgccgagcugggggccuucuucagcauccuccaggacaugcgcaacaccaucauggcguccaagaccgugggcaccagcgaggagaagcugcgcaagaaguccagcuucuaccaguccuaccugcggcgcacgcagagcauggggauccagcucgaccagcggaucaucguccuguucaugguggccuggggcaaggaggccguggacaacuuccgccugggggacgacauggaccccgagcuccggacccuggcccagucccugaucgacgucaaggugaaggagaucagcaaccaggagccccucaagcuguga

SEQ ID NO: 6380 - RNA, 1290 nt, Artificial Sequence
  derived and/or modified CDS sequence (opt1) from HTNV(Hu)__AB027111.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgccagcauccaggcgaagaucgacgagcucaagcggcagcuggccgaccgcaucgccacgggcaagaaccuggggaaggagcaggaccccaccggcguggagcccggggaccaccucaaggagcgguccaugcugagcuacggcaacguccuggaccucaaccaccuggacaucgacgagcccaccggccagaccgccgacuggcuguccaucgugaucuaccucacgagcuucgugguccccauccugcugaaggcgcucuacaugcugaccacccgcgggcggcagaccacgaaggacaacaagggcacccgcauccgguucaaggacgacuccagcuucgaggacgugaacgggauccgcaagccgaagcaccuguacgugucccuccccaacgcccagagcuccaugaaggccgaggagaucacccccggccgguaccgcaccgccaucugcgggcuguaccccgcccagaucaaggcgcggcagaugaucagcccggucauguccgugaucggcuuccuggcccucgccaaggacuggagcgaccgcaucgagcaguggcuguccgagcccugcaagcugcuccccgacacggccgccgugagccugcacggcgggcccgcgaccaaccgggacuaccugcgccagcggcaggucgcccucggcaacauggagaccaaggaguccaaggccauccgccagcacgccgaggccgcggggugcagcaugaucgaggacaucgaguccccgagcuccaucuggguguucgccggcgcccccgaccggagcccgccgaccugcauguucaucgccggcaucgacgagcugggggccuucuucagcauccugcaggacaugcgcaacacgaucauggcguccaagaccgugggcaccagcgaggagaagcuccgcaagaaguccagcuucuaccaguccuaccugcggcgcacccagagcauggggauccagcuggaccagcggaucaucguccucuucaugguggccuggggcaaggaggccguggacaacuuccaccugggggacgacauggaccccgagcugcgcacgcucgcccagucccugaucgacaucaaggucaaggagaucagcaaccaggagccccugaagcucuga

SEQ ID NO: 6381 - RNA, 1290 nt, Artificial Sequence
  derived and/or modified CDS sequence (opt1) from HTNV(HubeiHu02)__JQ665905.1__N
auggccaccauggaggagcugcagaaggagaucaacgcccacgagggccagcucgugaucgcgcgccagaagguccgggacgccgagaagcaguacgagaaggaccccgacgagcugaacaagcgcacccugacggaccgggaggggguggccgccagcauccaggccaagaucgacgagcucaagcgccagcuggcggaccggaucgccaccggcaagaaccuggggaaggagcaggacccgaccggcguggagcccggggaccaccucaaggagcgcuccaugcugagcuacggcaacguccuggaccucaaccaccuggacaucgacgagcccaccggccagacggccgacuggcuguccaucgugaucuaccucaccagcuucgugguccccauccugcugaaggcccucuacaugcugaccacccgggggcgccagacgaccaaggacaacaagggcacccggauccgcuucaaggacgacuccagcuucgaggacgugaacgggauccggaagccgaagcaccuguacgugucccuccccaacgcgcagagcuccaugaaggccgaggacaucacccccggccgcuaccggacggccaucugcgggcuguaccccgcccagaucaaggcccgccagaugaucagcccggucauguccgugaucggcuuccuggcgcucgccaaggacuggagcgaccggaucgagcaguggcuguccgagcccugcaagcugcuccccgacaccgccgccgugagccugcacggcgggcccgccaccaaccgcgacuaccugcggcagcgccaggucgcgcucggcaacauggagaccaaggaguccaaggccauccggcagcacgccgagagcgccgggugcuccaugaucgaggacaucgagagcccguccagcaucuggguguucgccggcgcgcccgaccgcugcccgcccacgugccuguucaucgccggcaucgccgagcugggggccuucuucagcauccuccaggacaugcggaacaccaucauggccuccaagaccgugggcaccagcgaggagaagcugcgcaagaaguccagcuucuaccaguccuaccugcgccggacgcagagcauggggauccagcucgaccagcgcaucaucguccuguucaugguggcguggggcaaggaggccguggacaacuuccaccugggggacgacauggaccccgagcuccggacccuggcccagucccugaucgacgucaaggugaaggagaucagcaaccaggagccccucaagcuguga

SEQ ID NO: 6382 - RNA, 1290 nt, Artificial Sequence
  derived and/or modified CDS sequence (opt1) from HTNV(HV004)__JQ083395.1__N
auggccaccauggaggagcugcagaaggagaucaacgcccacgagggccagcucgugaucgcgcgccagaagguccgggacgccgagaagcaguacgagaaggaccccgacgagcugaacaagcgcgcccugaccgaccgggaggggguggccgccagcauccaggcgaagaucgacgagcucaagcgccagcuggccgaccggaucgccacgggcaagaaccuggggaaggagcaggaccccaccggcguggagcccggggaccaccucaaggagcgcuccaugcugagcuacggcaacguccuggaccucaaccaccuggacaucgacgagcccaccggccagaccgccgacuggcuguccaucgugaucuaccucacgagcuucgugguccccauccugcugaaggcgcucuacaugcugaccacccgggggcgccagaccacgaaggacaacaagggcacccggauccgcuucaaggacgacuccagcuucgaggacgugaacgggauccggaagccgaagcaccuguacgugucccuccccaacgcccagagcuccaugaaggccgaggagaucacccccggccgcuaccggaccgccaucugcgggcuguaccccgcccagaucaaggcgcgccagaugaucagcccggucauguccgugaucggcuuccuggcccucgccaaggacuggagcgaccggaucgagcaguggcuguccgagcccugcaagcugcuccccgacacggccgccgugagccugcacggcgggcccgcgaccaaccgcgacuaccugcggcagcgccaggucgcccucggcaacauggagaccaaggaguccaaggccauccggcagcacgccgagagcgccgggugcuccaugaucgaggacaucgagagcccguccagcaucuggguguucgcgggcgcccccgaccgcugcccgccgaccugccuguucaucgccggcaucgccgagcugggggccuucuucagcauccuccaggacaugcggaacacgaucauggcguccaagaccgugggcaccagcgaggagaagcugcgcaagaaguccagcuucuaccaguccuaccugcgccggacccagagcauggggauccagcucgaccagcgcaucaucguccuguucaugguggccuggggcaaggaggccguggacaacuuccaccugggggacgacauggaccccgagcuccggacgcuggcccagucccugaucgacgucaaggugaaggagaucagcaaccaggagccccucaagcuguga

SEQ ID NO: 6383 - RNA, 1290 nt, Artificial Sequence
  derived and/or modified CDS sequence (opt1) from HTNV(Maaji-1)__AF321094.1__N
auggccaccauggaggagcugcagaaggagaucaacgcccacgagggccagcucgugaucgcgcgccagaagguccgggacgccgagcgccaguacgagaaggaccccgacgagcugaacaagcggacccugacggaccgcgaggggguggccgccagcauccaggccaagaucgacgagcucaagcggcagcuggcggaccgcaucgccaccggcaagaaccuggggaaggagcaggacccgaccggcguggagcccggggaccaccucaaggagcgguccaugcugagcuacggcaacguccuggaccucaaccaccuggacaucgacgagcccaccggccagacggccgacuggcuguccaucgugaucuaccucaccagcuucgugguccccauccugcugaaggcccucuacaugcugaccacccgcgggcggcagacgaccaaggacaacaagggcacccgcauccgguucaaggacgacuccagcuucgaggacgugaacgggauccgcaagccgaagcaccuguacgugucccuccccaacgcgcagagcuccaugaaggccgaggagaucacccccggccgguaccgcacggccgucugcgggcuguaccccgcccagaucaaggcccggcagaugaucagcccggugauguccgugaucggcuucauggcgcuggccaaggacuggagcgagcgcaucgagcaguggcucuccgagcccugcaagcugcugcccgacaccagcgccgucucccuccugggcgggcccgccaccaacaaggacuaccugcggcagcgccagguggcccucggcaacauggagaccaaggagagcaaggcgauccggcagcaggccgaggccuccgggugcagcaugaucgaggacaucgaguccccgagcagcaucuggguguucgccggcgcccccgaccgcugcccgcccacgugccuguucaucgcgggcauggccgagcugggggccuucuucuccauccuccaggacaugcggaacaccaucauggccagcaagaccgucggcaccuccgaggagaagcugcgcaagaaguccagcuucuaccagagcuaccugcgccggacgcaguccauggggauccagcucgaccagcgcaucaucgugcuguucaugguggccuggggcaaggaggcggucgacaacuuccaccugggggacgacauggaccccgagcuccggacccuggcccagagccugaucgacgugaaggugaaggagaucuccaaccaggagccccucaagcuguga

SEQ ID NO: 6384 - RNA, 1290 nt, Artificial Sequence
  derived and/or modified CDS sequence (opt1) from HTNV(Maaji-2)__AF321095.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgugagcauccaggccaagaucgacgagcucaagcggcagcuggccgaccgcaucgcgaccggcaagaacuucgggaaggagcaggacccgaccggcgucgagcccggggaccaccugaaggagcgguccaugcucagcuacggcaacgugcuggaccugaaccaccucgacaucgacgagcccaccggccagacggccgacuggcuguccaucguggucuaccugaccagcuucguggugcccauccuccugaaggcccuguacaugcucaccacccgcgggcggcagacgaccaaggacaacaagggcacccgcauccgguucaaggacgacuccagcuucgaggacgucaacgggauccgcaagccgaagcaccuguacgugucccugcccaacgcccagagcuccaugaaggcggaggagaucacccccggccgguaccgcacggccgugugcgggcucuaccccgcccagaucaaggcccggcagaugaucagcccggucauguccgugaucggcuuccuggcccuggcgaaggacuggagcgaccgcaucgagcaguggcucuccgagcccugcaagcugcugcccgacaccgccgccgugagccuccugggcgggcccgccaccaaccgggacuaccugcgccagcggcaggucgcccucggcaacauggagaccaaggaguccaaggcgauccgccagcacgccgaggccgccgggugcagcaugaucgaggacaucgaguccccgagcuccaucuggguguucgccggcgcgcccgaccggugcccgcccacgugccuguucaucgccggcaucgccgagcugggggccuucuucagcauccuccaggacaugcgcaacaccaucauggccagcaagaccgugggcaccuccgaggagaagcugcgcaagaaguccagcuucuaccagagcuaccugcggcgcacgcagcucauggggauccagcuggaccagcggaucaucguccuguucaugguggcguggggcaaggaggccguggacaacuuccaccucggggacgacauggaccccgagcugcgcacccuggcccagucccucaucgacgucaaggugaaggagaucagcaaccaggagccccugaagcuguga

SEQ ID NO: 6385 - RNA, 1290 nt, Artificial Sequence
  derived and/or modified CDS sequence (opt1) from HTNV(N8)__DQ658415.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgccagcauccaggccaagaucgacgagcucaagcggcagcuggcggaccgcaucgccaccggcaagaaccuggggaaggagcaggacccgaccggcguggagcccggggaccaccucaaggagcgguccaugcugagcuacggcaacguccuggaccucaaccaccuggacaucgacgagcccaccggccagacggccgacuggcuguccaucgugaucuaccucaccagcuucgugguccccauccugcugaaggcccucuacaugcugaccacccgcgggcggcagacgaccaaggacaacaagggcacccgcauccgguucaaggacgacuccagcuucgaggacgugaacgggauccgcaagccgaagcaccuguaccucucccugcccaacgcgcagagcuccaugaaggccgaggagaucacccccggccgguaccgcacggccaucugcgggcuguaccccgcccagaucaaggcccggcagaugaucagcccggugauguccgucaucggcuuccucgcgcuggccaaggacuggagcgaccgcaucgagcaguggcuguccgagcccugcaagcuccugcccgacgccgccgccgugagccugcacggcgggcccgcgaccaaccgggacuaccuccgccagcgccagguggcccugggcaacauggagaccaaggaguccaaggccauccggcagcacgccgagaccgccgggugcagcaugaucgacgacaucgaguccccgagcuccaucugggucuucgcgggcgcccccgaccggugcccgcccacgugccuguucaucgccggcaucgccgagcucggggccuucuucagcauccugcaggacaugcgcaacaccaucauggcgagcaagaccgugggcaccuccgaggagaagcugcgcaagaaguccagcuucuaccagagcuaccuccggcgcacgcaguccauggggauccagcuggaccagcggaucaucgugcuguucauggucgccuggggcaaggaggccguggacaacuuccaccucggggacgacauggaccccgagcugcgcacccuggcccagagccucaucgacgugaaggucaaggagaucuccaaccaggagccccugaagcuguga

SEQ ID NO: 6386 - RNA, 1290 nt, Artificial Sequence
  derived and/or modified CDS sequence (opt1) from HTNV(Q32)__AB027097.1__N
auggccaccauggaggagcugcagcgcgagaucaacgcccacgagggccagcucgugaucgcgcggcugaagguccgcgacgccgagaagcccuacgagaaggacccggacgagcugaacaugcggacccucacggaccgcgaggggguggccgccagcauccaggccaagaucgacgagcugaagcggcagcuggcggaccgcaucgccaccggcaagaaccucgggaaggagcaggaccccaccggcguggagcccggggaccaccugaaggagcgguccaugcugagcuacggcaacguccucgaccugaaccaccuggacaucgacgagcccaccggccagacggccgacuggcucuccaucgugaucuaccugaccagcuucguggucccgauccugcucaaggcccuguacaugcugaccacccgcgggcggcagacgaccaaggacaacaagggcacccgcauccgguucaaggacgacuccagcuucgaggacgugaacgggauccgcaagcccaagcaccucuacgugucccugcccaacgcgcagagcuccaugaaggccgaggagaucacccccggccgguaccgcacggccaucugcgggcuguacccggcccagaucaaggcccggcagaugaucagccccgucauguccgugaucggcuuccucgcgcuggccaaggacuggagcgaccgcaucgagcaguggcuguccgagcccugcaagcuccugcccgacaccgccgccgugagccugcacggcgggccggccaccaaccgggacuaccuccgccagcggcaggucgcgcugggcaacauggagaccaaggaguccaaggccauccgccagcacgccgagagcgccgggugcuccaugguggaggacaucgagagccccuccagcaucuggguguucgccggcgcgcccgaccggugcccgcccacgugccuguucaucgccggcaucgccgagcucggggccuucuucagcauccugcaggacaugcgcaacaccaucauggccuccaagaccgucggcaccagcgaggagaagcugcgcaagaaguccagcuucuaccaguccuaccuccggcgcacgcagagcauggggauccagcuggaccagcggaucaucgugcuguucaugguggcguggggcaaggaggccgucgacaacuuccagcccggggacgacauggaccccgagcuccgcacccuggcccagucccugaucgacgugaaggugaaggagaucagcaaccaggagccccucaagcuguga

SEQ ID NO: 6387 - RNA, 1290 nt, Artificial Sequence
  derived and/or modified CDS sequence (opt1) from HTNV(SXHu2012B1)__KC844226.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgccagcauccaggcgaagaucgacgagcucaagcggcagcuggccgaccgcaucgccacgggcaagaaccuggggaaggagcaggaccccaccggcguggagcccggggaccaccucaaggagcgguccaugcugagcuacggcaacguccuggaccucaaccaccuggacaucgacgagcccaccggccagaccgccgacuggcuguccaucgugaucuaccucacgagcuucgugguccccauccugcugaaggcgcucuacaugcugaccacccgcgggcggcagaccacgaaggacaacaagggcacccgcauccgguucaaggacgacuccagcuucgaggacgugaacgggauccgcaagccgaagcaccuguacgugucccuccccaacgcccagagcuccaugaaggccgaggagaucacccccggccgguaccgcaccgccaucugcgggcuguaccccgcccagaucaaggcgcggcagaugaucagcccggucauguccgugaucggcuuccuggcccucgccaaggacuggagcgaccgcaucgagcaguggcuguccgagcccugcaagcugcuccccgacacggccgccgugagccugcacggcgggcccgcgaccaaccgggacuaccugcgccagcggcaggucgcccucggcaacauggagaccaaggaguccaaggccauccgccagcacgccgagagcgccgggugcuccaugguggaggacaucgagagcccguccagcaucuggguguucgcgggcgcccccgaccggugcccgccgaccugccuguucaucgccggcaucgccgagcugggggccuucuucagcauccuccaggacaugcgcaacacgaucauggcguccaagaccgucggcaccagcgaggagaagcugcgcaagaaguccagcuucuaccaguccuaccugcggcgcacccagagcauggggauccagcucgaccagcggaucaucgugcuguucaugguggccuggggcaaggaggccgucgacaacuuccaccugggggacgacauggaccccgagcuccgcacgcuggcccagucccugaucgacgugaaggugaaggagaucagcaaccaggagccccucaagcuguga

SEQ ID NO: 6388 - RNA, 1290 nt, Artificial Sequence
  derived and/or modified CDS sequence (opt1) from HTNV(TJJ16)__AY839871.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggcucgccgccagcauccaggcgaagaucgacgagcugaagcggcagcuggccgaccgcaucgccacgggcaagaaccucgggaaggagcgggaccccaccggcguggagcccggggaccaccugaaggagcgcuccaugcugagcuacggcaacgugcucgaccugaaccaccuggacaucgacgagcccaccggccagaccgccgacuggcucuccaucgucaucuaccugacgagcuucguggugcccauccugcucaaggcgcuguacaugcugaccacccgggggcgccagaccacgaaggacaacaagggcacccggauccgcuucaaggacgacuccagcuucgaggacgucaacgggauccggaagccgaagcaccucuacgugucccugcccaacgcccagagcuccaugaaggccgaggagaucacccccggccgcuaccggaccgccaucugcgggcuguaccccgcccagaucaaggcgcgccagaugaucagcccggugauguccgucaucggcuuccucgcccuggccaaggacuggagcgaccggaucgagcaguggcuguccgagcccugcaagcuccugcccgacacggccgccgugagccugcacggcgggcccgcgaccaaccgcgacuaccuccggcagcgccagguggcccugggcaacauggagaccaaggaguccaaggccauccggcagcacgccgagagcgccgggugcuccauggucgaggacaucgagagcccguccagcaucuggguguucgcgggcgcccccgaccgcugcccgccgaccugccuguacaucgccggcaucgccgagcucggggccuucuucagcauccugcaggacaugcgcaacacgaucauggcguccaagaccgugggcaccagcgaggagaagcugcggaagaaguccagcuucuaccaguccuaccuccgccggacccagagcauggggauccagcuggaccagcgcaucaucguccuguucaugguggccuggggcaaggaggccguggacaacuuccaccucggggacgacauggaccccgagcugcggacgcuggcccagucccucaucgacgucaaggugaaggagaucagcaaccaggagccccugaagcuguga

SEQ ID NO: 6389 - RNA, 1290 nt, Artificial Sequence
  derived and/or modified CDS sequence (opt1) from HTNV(WCL)__KM355414.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucgagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggcggcagaccacgaaggacaacaagggcacccgcauccgguucaaggacgacuccagcuucgaggacgucaacgggauccgcaagccgaagcaccuguacgugucccuccccaacgcgcagagcuccaugaaggccgaggagaucacccccggccgguaccgcaccgccaucugcgggcuguaccccgcccagaucaaggcccggcagaugaucagcccggugauguccgucaucggcuuccuggcgcucgccaaggacuggagcgaccgcaucgagcaguggcuguccgagcccugcaagcugcuccccgacacggccgccgugagccugcugggcgggcccgccaccaaccgggacuaccuccgccagcgccagguggcgcugggcaacauggagaccaaggaguccaaggccauccggcagcacgccgaggccgccgggugcagcaugaucgaggacaucgaguccccgagcuccaucugggucuucgcgggcgcccccgaccggugcccgccgaccugccuguucaucgccggcaucgccgagcucggggccuucuucagcauccugcaggacaugcgcaacacgaucauggcgagcaagaccgugggcaccuccgaggagaagcugcgcaagaaguccagcuucuaccagagcuaccuccggcgcacccaguccauggggauccagcuggaccagcggaucaucgugcuguucauggucgccuggggcaaggaggccguggacaacuuccaccucggggacgacauggaccccgagcugcgcacgcuggcccagagccucaucgacgugaaggucaaggagaucuccaaccaggagccccugaagcuguga

SEQ ID NO: 6390 - RNA, 1290 nt, Artificial Sequence
  derived and/or modified CDS sequence (opt1) from HTNV(YN509)__GU329991.1__N
auggccaccauggaggagcugcagaaggagaucaacgcccacgagggccagcucaucaucgcgaagcagaaggugaaggacgccgagaagcaguacgagaaggaccccgacgagcugaacaagcgcgcccugaccgaccgggagggggucgccgccagcauccaggcgaagaucgacgagcucaagcgccagcuggccgaccggaucgccacgggcaagaaccuggggcaggaccgcgaccccaccggcguggagcccggggaccaccucaaggagcgguccaugcugagcuacggcaacauccuggaccucaaccaccuggacaucgacgagcccaccggccagaccgccgacuggcuguccaucaucguguaccucacgagcuucgucgugcccauccugcugaaggcgcucuacaugcugaccacccgcgggcggcagaccgccaaggacaacaagggcacgcgcauccgguucaaggacgacuccagcuucgaggacgugaacgggauccgcaagccgaagcaccuguacgucuccaugcccaacgcccagagcuccaugaaggccgaggagaucacccccggccgguaccgcaccgccgugugcgggcucuaccccgcgcagaucaaggcccggcagauggugagcccggucauguccgugaucggcuucauggcccuggccaaggacuggaccgaccgcaucgagaacuggcugggcgagcccugcaagcuccugcccgacacgagcuccgugauccugcucgggggccccgccaccaaccgggacuacauccgccagcggcaggucgcgcuggggaacauggagaccaaggaggccaaggccgugcgccagcacgccgagagcgccggcugcuccaugaucgacaacaucgacagcccguccagcaucuggguguucgcgggcgcccccgaccggugcccgccgaccugccuguucgucgccgggcucgccgagcugggcgccuucuucuccauccugcaggacaugcgcaacacgaucauggcgagcaagaccguggggaccagcgaggagaagaugcggaagaaguccagcuucuaccaguccuaccuccgccgcacccagagcaugggcauccagcuggaccagcggaucaucgugcuguucauggucgccugggggaaggaggccguggacaacuuccaccucggcgacgacauggaccccgagcugcgcaaccuggcccagucccucaucgaccagaaggugaaggagaucagcaaccaggagccccugaagcuguga

SEQ ID NO: 6391 - RNA, 1290 nt, Artificial Sequence
  derived and/or modified CDS sequence (opt1) from HTNV(YU62)__AY748309.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggcucgccgccagcauccaggcgaagaucgacgagcugaagcggcagcuggccgaccgcaucgccacgggcaagaaccucgggaaggagcaggaccccaccggcguggagcccggggaccaccugaaggagcgguccaugcugagcuacggcaacgugcucgaccugaaccaccuggacaucgacgagcccaccggccagaccgccgacuggcucuccaucgucaucuaccugacgagcuucguggugcccauccugcucaaggcgcuguacaugcugaccacccgcgggcggcagaccacgaaggacaacaagggcacccgcauccgguucaaggacgacuccagcuucgaggacgucaacgggauccgcaagccgaagcaccucuacgugucccugcccaacgcccagagcuccaugaaggccgaggagaucacccccggccgguaccgcaccgccaucugcgggcuguaccccgcccagaucaaggcgcggcagaugaucagcccggugauguccgucaucggcuuccucgcccuggccaaggacuggagcgaccgcaucgagcaguggcuguccgagcccugcaagcuccugcccgacacggccgccgugagccugcacggcgggcccgcgaccaaccgggacuaccuccgccagcgccagguggcccugggcaacauggagaccaaggaguccaaggccauccggcagcacgccgagagcgccgggugcuccauggucgaggacaucgagagcccguccagcaucuggguguucgcgggcgcccccgaccggugcccgccgaccugccuguucaucgccggcaucgccgagcucggggccuucuucagcauccugcaggacaugcgcaacacgaucauggcguccaagaccgugggcaccagcgaggagaagcugcgcaagaaguccagcuucuaccaguccuaccuccggcgcacccagagcauggggauccagcuggaccagcggaucaucguccuguucaugguggccuggggcaaggaggccguggacaacuuccaccucggggacgacauggaccccgagcugcgcacgcuggcccagucccucaucgacgucaaggugaaggagaucagcaaccaggagccccugaagcuguga

SEQ ID NO: 6392 - RNA, 1290 nt, Artificial Sequence
  derived and/or modified CDS sequence (opt1) from HTNV(ZLS6-11)__FJ753396.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgccagcauccaggcgaagaucgacgagcucaagcggcagcuggccgaccgcaucgccacgggcaagaaccuggggaaggagcaggacccgaccggcguggagcccggggaccaccucaaggagcgguccaugcugagcuacggcaacguccuggaccucaaccaccuggacaucgacgagcccaccggccagaccgccgacuggcuguccaucgugaucuaccucacgagcuucgugguccccauccugcugaaggcgcucuacaugcugaccacccgcgggcggcagaccacgaaggacaacaagggcacccgcauccgguucaaggacgacuccagcuucgaggacaucaacgggauccgcaagccgaagcaccuguacgugucccuccccaacgcccagagcuccaugaaggccgaggagaucacccccggccgguaccgcaccgccaucugcgggcuguaccccgcccagaucaaggcgcggcagaugaucagcccggugauguccgucaucggcuuccuggcccucgccaaggacuggagcgaccgcaucgagcaguggcuguccgagcccugcaagcugcuccccgacacggccgccgugagccugcacggcgggcccgcgaccaaccgggacuaccugcgccagcgccagguggcccucggcaacauggagaccaaggaguccaaggccauccggcagcacgccgagaccgccgggugcagcaugaucgaggacaucgaguccccgagcuccaucugggucuucgcgggcgcccccgaccggugcccgcccacgugccuguucaucgccggcaucgccgagcugggggccuucuucagcauccuccaggacaugcgcaacaccaucauggcgagcaagaccgugggcaccuccgaggagaagcugcgcaagaaguccagcuucuaccagagcuaccugcggcgcacgcaguccauggggauccagcucgaccagcggaucaucgugcuguucauggucgccuggggcaaggaggccguggacaacuuccaccugggggacgacauggaccccgagcuccgcacccuggcccagagccugaucgacgugaaggucaaggagaucuccaaccaggagccccucaagcuguga

SEQ ID NO: 6393 - RNA, 1290 nt, Artificial Sequence
  derived and/or modified CDS sequence (opt1) from HTNV__AB027523.1__N
auggccaccauggaggagcugcagaaggagaucaacgcccacgagggccagcucaucaucgcgaagcagaaggugaaggacgccgagaagcaguacgagaaggaccccgacgagcugaacaagcgcgcccugaccgaccgggagggggucagcgccuccauccaggccaagaucgacgagcucaagcgccagcuggcggaccggaucgccacgggcaagaaccuggggcaggaccgcgaccccaccggcguggagcccggggaccaccucaaggagcggagcaugcuguccuacggcaacauccuggaccucaaccaccuggacaucgacgagcccaccggccagaccgccgacuggcugagcaucaucguguaccucacguccuucgucgugcccauccugcugaaggcccucuacaugcugaccacccgcgggcggcagaccgcgaaggacaacaagggcacgcgcauccgguucaaggacgacagcuccuucgaggacgugaacgggauccgcaagccgaagcaccuguacgucagcaugcccaacgcccaguccagcaugaaggccgaggagaucacccccggcggguaccggaccgccgugugcggccucuuccccgcccagaucaaggcgcgccagaugguguccccggucaugagcgugaucggcuucauggcccuggccaaggacuggaccgaccggaucgaguccuggcugggggagcccugcaagcuccugcccgacacgagcgccgugucccugcucggcgggcccgccaccaaccgcgacuacauccggcagcgccaggucgcgcugggcaacauggagaccaaggaggccaaggccgugcggcagcacgccgagagcgccggcugcuccaugaucgacaacaucgacagcccguccagcaucuggguguucgcgggggcccccgaccgcugcccgccgaccugccuguucaucgccggcaucgccgagcucggggccuucuucagcauccugcaggacaugcggaacacgaucauggcguccaagaccgucggcaccagcgaggagaagaugcgcaagaaguccagcuucuaccaguccuaccugcggcgcacccagagcauggggauccagcucgaccagcgcaucaucgugcuguucaugguggccuggggcaaggaggccgccgacaacuuccagcacggcgacgacauggaccccgagcugcggacgcucgcgcagucccugaucgaccagaaggucaaggagaucagcaaccaggagccccugaagcucuga

SEQ ID NO: 6394 - RNA, 1293 nt, Artificial Sequence
  derived and/or modified CDS sequence (opt1) from HTNV__D25530.1__N
augauggccaccauggaggagcugcagcgcgagaucaacgcccacgagggccagcucgugaucgcgcggcagaagguccgcgacgccgagaagcaguacgagaaggaccccgacgagcugaacaagcgggcccugaccaaccgcgaggggguggccgugagcauccaggccaagaucgacgagcucaagaugcagcuggcggaccggaucgccacgggcaagaaccuggggaaggagcaggaccccaccggcgucgagcccggggaccaccucaaggagcgcuccaugcugagcuacggcaacgugcuggaccucaaccaccuggacaucgacgagcccaccggccagaccgccgacuggcuguccaucaucguguaccucacgagcuucgucgugcccauccugcugaaggcccucuacaugcugaccacccgggggcgccagaccacgaaggacaacaagggcacccggauccgcuucaaggacgacuccagcuucgaggacgugaacgggauccggaagccgaagcaccuguacgucucccuccccaacgcgcagagcuccaugaaggccgaggagaucacccccggccgcuaccggaccgccgugugcgggcuguaccccgcccagaucaaggcccgccagaugaucagcccggugauguccgucaucggcuuccuggcgcucgccaaggacuggagcgaccggaucgagcaguggcugaucgagcccugcaagcugcuccccgacacggccgccgugucccugcugggcgggcccgccaccaaccgcgacuaccuccggcagcgccagguggcgcugggcaacauggagaccaaggagagcaaggccauccggcagcacgccgaggccgccgggugcuccaugaucgaggacaucgagagcccguccagcaucugggucuucgcgggcgcccccgaccgcugcccgccgaccugccuguucaucgccggcaucgccgagcucggggccuucuucuccauccugcaggacaugcggaacacgaucauggcgagcaagaccgugggcaccagcgaggagaagcugcgcaagaaguccagcuucuaccaguccuaccuccgccggacccagagcauggggauccagcuggaccagcgcaucaucgugcuguucauggucgccuggggcaaggaggccguggacaacuuccaccucggggacgacauggaccccgagcugcggacgcuggcccagucccucaucgacgugaaggucaaggagaucagcaaccaggagccccugaagcuguga

SEQ ID NO: 6395 - RNA, 1290 nt, Artificial Sequence
  derived and/or modified CDS sequence (opt1) from HTNV__M14626.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgugagcauccaggccaagaucgacgagcucaagcggcagcuggccgaccgcaucgcgaccggcaagaaccuggggaaggagcaggacccgaccggcgucgagcccggggaccaccucaaggagcgguccaugcugagcuacggcaacgugcuggaccucaaccaccuggacaucgacgagcccaccggccagacggccgacuggcuguccaucaucguguaccucaccagcuucgucgugcccauccugcugaaggcccucuacaugcugaccacccgcgggcggcagacgaccaaggacaacaagggcacccgcauccgguucaaggacgacuccagcuucgaggacgugaacgggauccgcaagccgaagcaccuguacgucucccuccccaacgcccagagcuccaugaaggcggaggagaucacccccggccgguaccgcacggccgugugcgggcuguaccccgcccagaucaaggcccggcagaugaucagcccggugauguccgucaucggcuuccuggcccucgcgaaggacuggagcgaccgcaucgagcaguggcugaucgagcccugcaagcugcuccccgacaccgccgccgugucccugcugggcgggcccgccaccaaccgggacuaccuccgccagcgccagguggcccugggcaacauggagaccaaggagagcaaggcgauccggcagcacgccgaggccgccgggugcuccaugaucgaggacaucgagagcccguccagcaucugggucuucgccggcgcgcccgaccggugcccgcccacgugccuguucaucgccggcaucgccgagcucggggccuucuucuccauccugcaggacaugcgcaacaccaucauggccagcaagaccgugggcaccagcgaggagaagcugcgcaagaaguccagcuucuaccaguccuaccuccggcgcacgcagagcauggggauccagcugggccagcggaucaucgugcuguucauggucgcgugggggaaggaggccguggacaacuuccaccucggcgacgacauggaccccgagcugcgcacccuggcccagucccucaucgacgugaaggucaaggagaucagcaaccaggagccccugaagcuguga

SEQ ID NO: 6396 - RNA, 1290 nt, Artificial Sequence
  derived and/or modified CDS sequence (opt1) from HTNV__X95077.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgugagcauccaggccaagaucgacgagcucaagcggcagcuggccgaccgcaucgcgaccggcaagaaccuggggaaggagcaggaccccaccggcgucgagcccggggaccaccucaaggagcgguccaugcugagcuacggcaacgugcuggaccucaaccaccuggacaucgacgagcccaccggccagacggccgacuggcuguccaucguggucuaccucaccagcuucguggugcccacccugcugaaggcccucuacaugcugaccacgcgcgggcggcagaccaccaaggacaacaagggcacccgcauccgguucaaggacgacuccagcuucgaggacgucaacgggauccgcaagccgaagcaccuguacgugucccuccccaacgcccagagcuccaugaaggcggaggagaucacgcccggccgguaccgcaccgccgugugcgggcuguaccccgcccagaucaaggcccggcagaugaucagcccggucauguccgugaucggcuuccuggcccucgcgaaggacuggagcgaccgcaucgagcaguggcuguccgagcccugcaagcugcuccccgacaccaccgccgugagccugcugggcgggcccgccacgaaccgggacuaccuccgccagcggcaggucgcccugggcaacauggagaccaaggaguccaaggccauccgccagcacgcggaggccgccgggugcagcaugaucgaggacaucgaguccccgagcuccaucuggguguucgccggcgcccccgaccggugcccgccgaccugccuguucaucgcgggcaucgccgagcucggggccuucuucagcauccugcaggacaugcgcaacaccaucauggccagcaagacggugggcaccuccgaggagaagcugcgcaagaaguccagcuucuaccagagcuaccuccggcgcacccaguccauggggauccagcuggaccagcggaucaucguccuguucaugguggccuggggcaaggaggcgguggacaacuuccaccucggggacgacauggaccccgagcugcgcacccuggcccagagccucaucgacgucaaggugaaggagaucuccaaccaggagccccugaagcuguga

SEQ ID NO: 6397 - RNA, 1290 nt, Artificial Sequence
  derived and/or modified CDS sequence (opt1) from HTNV(CGAa1011)__EF990913.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgccagcauccaggccaagaucgacgagcucaagcggcagcuggcggaccgcaucgccaccggcaagaaccuggggaaggagcaggaccccaccggcguggagcccggggaccaccucaaggagcgguccaugcugagcuacggcaacguccuggaccucaaccaccuggacaucgacgagcccaccggccagacggccgacuggcuguccaucgugaucuaccucaccagcuucgugguccccauccugcugaaggcccucuacaugcugaccacccgcgggcggcagacgaccaaggacaacaagggcacccgcauccgguucaaggacgacuccagcuucgaggacgugaacgggauccgcaagccgaagcaccuggacgugucccuccccaacgcgcagagcuccaugaaggccgaggagaucacccccggccgguaccgcacggccaucugcgggcuguaccccgcccagaucaaggcccggcagaugaucagcccggucauguccgugaucggcuuccuggcgcucgccaaggacuggagcgaccgcaucgagcaguggcugggcgagcccugcaagcugcuccccgacaccgccgccgugucccugcucgggggccccgccaccaaccgggacuaccugcgccagcggcaggucgcgcuggggaacauggagaccaaggagagcaaggccauccgccagcacgccgagacggccggcugcuccaugaucgaggacaucgagagcccguccagcaucuggguguucgccggcgcgcccgaccggugcccgccgaccugccuguucaucgccgggaucgccgagcucggcgccuucuucuccgugcugcaggacaugcgcaacaccaucauggccagcaagaccgucgggacgagcgaggagaagcugcgcaagaaguccagcuucuaccaguccuaccucggccggacccagagcauggggauccagcuggaccagcgcaucaucgugcuguucaugguggcguggggcaaggaggccgucgacaacuuccaccucggcgacgacguggaccccgagcugcggacccuggcccagucccucaucgacgugaaggucaaggagaucagcgaccaggagccccugaagcuguga

SEQ ID NO: 6398 - RNA, 1290 nt, Artificial Sequence
  derived and/or modified CDS sequence (opt1) from HTNV(CGAa1015)__EF990912.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgccagcauccaggccaagaucgacgagcucaagcggcagcuggcggaccgcaucgccaccggcaagaaccuggggaaggagcaggaccccaccggcguggagcccggggaccaccucaaggagcgguccaugcugagcuacggcaacguccuggaccucaaccaccuggacaucgacgagcccaccggccagacggccgacuggcuguccaucgugaucuaccucaccagcuucgugguccccauccugcugaaggcccucuacaugcugaccacccgcgggcggcagacgaccaaggacaacaagggcacccgcauccgguucaaggacgacuccagcuucgaggacgugaacgggauccgcaagccgaagcaccuggacgugucccuccccaacgcgcagagcuccaugaaggccgaggagaucacccccggccgguaccgcacggccaucugcgggcuguaccccgcccagaucaaggcccggcagaugaucagcccggucauguccgugaucggcuaccuggcgcucgccaaggacuggagcgaccgcaucgagcaguggcugggcgagcccugcaagcugcuccccgacaccgccgccgugucccugcucgggggccccgccaccaaccgggacuaccugcgccagcggcaggucgcgcuggggaacauggagaccaaggagagcaaggccauccgccagcacgccgagacggccggcugcuccaugaucgaggacaucgagagcccguccagcaucuggguguucgccggcgcgcccgaccggugcccgccgaccugccuguucaucgccgggaucgccgagcucggcgccuucaucuccgugcugcaggacaugcgcaacaccaucauggccagcaagaccgucgggacgagcgaggagaagcugcgcaagaaguccagcuucuaccaguccuaccucggccggacccagagcauggggauccagcuggaccagcgcaucaucgugcuguucaugguggcguggggcaaggaggccgucgacaacuuccaccucggcgacgacguggaccccgagcugcggacccuggcccagucccucaucgacgugaaggucaaggagaucagcgaccaggagccccugaagcuguga

SEQ ID NO: 6399 - RNA, 1290 nt, Artificial Sequence
  derived and/or modified CDS sequence (opt1) from HTNV(CGAa2)__EU092219.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgccagcauccaggccaagaucgacgagcucaagcggcagcuggcggaccgcaucgccaccggcaagaaccuggggaaggagcaggaccccaccggcguggagcccggggaccaccucaaggagcgguccaugcugagcuacggcaacguccuggaccucaaccaccuggacaucgacgagcccaccggccagacggccgacuggcuguccaucgugaucuaccucaccagcuucgugguccccauccugcugaaggcccucuacaugcugaccacccgcgggcggcagacgaccaaggacaacaagggcacccgcauccgguucaaggacgacuccagcuucgaggacgugaacgggauccgcaagccgaagcaccuguacgugucccuccccaacgcgcagagcuccaugaaggccaaggagaucacccccggccgguaccgcacggccaucugcgggcuguaccccgcccagaucaaggcccggcagaugaucagcccggucauguccgugaucggcuuccuggcgcucgccaaggacuggagcgaccgcaucgagcaguggcuguccgagcccugcaagcugcuccccgacaccgccgccgugagccugcacggcgggcccgccaccaaccgggacuaccugcgccagcggcaggucgcgcucggcaacauggagccgaaggaguccaaggccauccgccagcacgccgagagcgccgggugcuccaugguggaggacaucgagagccccuccagcaucuggguguucgccggcgcgcccgaccggugcccgccgaccugccuguucaucgccggcaucgccgagcugggggccuucuucagcauccuccaggacaugcgcaacacgaucauggccuccaagaccgucggcaccagcgaggagaagcugcgcaagaaguccagcuucuaccaguccuaccugcggcgcacccagagcauggggauccagcucgaccagcggaucaucgugcuguucaugguggcguggggcaaggaggccgucgacaacuuccaccugggggacgacauggaccccgagcuccgcacgcuggcccagucccugaucgacgugaaggugaaggagaucagcaaccaggagccccucaagcuguga

SEQ ID NO: 6400 - RNA, 1290 nt, Artificial Sequence
  derived and/or modified CDS sequence (opt1) from HTNV(CGAa31MP7)__EF990911.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgccagcauccaggccaagaucgacgagcucaagcggcagcuggcggaccgcaucgccaccggcaagaaccuggggaaggagcaggacccgaccggcguggagcccggggaccaccucaaggagcgguccaugcugagcuacggcaacguccuggaccucaaccaccuggacaucgacgagcccaccggccagacggccgacuggcuguccaucgugaucuaccucaccagcuucgugguccccauccugcugaaggcccucuacaugcugaccacccgcgggcggcagacgaccaaggacaacaagggcacccgcauccgguucaaggacgacuccagcuucgaggacgugaacgggauccgcaagccgaagcaccuguacgugucccuccccaacgcgcagagcuccaugaaggccgaggagaucacccccggccgguaccgcacggccaucugcgggcuguaccccgcccagaucaaggcccggcagaugaucagcccggucauguccgugaucggcuuccuggcgcucgccaaggacuggagcgaccgcaucgagcaguggcuguccgagcccugcaagcugcuccccgacaccgccgccgugagccugcacggcgggcccgccaccaaccgggacuaccugcgccagcggcaggucgcgcucggcaacauggagaccaaggaguccaaggccauccgccagcacgccgagagcgccgggugcuccaugguggaggacaucgagagcccguccagcaucuggguguucgccggcgcgcccgaccggugcccgcccacgugccuguucaucgccggcaucgccgagcugggggccuucuucagcauccuccaggacaugcgcaacaccaucauggccuccaagaccgucggcaccagcgaggagaagcugcgcaagaaguccagcuucuaccaguccuaccugcggcgcacgcagagcauggggauccagcucgaccagcggaucaucgugcuguucaugguggcguggggcaaggaggccgucgacaacuuccaccugggggacgacauggaccccgagcuccgcacccuggcccagucccugaucgacgugaaggugaaggagaucagcaaccaggagccccucaagcuguga

SEQ ID NO: 6401 - RNA, 1290 nt, Artificial Sequence
  derived and/or modified CDS sequence (opt1) from HTNV(CGAa31P9)__EF990910.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgccagcauccaggccaagaucgacgagcucaagcggcagcuggcggaccgcaucgccaccggcaagaaccuggggaaggagcaggacccgaccggcguggagcccggggaccaccucaaggagcgguccaugcugagcuacggcaacguccuggaccucaaccaccuggacaucgacgagcccaccggccagacggccgacuggcuguccaucgugaucuaccucaccagcuucgugguccccauccugcugaaggcccucuacaugcugaccacccgcgggcggcagacgaccaaggacaacaagggcacccgcauccgguucaaggacgacuccagcuucgaggacgugaacgggauccgcaagccgaagcaccuguacgugucccuccccaacgcgcagagcuccaugaaggccgaggagaucacccccggccgguaccgcacggccaucugcgggcuguaccccgcccagaucaaggcccggcagaugaucagcccggucauguccgugaucggcuuccuggcgcucgccaaggacuggagcgaccgcaucgagcaguggcuguccgagcccugcaagcugcuccccgacaccgccgccgugagccugcacggcgggcccgccaccaaccgggacuaccugcgccagcggcaggucgcgcucggcaacauggagaccaaggaguccaaggccauccgccagcacgccgagagcgccgggugcuccaugguggaggacaucgagagcccguccagcaucuggguguucgccggcgcgcccgaccggugcccgcccacgugccuguucaucgccgagaucgccgagcugggcgccuucuucagcauccuccaggacaugcgcaacaccaucauggccuccaagaccgucgggaccagcgaggagaagcugcgcaagaaguccagcuucuaccaguccuaccugcggcgcacgcagagcaugggcauccagcucgaccagcggaucaucgugcuguucaugguggcgugggggaaggaggccgucgacaacuuccaccugggcgacgacauggaccccgagcuccgcacccuggcccagucccugaucgacgugaaggugaaggagaucagcaaccaggagccccucaagcuguga

SEQ ID NO: 6402 - RNA, 1290 nt, Artificial Sequence
  derived and/or modified CDS sequence (opt1) from HTNV(CGAa4MP9)__EF990915.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgccagcauccaggccaagaucgacgagcucaagcggcagcuggcggaccgcaucgccaccggcaagaaccuggggaaggagcaggaccccaccggcguggagcccggggaccaccucaaggagcgguccaugcugagcuacggcaacguccuggaccucaaccaccuggacaucgacgagcccaccggccagacggccgacuggcuguccaucgugaucuaccucaccagcuucgugguccccauccugcugaaggcccucuacaugcugaccacccgcgggcggcagacgaccaaggacaacaagggcacccgcauccgguucaaggacgacuccagcuucgaggacgugaacgggauccgcaagccgaagcaccuguacgugucccuccccaacgcgcagagcuccaugaaggccgaggagaucacccccggccgguaccgcacggccaucugcgggcuguaccccgcccagaucaaggcccggcagaugaucagcccggucauguccgugaucggcuuccuggcgcucgccaaggacuggagcgaccgcaucgagcaguggcugggcgagcccugcaagcugcuccccgacaccgccgccgugucccugcucgggggccccgccaccaaccgggacuaccugcgccagcggcaggucgcgcuggggaacauggagaccaaggagagcaaggccauccgccagcacgccgagacggccggcugcuccaugaucgaggacaucgagagcccguccagcaucuggguguucgccggcgcgcccgaccggugcccgccgaccugccuguucaucgccgggaucgccgagcucggcgccuucuucuccgugcugcaggacaugcgcaacaccaucauggccagcaagaccgucgggacgagcgaggagaagcugcgcaagaaguccagcuucuaccaguccuaccuccggcgcacccagagcaugggcauccagcuggaccagcggaucaucgugcuguucaugguggcgugggggaaggaggccgucgacaacuuccaccucggcgacgacauggaccccgagcugcgcacccuggcccagucccucaucgacgugaaggugaaggagaucagcaaccaggagccccugaagcuguga

SEQ ID NO: 6403 - RNA, 1290 nt, Artificial Sequence
  derived and/or modified CDS sequence (opt1) from HTNV(CGAa75)__EU092220.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgccagcauccaggccaagaucgacgagcucaagcggcagcuggcggaccgcaucgccaccggcaagaaccuggggaaggagcaggacccgaccggcguggagcccggggaccaccucaaggagcgguccaugcugagcuacggcaacguccuggaccucaaccaccuggacaucgacgagcccaccggccagacggccgacuggcuguccaucgugaucuaccucaccagcuccgugguccccauccugcugaaggcccucuacaugcugaccacccgcgggcggcagacgaccaaggacaacaagggcacccgcauccgguucaaggacgacagcuccuucgaggacgugaacgggauccgcaagccgaagcaccuguacgugagccuccccaacgcgcaguccagcaugaaggccgaggagaucacccccggccgguaccgcacggccaucugcgggcuguaccccgcccagaucaaggcccggcagaugaucuccccggucaugaacgugaucggcuuccuggcgcucgccaaggacuggagcgaccgcaucgagcaguggcuguccgagcccugcaagcugcuccccgacaccgccgccgugagccugcacggcgggcccgccaccaaccgggacuaccugcgccagcggcaggucgcgcucggcaacauggagaccaaggaguccaaggccauccgccagcacgccgagagcgccgggugcuccaugguggaggacaucgagagcccguccagcaucuggguguucgccggcgcgcccgaccggugcccgcccacgugccuguucaucgccggcaucgccgagcugggggccuucuucagcauccuccaggacaugcgcaacaccaucauggccuccaagaccgucggcaccagcgaggagaagcugcgcaagaaguccagcuucuaccaguccuaccugcggcgcacgcagagcauggggauccagcucgaccagcggaucaucgugcuguucaugguggcguggggcaaggaggccgucgacaacuuccaccugggggacgacauggaccccgagcuccgcacccuggcccagucccugaucgacgugaaggugaaggagaucagcaaccaggagccccucaagcuguga

SEQ ID NO: 6404 - RNA, 1290 nt, Artificial Sequence
  derived and/or modified CDS sequence (opt1) from HTNV(CGHu1)__EU092218.1__N
auggccaccauggaggagcugcagcgcgagaucaacgcccacgagggccagcucgugaucgcgcggcagaagguccgcgacgccgagaagcaguacgagaaggacagcgacgagcugaacaagcggacccugacggaccgcgaggggguggccguguccauccaggccaagaucgacgagcucaagcggcagcuggccgaccgcaucgcgaccggcaagaaccuggggaaggagcaggaccccaccggcgucgagccgggggaccaccucaaggagcggagcaugcuguccuacggcaacgugcuggaccucaaccaccuggacaucgacgagcccaccggccagacggccgacuggcugagcaucguggucuaccucaccucccugguggugcccauccugcucaaggcccuguacaugcugaccaccaaggggcgccagacgaccaaggacaacaagggcacccggauccgcuucaaggacgacagcuccuucgaggacgucaacgggauccggaagcccaagcaccucuacgugagccugcugaacgcccaguccagcaugaaggcggaggagaucaccccgggccgcuaccggacggccaucugcgggcccuaccccgcccagaucaaggcccgccagaugaucucccccgugaugagcgucaucggcuuccucgcccuggcgaaggacugguccgaccggaucgagcaguggcugagcgagccgugcaagcuccugcccgacaccgccgccgugucccugcucggcgggcccgccaccaaccgcgacuaccugcggcagcgccagguggcccugggcaacauggagaccaaggagagcaaggcgauccggcagcacgccgaggccgccgggugcuccaugaucgaggacaucgagagccccuccagcaucugggucagcgccggcgcgccggaccgcugcccgcccacgugccucuucaucgccggcaucgccgagcugggggccuucuucuccauccugcaggacaugcggaacaccaucauggccagcaagaccgugggcaccuccgaggagaagcuccgcaagaaguccagcuucuaccagagcuaccugcgccggacgcaguccauggggauccagcuggaccagcgcaucaucguccucuucaugguggcguggggcaaggaggccguggacaacuuccaccugggggacgacauggaccccgagcugcggacccucgcccagagccugaucgacgugaaggucaaggagaucuccaaccaggagccccugaagcucuga

SEQ ID NO: 6405 - RNA, 1290 nt, Artificial Sequence
  derived and/or modified CDS sequence (opt1) from HTNV(CGHu2)__EU363813.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgccagcauccaggccaagaucgacgagcucaagcggcagcuggcggaccgcaucgccaccggcaagaaccuggggaaggagcaggacccgaccggcguggagcccggggaccaccucaaggagcgguccaugcugagcuacggcaacguccuggaccucaaccaccuggacaucgacgagcccaccggccagacggccgacuggcuguccaucgugaucuaccucaccagccuggugguccccauccugcucaaggcccuguacaugcugaccacccgcgggcggcagacgaccaaggacaacaagggcacccgcauccgguucaaggacgacuccagcuucgaggacgugaacgggauccgcaagccgaagcaccucuacgugucccugcccaacgcgcagagcuccaugaaggccgaggagaucacccccggccgguaccgcacggccaucugcgggcuguaccccgcccagaucaaggcccggcagaugaucagcccggucauguccgugaucggcuuccucgcgcuggccaaggacuggagcgaccgcaucgagcaguggcuguccgagcccugcaagcuccugcccgacaccgccgccgugagccugcacggcgggcccgccaccaaccgggacuaccuccgccagcggcaggucgcgcugggcaacauggagaccaaggaguccaaggccauccgccagcacgccgagagcgccgggugcuccaugguggaggacaucgagagcccguccagcaucuggguguucgccggcgcgcccgaccggugcccgcccacgugccuguucaucgccggcaucgccgagcucggggccuucuucagcaucucccaggacaugcgcaacaccaucauggccagcaagaccgucggcaccuccgaggagaagcugcgcaagaaguccagcuucuaccagagcuaccugcggcgcacgcaguccauggggauccagcucgaccagcggaucaucgugcuguucaugguggcguggggcaaggaggccgucgacaacuuccaccugggggacgacauggaccccgagcuccgcacccuggcccagagccugaucgacgugaaggugaaggagaucuccaaccaggagccccucaagcuguga

SEQ ID NO: 6406 - RNA, 1290 nt, Artificial Sequence
  derived and/or modified CDS sequence (opt1) from HTNV(CGHu3612)__EF990909.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggcucgccgccagcauccaggcgaagaucgacgagcugaagcggcagcuggccgaccgcguggccacgggcaagaaccucgggaaggagcaggaccccaccggcguggagcccggggaccaccugaaggagcgguccaugcugagcuacggcaacguccucgaccugaaccaccuggacaucgacgagcccaccggccagaccgccgacuggcucuccaucgugaucuaccugacgagcuucgugguccccauccugcucaaggcgcuguacaugcugaccacccgcgggcggcagaccacgaaggacaacaagggcacccgcauccgguucaaggacgacuccagcuucgaggacgugaacgggauccgcaagccgaagcaccucuacgugucccugcccaacgcccagagcuccaugaaggccgaggagaucacccccggccgguaccgcaccgccaucugcgggcuguaccccgcccagaucaaggcgcggcagaugaucagcccggucauguccgugaucggcuuccucgcccuggccaaggacuggagcgaccgcaucgagcaguggcuguccgagcccugcaagcuccugcccgacacggccgccgugagccugcacggcgggcccgcgaccaaccgggacuaccuccgccagcggcaggucgcccugggcaacauggagaccaaggaguccaaggccauccgccagcacgccgagagcgccgggugcuccaugguggaggacaucgagagcccguccagcaucuggguguucgcgggcgcccccgaccggugcccgccgaccugccuguucaucgccggcaucgccgagcucggggccuucuucagcauccugcaggacaugcgcaacacgaucauggcguccaagaccgucggcaccagcgaggagaagcugcgcaagaaguccagcuucuaccaguccuaccuccggcgcacccagagcauggggauccagcuggaccagcggaucaucgugcuguucaugguggccuggggcaaggaggccgucgacaacuuccaccucggggacgacauggaccccgagcugcgcacgcuggcccagucccucaucgacgugaaggugcgggagaucagcaaccaggagccccugaagcuguga

SEQ ID NO: 6407 - RNA, 1290 nt, Artificial Sequence
  derived and/or modified CDS sequence (opt1) from HTNV(CGRn15)__EU363810.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgccagcauccaggccaagaucgacgagcucaagcggcagcuggcggaccgcaucgccaccggcaagaaccuggggaaggagcaggaccccaccggcguggagcccggggaccaccucaaggagcgguccaugcugagcuacggcaacguccuggaccucaaccaccuggacaucgacgagcccaccggccagacggccgacuggcuguccaucgugaucuaccucaccagcuucgugguccccauccugcugaaggcccucuacaugcugaccacccgcgggcggcagacgaccaaggacaacaagggcacccgcauccgguucaaggacgacuccagcuucgaggacgugaacgggauccgcaagccgaagcaccuguacgugacccuccccaacgcgcaguccagcaugaaggccgaggagaucacgcccggccgguaccgcaccgccaucugcgggcuguaccccgcccagaucaaggcccggcagaugaucuccccggucaugagcgugaucggcuuccuggcgcucgccaaggacugguccgaccgcaucgagcaguggcugagcgagcccugcaagcugcuccccgacaccgccgccgugucccugcacggcgggcccgccaccaaccgggacuaccugcgccagcggcaggucgcgcucggcaacauggagacgaaggagagcaaggccauccgccagcacgccgaguccgccgggugcagcaugguggaggacaucgaguccccgagcuccaucuggguguucgccggcgcgcccgaccggugcccgccgaccugccuguucaucgccggcaucgccgagcugggggccuucuucagcauccuccaggacaugcgcaacaccaucauggccagcaagaccgucggcacguccgaggagaagcugcgcaagaaguccagcuucuaccagagcuaccugcggcgcacccaguccauggggauccagcucgaccagcggaucaucgugcuguucaugguggcguggggcaaggaggccgucgacaacuuccaccugggggacgacauggaccccgagcuccgcacccuggcccagagccugaucgacgugaaggugaaggagaucuccaaccaggagccccucaagcuguga

SEQ ID NO: 6408 - RNA, 1290 nt, Artificial Sequence
  derived and/or modified CDS sequence (opt1) from HTNV(CGRn2616)__EU363811.1__N
auggccaccauggaggagcugcagcgcgagaucaacgcccacgagggccagcucgugaucgcgcggcagaagguccgcgacgccgggaagcaguacgagaaggaccccgacgagcugaacaagcggacccugacggaccgcgagggcguggccgccagcauccaggccaagaucgacgagcucaagcggcagcuggcggaccgcaucgccaccgggaagaaccugggcaaggagcaggacccgaccgggguggagcccggcgaccaccucaaggagcgguccaugcugagcuacggcaacguccuggaccucaaccaccuggacaucgacgagcccaccgggcagacggccgacuggcuguccaucgugaucuaccucaccagcuucgugguccccauccugcugaaggcccucuacaugcugaccacccgcggccggcagacgaccaaggacaacaaggggacccgcauccgguucaaggacgacuccagcuucgaggacgugaacggcauccgcaagccgaagcaccuguacgugucccuccccaacgcgcagagcuccaugaaggccgaggagaucacccccgggcgguaccgcacggccaucugcggccuguaccccgcccagaucaaggcccggcagaugaucagcccggucauguccgugaucggcuuccuggcgcucgccaaggacuggagcgaccgcaucgagcaguggcuguccgagcccugcaagcugcuccccgacaccgccgccgugagccugcacgggggccccgccaccaaccgggacuaccugcgccagcggcaggucgcgcucgggaacauggagaccaaggaguccaaggccauccgccagcacgccgagagcgccggcugcuccaugguggaggacaucggcagcccguccagcaucuggguguucgccggggcgcccgaccggugcccgcccacgugccuguucaucgccggcaucgccgagcugggggccuucuucagcauccuccaggacaugcgcaacaccaucauggccuccaagaccgucggcaccagcgaggagaagcugcgcaagaaguccagcuucuaccaguccuaccugcggcgcacgcagagcauggggauccagcucgaccagcggaucaucgugcuguucaugguggcguggggcaaggaggccgucgacaacuuccaccugggcgacgacauggaccccgagcuccgcacccuggcccagucccugaucgacguggaggugaaggagaucagcaaccaggagccccucaagcuguga

SEQ ID NO: 6409 - RNA, 1290 nt, Artificial Sequence
  derived and/or modified CDS sequence (opt1) from HTNV(CGRn53)__EF990907.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgccagcauccaggcgaagaucgacgagcucaagcggcagcuggccgaccgcaucgccacgggcaagaaccuggggaaggagcaggaccccaccggcguggagcccggggaccaccucaaggagcgguccaugcugagcuacggcaacguccuggaccucaaccaccuggacaucgacgagcccaccggccagaccgccgacuggcuguccaucgugaucuaccucacgagcuucgugguccccauccugcugaaggcgcucuacaugcugaccacccgcgggcggcagaccacgaaggacaacaagggcacccgcauccgguucaaggacgacuccagcuucgaggacgugaacgggauccgcaagccgaagcaccuguacgugucccuccccaacgcccagagcuccaugaaggccgaggagaucacccccggccgguaccgcaccgccaucugcgggcuguaccccgcccagaucaaggcgcggcagaugaucagcccggucauguccgugaucggcuuccuggcccucgccaaggacuggagcgaccgcaucgagcaguggcuguccgagcccugcaagcugcuccccgacacggccgccgugagccugcacggcgggcccgcgaccaaccgggacuaccugcgccagcggcaggucgcccucggcaacauggagaccaaggaguccaaggccauccgccagcacgccgaggccgcggggugcagcaugaucgaggacaucgaguccccgagcuccaucuggguguucgccggcgcccccgaccggugcccgccgaccugccuguucaucgccggcaucgccgagcugggggcguucuucagcauccuccaggacaugcgcaacacgaucauggccagcaagaccgugggcaccuccgaggagaagcugcgcaagaaguccagcuucuaccagagcuaccugcggcgcacccaguccauggggauccagcucgaccagcggaucaucguccuguucaugguggccuggggcaaggaggccguggacaacuuccaccugggggacgacauggaccccgagcuccgcacgcuggcgcagagccugaucgacgucaaggugaaggagaucuccaaccaggagccccucaagcuguga

SEQ ID NO: 6410 - RNA, 1290 nt, Artificial Sequence
  derived and/or modified CDS sequence (opt1) from HTNV(CGRn5310)__EF990906.1__N
auggccaccauggaggagcugcagcgcgagaucaacgcccacgagggccagcucgugaucgcgcggcagaagguccgcgacgccgagaagcaguacgagaaggaccccgacgagcccaacaagcgggcccugaccgaccgcgaggggguggccgccagcauccaggcgaagaucgacgagcugaagcggcagcucgccgaccgcaucgccacgggcaagaaccuggggaaggagcaggaccccaccggcguggagcccggggaccaccugaaggagcgguccaugcucagcuacggcaacguccuggaccugaaccaccucgacaucgacgagcccaccggccagaccgccgacuggcuguccaucgugaucuaccugacgagcuucguggucccgauccuccugaaggcgcuguacaugcucaccacccgcgggcggcagaccacgaaggacaacaagggcacccgcauccgguucaaggacgacuccagcuucgaggacgugaacgggauccgcaagcccaagcaccuguacgugucccugcccaacgcccagagcuccaugaaggccgaggagaucacccccggccgguaccgcaccgccaucugcgggcucuacccggcccagaucaaggcgcggcagaugaucagccccgucauguccgugaucggcuuccuggcccuggccaaggacuggagcgaccgcaucgagcaguggcucuccgagcccugcaagcugcugcccgacacggccgccgugagccuccacggcgggccggcgaccaaccgggacuaccugcgccagcggcaggucgcccugggcaacauggagaccaaggaguccaaggccauccgccagcacgccgaggccgcggggugcagcaugaucgaggacaucgagucccccagcuccaucuggguguucgccggcgcccccgaccggugcccgccgaccugccucuucaucgccggcaucgccgagcugggggcguucuucagcauccugcaggacaugcgcaacacgaucauggccagcaagaccgugggcaccuccgaggagaagcuccgcaagaaguccagcuucuaccagagcuaccugcggcgcacccaguccauggggauccagcuggaccagcggaucaucguccucuucaugguggccuggggcaaggaggccguggacaacuuccaccugggggacgacauggaccccgagcugcgcacgcucgcgcagagccugaucgacgucaaggugaaggagaucuccaaccaggagccccugaagcucuga

SEQ ID NO: 6411 - RNA, 1290 nt, Artificial Sequence
  derived and/or modified CDS sequence (opt1) from HTNV(CGRn93MP8)__EF990905.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgcccccauccaggcgaagaucgacgagcucaagcggcagcuggccgaccgcaucgccacgggcaagaaccuggggaaggagcaggaccccaccggcguggagcccggggaccaccucaaggagcggagcaugcuguccuacggcaacguccuggaccucaaccaccuggacaucgacgagcccaccggccagaccgccgacuggcugagcaucgugaucuaccucacguccuucguggucccgauccugcugaaggcgcucuacaugcugaccacccgcgggcggcagaccacgaaggacaacaagggcagccgcauccgguucaaggacgacuccagcuucgaggacgugaacgggauccgcaagcccaagcaccuguacgugucccuccccaacgcccagagcuccaugaaggccgaggagaucacccccggccgguaccgcaccgccaucugcgggcuguacccggcccagaucaaggcgcggcagaugaucagccccgucauguccgugaucggcuuccuggcccucgccaaggacuggagcgaccgcaucgagcaguggcuguccgagcccugcaagcugcuccccgacaccgccgccgugagccugcacggcgggccggcgacgaaccgggacuaccugcgccagcggcaggucgcccucggcaacauggagaccaaggaguccaaggccauccgccagcacgccgaggccgcggggugcagcaugaucgaggacaucgagucccccagcuccaucuggguguucgccggcgcccccgaccggugcccgccgaccugccuguucaucgccggcaucgccgagcugggggcguucuucagcauccuccaggacaugcgcaacaccaucauggccagcaagacggugggcaccuccgaggagaagcugcgcaagaaguccagcuucuaccagagcuaccugcggcgcacccaguccauggggauccagcucgaccagcggaucaucguccuguucaugguggccuggggcaaggaggccguggacaacuuccaccugggggacgacauggaccccgagcuccgcacccuggcgcagagccugaucgacgucaaggugaaggagaucuccaaccaggagccccucaagcuguga

SEQ ID NO: 6412 - RNA, 1290 nt, Artificial Sequence
  derived and/or modified CDS sequence (opt1) from HTNV(CGRn93P8)__EF990904.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgccagcauccaggcgaagaucgacgagcucaagcggcagcuggccgaccgcaucgccacgggcaagaaccuggggaaggagcaggaccccaccggcguggagcccggggaccaccucaaggagcgguccaugcugagcuacggcaacguccuggaccucaaccaccuggacaucgacgagcccaccggccagaccgccgacuggcuguccaucgugaucuaccucacgagcuucgugguccccauccugcugaaggcgcucuacaugcugaccacccgcgggcggcagaccacgaaggacaacaagggcacccgcauccgguucaaggacgacuccagcuucgaggacgugaacgggauccgcaagccgaagcaccuguacgugucccuccccaacgcccagagcuccaugaaggccgaggagaucacccccggccgguaccgcaccgccaucugcgggcuguaccccgcccagaucaaggcgcggcagaugaucagcccggucauguccgugaucggcuuccuggcccucgccaaggacuggagcgaccgcaucgagcaguggcuguccgagcccugcaagcugcuccccgacacggccgccgugagccugcacggcgggcccgcgaccaaccgggacuaccugcgccagcggcaggucgcccucggcaacauggagaccaaggaguccaaggccauccgccagcacgccgaggccgcggggugcagcaugaucgaggacaucgaguccccgagcuccaucuggguguucgccggcgcccccgaccggugcccgccgaccugccuguucaucgccggcaucgccgagcugggggcguucaucagcauccuccaggacaugcgcaacacgaucauggccagcaagaccgugggcaccuccgaggagaagcugcgcaacaagagcuccuucuaccagagcuaccugcggcgcacccaguccauggggauccagcucgaccagcggaucaucguccuguucaugguggccuggggcaaggaggccguggacaacuuccaccugggggacgacauggaccccgagcuccgcacgcuggcgcagagccugaucgacgucaaggugaaggagaucuccaaccaggagccccucaagcuguga

SEQ ID NO: 6413 - RNA, 1290 nt, Artificial Sequence
  derived and/or modified CDS sequence (opt1) from HTNV(CGRni1)__EU363812.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgccagcauccaggccaagaucgacgagcucaagcggcagcuggcggaccgcaucgccaccggcaagaaccuggggcgggagcaggacccgaccggcguggagcccggggaccaccucaaggagcgcuccaugcugagcuacggcaacguccuggaccucaaccaccuggacaucgacgagcccaccggccagacggccgacuggcuguccaucgugaucuaccucaccagcuucgugguccccauccugcugaaggcccucuacaugcugaccacccgggggcgccagacgaccaaggacaacaagggcacccggauccgcuucaaggacgacuccagcuucgaggacaucaacgggauccggaagccgaagcaccuguacgugucccuccccaacgcgcagagcuccaugaaggccgaggagaucacccccggccgcuaccggacggccaucugcgggcuguaccccgcccagaucaaggcccgccagaugaucagcccggugauguccgucaucggcuuccuggcgcucgccaaggacuggagcgaccggaucgagcaguggcuguccgagcccugcaagcugcuccccgacaccgccgccgugagccugcacggcgggcccgccaccaaccgcgacuaccugcggcagcgccagguggcgcucggcaacauggagaccaaggaguccaaggccauccggcagcacgccgagagcgccgggugcuccauggucgaggacaucgagagcccguccagcaucuggguguucgccggcgcgcccgaccgcugcccgcccacgugccuguucaucgccggcaucgccgagcugggggccuucuucagcauccuccaggacaugcgcaacaccaucauggccuccaagaccgugggcaccagcgaggagaagcugcggaagaaguccagcuucuaccaguccuaccugcgccggacgcagagcauggggauccagcucgaccagcgcaucaucguccugcugaugguggcguggggcaaggaggccguggacaacuuccaccucggggacgacauggaccccgagcugcggacccuggcccagucccucaucgacgucaaggugaaggagaucagcaaccaggagccccugaagcuguga

SEQ ID NO: 6414 - RNA, 1290 nt, Artificial Sequence
  derived and/or modified CDS sequence (opt1) from HTNV(CJAp93)__EF208929.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgugagcauccaggccaagaucgacgagcucaagcggcagcuggccgaccgcaucgcgaccggcaagaaccuggggaaggagcaggacccgaccggcgucgagcccggggaccaccucaaggagcgguccaugcugagcuacggcaacgugcuggaccucaaccaccuggacaucgacgagcccaccggccagacggccgacuggcuguccaucguggucuaccucaccagcuucguggugcccauccugcugaaggcccucuacaugcugaccacccgcgggcggcagacgaccaaggacaacaagggcacccgcauccgguucaaggacgacuccagcuucgaggacgucaacgggauccgcaagccgaagcaccuguacgugucccuccccaacgcccagagcuccaugaaggcggaggagaucacccccggccgguaccgcacggccaucugcgggcuguaccccgcccagaucaaggcccggcagaugaucagcccggugauguccgucaucggcuuccuggcccucgcgaaggacuggagcgaccgcaucgagcaguggcuguccgagcccugcaagcugcuccccgacaccgccgccgugggccugcucgggggccccgccaccaaccgggacuaccugcgccagcgccagguggcccuggggaacauggagaccaaggagagcaaggcgauccggcagcacgccgaggccgccggcugcuccaugaucgaggacaucgagagcccguccagcaucugggucuucgccggcgcgcccgaccggugcccgcccacgugccuguucaucgccgggaucgccgagcucggcgccuucuucuccauccugcaggacaugcgcaacaccaucauggccagcaagaccguggggaccagcgaggagaagcugcgcaagaaguccagcuucuaccaguccuaccuccggcgcacgcagagcaugggcauccagcuggaccagcggaucaucgugcuguucauggucgcgugggggaaggaggccgugaacaacuuccaccucggcgacgacauggaccccgagcugcgcacccuggcccagucccucaucgacgugaaggucaaggagaucagcaaccaggagccccugaagcuguga

SEQ ID NO: 6415 - RNA, 1290 nt, Artificial Sequence
  derived and/or modified CDS sequence (opt1) from HTNV(Aa14_207)__KX687234.1__N
auggccaccauggaggagcugcagcgcgagaucaacgcccacgagggccagcucgugaucgcgcggcagaagguccgcgacgccgagaagcaguacgggaaggaccccgacgagcugaacaagcgggcccugaccgaccgcgagggcguggccgugagcauccaggccaagaucgacgagcucaagcggcagcuggcggaccgcaucgccacggggaagaaccugggcaaggagcaggaccccaccggggucgagcccggcgaccaccucaaggagcgguccaugcugagcuacggcaacgugcuggaccucaaccaccuggacaucgacgagcccaccgggcagaccgccgacuggcuguccaucguggucuaccucacgagcuucguggugcccauccugcugaaggcccucuacaugcugaccacccgcggccggcagaccacgaaggacaacaaggggacccgcauccgguucaaggacgacuccagcuucgaggacgucaacggcauccgcaagccgaagcaccuguacgugucccuccccaacgcgcagagcuccaugaaggccgaggagaucacccccgggcgguaccgcaccgccgugugcggccuguaccccgcccagaucaaggcccggcagaugaucagcccggucauguccgugaucggcuuccuggcgcucgccaaggacuggagcgaccgcaucgagcaguggcuguccgagcccugcaagcugcuccccgacacggccgccgugagccugcucgggggccccgccaccaaccgggacuaccugcgccagcggcaggucgcgcuggggaacauggagaccaaggaguccaaggccauccgccagcacgccgaggccgccggcugcagcaugaucgaggacaucgaguccccgagcuccaucuggguguucgcgggcgcccccgaccggugcccgccgaccugccuguucguggccgggaucgccgagcucggcgccuucuucagcauccugcaggacaugcgcaacacgaucauggcgagcaagaccgucgggaccuccgaggagaagcugcgcaagaaguccagcuucuaccagagcuaccuccggcgcacccaguccaugggcauccagcuggaccagcggaucaucgugcuguucaugguggccugggggaaggaggccgucgacaacuuccaccucggcgacgacauggaccccgagcugcgcacgcuggcccagagccucaucgacgugaaggugaaggagaucuccaaccaggagccccugaagcuguga

SEQ ID NO: 6416 - RNA, 1290 nt, Artificial Sequence
  derived and/or modified CDS sequence (opt1) from HTNV(Aa14_234)__KX687235.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgugagcauccaggccaagaucgacgagcucaagcggcagcuggcggaccgcaucgccacgggcaagaaccuggggaaggagcaggaccccaccggcgucgagcccggggaccaccucaaggagcgguccaugcugagcuacggcaacgugcuggaccucaaccaccuggacaucgacgagcccaccggccagaccgccgacuggcuguccaucguggucuaccucacgagcuucguggugcccauccugcugaaggcccucuacaugcugaccacccgcgggcggcagaccacgaaggacaacaagggcacccgcauccgguucaaggacgacuccagcuucgaggacgucaacgggauccgcaagccgaagcaccuguacgugucccuccccaacgcgcagagcuccaugaaggccgaggagaucacccccggccgguaccgcaccgccgugugcgggcuguaccccgcccagaucaaggcccggcagaugaucagcccggucauguccgugaucggcuuccuggcgcucgccaaggacuggagcgaccgcaucgagcaguggcugggcgagcccugcaagcugcuccccgacacggccgccgugucccugcucgggggccccgccaccaaccgggacuaccugcgccagcggcaggucgcgcuggggaacauggagaccaaggagagcaaggccauccgccagcacgccgaggccgccggcugcuccaugaucgaggacaucgagagcccguccagcaucuggguguucgcgggcgcccccgaccggugcccgccgaccugccuguucaucgccgggaucgccgagcucggcgccuucuucuccauccugcaggacaugcgcaacacgaucauggcgagcaagaccguggggaccagcgaggagaagcugcgcaagaaguccagcuucuaccaguccuaccuccggcgcacccagagcaugggcauccagcuggaccagcggaucaucguccuguucaugguggccugggggaaggaggccguggacaacuuccaccucggcgacgacauggaccccgagcugcgcacgcuggcccagucccucaucgacgucaaggugaaggagaucagcaaccaggagccccugaagcuguga

SEQ ID NO: 6417 - RNA, 1290 nt, Artificial Sequence
  derived and/or modified CDS sequence (opt1) from HTNV(Aa14_239)__KX687236.1__N
auggccaccauggaggagcugcagcgcgagaucaacgcccacgagggccagcucgugaucgcgcggcagaagguccgcgacgccgagaagcaggacgggaaggaccccgacgagcugaacaagcgggcccugaccgaccgcgagggcguggccgugagcauccaggccaagaucgacgagcucaagcggcagcuggcggaccgcaucgccacggggaagaaccugggcaaggagcaggaccccaccggggucgagcccggcgaccaccucaaggagcgguccaugcugagcuacggcaacgugcuggaccucaaccaccuggacaucgacgagcccaccgggcagaccgccgacuggcuguccaucguggucuaccucacgagcuucguggugcccauccugcugaaggcccucuacaugcugaccacccgcggccggcagaccacgaaggacaacaaggggacccgcauccgguucaaggacgacuccagcuucgaggacgucaacggcauccgcaagccgaagcaccuguacgugucccuccccaacgcgcagagcuccaugaaggccgaggagaucacccccgggcgguaccgcaccgccgugugcggccuguaccccgcccagaucaaggcccggcagaugaucagcccggucauguccgugaucggcuuccuggcgcucgccaaggacuggagcgaccgcaucgagcaguggcugggggagcccugcaagcugcuccccgacacggccgccgugucccugcugggcgggcccgccaccaaccgggacuaccuccgccagcggcaggucgcgcugggcaacauggagaccaaggagagcaaggccauccgccagcacgccgaggccgccggcugcuccaugaucgaggacaucgagagcccguccagcaucuggguguucgcgggggcccccgaccggugcccgccgaccugccuguucaucgccggcaucgccgagcucggggccuucuucuccauccugcaggacaugcgcaacacgaucauggcgagcaagaccgugggcaccagcgaggagaagcugcgcaagaaguccagcuucuaccaguccuaccuccggcgcacccagagcauggggauccagcuggaccagcggaucaucguccuguucaugguggccuggggcaaggaggccguggacaacuuccaccucggcgacgacauggaccccgagcugcgcacgcuggcccagucccucaucgacgucaaggugaaggagaucagcaaccaggagccccugaagcuguga

SEQ ID NO: 6418 - RNA, 1290 nt, Artificial Sequence
  derived and/or modified CDS sequence (opt1) from HTNV(AY133/2011)__KY807166.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgccagcauccaggcgaagaucgacgagcucaagcggcagcuggccgaccgcaucgccacgggcaagaacaucgggaaggagcaggacccgaccggcguggagcccggggaccaccugaaggagcgguccaugcucagcuacggcaacguccuggaccugaaccaccucgacaucgacgagcccaccggccagaccgccgacuggcuguccaucgugaucuaccugacgagcuucgugguccccauccuccugaaggcgcuguacaugcucaccacccgcgggcggcagaccacgaaggacaacaagggcacccgcauccgguucaaggacgacuccagcuucgaggacguguccgggauccgcaagccgaagcaccuguaccugagccuccccaacgcccaguccagcaugaaggccgaggagaucacccccggccgguaccgcaccgccaucugcgggcuguaccccgcccagaucaaggcgcggcagaugaucuccccggugaugagcgucaucggcuuccuggcccucgccaaggacugguccgaccgcaucgagcaguggcugagcgagcccugcaagcugcuccccgacacggccgccgugucccugcacggcgggcccgcgaccaaccgggacuaccugcgccagcgccagguggcccucggcaacauggagaccaaggagagcaaggccauccggcagcacgccgagaccgccgggugcuccaugaucgacgacaucgagagcccguccagcaucugggucuucgcgggcgcccccgaccggugcccgcccacgugccuguucaucgccggcaucgccgagcugggggccuucuucagcauccuccaggacaugcgcaacaccaucauggcguccaagaccgugggcaccagcgaggagaagcugcgcaagaaguccagcuucuaccaguccuaccugcggcgcacgcagagcauggggauccagcucgaccagcggaucaucgugcuguucauggucgccuggggcaaggaggccguggacaacuuccaccugggggacgacauggaccccgagcuccgcacccuggcccagucccugaucgacgugaaggucaaggagaucagcaaccaggagccccucaagcuguga

SEQ ID NO: 6419 - RNA, 1290 nt, Artificial Sequence
  derived and/or modified CDS sequence (opt1) from HTNV(GAN13/2011)__KY807168.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgccagcauccaggcgaagaucgacgagcucaagcggcagcuggccgaccgcaucgccacgggcaagaaccuggggaaggagcaggacccgaccggcguggagcccggggaccaccucaaggagcgguccaugcugagcuacggcaacguccuggaccucaaccaccuggacaucgacgagcccaccggccagaccgccgacuggcuguccaucgugaucuaccucacgagcuucgugguccccauccugcugaaggcgcucuacaugcugaccacccgcgggcggcagaccacgaaggacaacaagggcacccgcauccgguucaaggacgacuccagcuucgaggacgugaacgggauccgcaagccgaagcaccuguaccucucccugcccaacgcccagagcuccaugaaggccgaggagaucacccccggccgguaccgcaccgccaucugcgggcuguaccccgcccagaucaaggcgcggcagaugaucagcccggugauguccgucaucggcuuccucgcccuggccaaggacuggagcgaccgcaucgagcaguggcuguccgagcccugcaagcuccugcccgacacggccgccgugagccugcacggcgggcccgcgaccaaccgggacuaccuccgccagcgccagguggcccugggcaacauggagaccaaggaguccaaggccauccggcagcacgccgagaccgccgggugcagcaugaucgacgacaucgaguccccgagcuccaucugggucuucgcgggcgcccccgaccggugcccgcccacgugccuguucaucgccggcaucgccgagcucggggccuucuucagcauccugcaggacaugcgcaacaccaucauggcgagcaagaccgugggcaccuccgaggagaagcugcgcaagaaguccagcuucuaccagagcuaccuccggcgcacgcaguccauggggauccagcuggaccagcggaucaucgugcuguucauggucgccuggggcaaggaggccguggacaacuuccaccucggggacgacauggaccccgagcugcgcacccuggcccagagccucaucgacgugaaggucaaggagaucuccaaccaggagccccugaagcuguga

SEQ ID NO: 6420 - RNA, 1290 nt, Artificial Sequence
  derived and/or modified CDS sequence (opt1) from HTNV(GAN19/2011)__KY807172.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccgaccgcgaggggguggccgccagcauccaggcgaagaucgacgagcucaagcggcagcuggccgaccgcaucgccacgggcaagaaccuggggaaggagcaggaccccaccggcguggagcccggggaccaccucaaggagcgguccaugcugagcuacggcaacguccuggaccucaaccaccuggacaucgacgagcccaccggccagaccgccgacuggcuguccaucgugaucuaccucacgagcuucgugguccccauccugcugaaggcgcucuacaugcugaccacccgcgggcggcagaccacgaaggacaacaagggcacccgcauccgguucaaggacgacuccagcuucgaggacgugaacgggauccgcaagccgaagcaccuguaccucucccugcccaacgcccagagcuccaugaaggccgaggagaucacccccggccgguaccgcaccgccaucugcgggcuguaccccgcccagaucaaggcgcggcagaugacgagcccggugauguccgucaucggcuuccucgcccuggccaaggacuggagcgaccgcaucgagcaguggcuguccgagcccugcaagcuccugcccgacaccgccgccgugagccugcacggcgggcccgcgaccucccgggacuaccuccgccagcgccagguggcccugggcaacauggagaccaaggagagcaaggccauccggcagcacgccgagacggccgggugcuccaugaucgacgacaucgagagcccguccagcaucugggucuucgcgggcgcccccgaccggugcccgccgaccugccuguucaucgccggcaucgccgagcucggggccuucuucagcauccugcaggacaugcgcaacaccaucauggcguccaagaccgugggcacgagcgaggagaagcugcgcaagaaguccagccucuaccaguccuaccugcggcgcacccagagcauggggauccagcuggaccagcggaucaucguccucuucaugguggccuggggcaaggaggccguggacaacuuccaccugggggacgacauggaccccgagcugcgcacccucgcccagucccugaucgacgugaaggucaaggagaucagcaaccaggagccccugaagcucuga

SEQ ID NO: 6421 - RNA, 1290 nt, Artificial Sequence
  derived and/or modified CDS sequence (opt1) from HTNV(LR1)__AF288294.1__N
auggccaccauggaggagcugcagcgcgagaucaacgcccacgagggccagcucgugaucgcgcggcagaagguccgcgacgccgagaagcaguacgagaaggaccccgacgagcugaacaagcgggcccugaccaaccgcgaggggguggccgugagcauccaggccaagaucgacgagcucaagaugcagcuggcggaccggaucgccacgggcaagaaccuggggaaggagcaggaccccaccggcgucgagcccggggaccaccucaaggagcgcuccaugcugagcuacggcaacgugcuggaccucaaccaccuggacaucgacgagcccaccggccagaccgccgacuggcuguccaucaucguguaccucacgagcuucgucgugcccauccugcugaaggcccucuacaugcugaccacccgggggcgccagaccacgaaggacaacaagggcacccggauccgcuucaaggacgacuccagcuucgaggacgugaacgggauccggaagccgaagcaccuguacgucucccuccccgacgcgcagagcuccaugaaggccgaggagaucacccccggccgcuaccggaccgccgugugcgggcuguaccccgcccagaucaaggcccgccagaugaucagcccggugauguccgucaucggcuuccuggcgcucgccaaggacuggagcgaccggaucgagcaguggcugaucgagcccugcaagcugcuccccgacacggccgccgugucccugcugggcgggcccgccaccaaccgcgacuaccuccggcagcgccagguggcgcugggcaacauggagaccaaggagagcaaggccauccggcagcacgccgaggccgccgggugcuccaugaucgaggacaucgagagcccguccagcaucugggucuucgcgggcgcccccgaccgcugcccgccgaccugccuguucaucgccggcaucgccgagcucggggccuucuucuccauccugcaggacaugcggaacacgaucauggcgagcaagaccgugggcaccagcgaggagaagcugcgcaagaaguccagcuucuaccaguccuaccuccgccggacccagagcauggggauccagcuggaccagcgcaucaucgugcuguucauggucgccuggggcaaggaggccguggacaacuuccaccucggggacgacauggaccccgagcugcggacgcuggcccagucccucaucgacgugaaggucaaggagaucagcaaccaggagccccugaagcuguga

SEQ ID NO: 6422 - RNA, 1290 nt, Artificial Sequence
  derived and/or modified CDS sequence (opt1) from HTNV(RG9)__AF288296.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgccagcauccaggccaagaucgacgagcucaagcggcagcuggcggaccgcaucgccaccggcaagaaccuggggaaggagcaggacccgaccggcguggagcccggggaccaccucaaggagcgguccaugcugagcuacggcaacguccuggaccucaaccaccuggacaucgacgagcccaccggccagacggccgacuggcuguccaucgugaucuaccucaccagcuucgugguccccauccugcugaaggcccucuacaugcugaccacccgcgggcggcagacgaccaaggacaacaagggcacccgcauccgguucaaggacgacuccagcuucgaggacgugaacgggauccgcaagccgaagcaccuguacgugucccuccccaacgcgcagagcuccaugaaggccgaggagaucacccccggccgguaccgcacggccaucugcgggcuguaccccgcccagaucaaggcccggcagaugaucagcccggucauguccgugaucggcuuccuggcgcucgccaaggacuggagcgaccgcaucgagcaguggcuguccgagcccugcaagcugcuccccgacaccgccgccgugagccugcacggcgggcccgccaccaaccgggacuaccugcgccagcggcaggucgcgcucggcaacauggagaccaaggaguccaaggccauccgccagcacgccgagagcgccgggugcuccaugaucgaggacaucgagagcccguccagcaucuggguguucgccggcgcgcccgaccggugcccgcccacgugccuguucaucgccggcaucgccgagcugggggccuucuucagcauccuccaggacaugcgcaacaccaucaccgccuccaagaccgugggcacgagcgaggagaagcugcgcaagaaguccagcuucuaccaguccuaccugcggcgcacccagagcauggggauccagcucgaccagcggaucaucguccuguucaugguggcguggggcaaggaggccguggacaacuuccaccugggggacgacauggaccccgagcuccgcacccuggcccagucccugaucgacgucaaggugaaggagaucagcaaccaggagccccucaagcuguga

SEQ ID NO: 6423 - RNA, 1290 nt, Artificial Sequence
  derived and/or modified CDS sequence (opt1) from HTNV(S85-46)__AF288659.1__N
auggccaccauggaggagcugcagcgcgagaucaacgcccacgagggccagcucgugaucgcgcggcagaagguccgcgacgccgagaagcaguacgagaaggaccccgacgagcugaacaagagcgcccugaccaaccgggaggggguggccguguccauccaggccaagaucgacgagcucaagaugcagcuggcggaccgcaucgccacgggcaagaaccuggggaaggagcaggaccccaccggcgucgagcccggggaccaccucaaggagcggagcaugcuguccuacggcaacgugcuggaccucaaccaccuggacaucgacgagcccaccggccagaccgccgacuggcugagcaucaucguguaccucacguccuucgucgugcccauccugcugaaggcccucuacaugcugaccacccgcgggcggcagaccacgaaggacaacaagggcacccgcauccgguucaaggacgacagcuccuucgaggacgugaacgggauccgcaagccgaagcaccuguacgucagccuccccaacgcgcaguccagcaugaaggccgaggagaucacccccggccgguaccgcaccgccgugugcgggcuguaccccgcccagaucaaggcccggcagaugaucuccccggugaugagcgucaucggcuuccuggcgcucgccaaggacugguccgaccgcaucgagcaguggcugaucgagcccugcaagcugcuccccgacacggccgccgugagccugcugggcgggcccgccaccaaccgggacuaccuccgccagcgccagguggcgcugggcaacauggagaccaaggaguccaaggccauccggcagcacgccgaggccgccgggugcagcaugaucgaggacaucgaguccccgagcuccaucugggucuucgcgggcgcccccggccggugcccgccgaccugccuguucaucgccgggaucgccgagcucggcgccuucuucagcauccugcaggacaugcgcaacacgaucauggcgagcaagaccguggggaccuccgaggagaagcugcggaagaaguccagcuucuaccagagcuaccuccgccgcacccaguccaugggcauccagcuggaccagcggaucaucgugcuguucauggucgccugggggaaggaggccguggacaacuuccaccucggcgacgacauggaccccgagcugcgcacgcuggcccagagccucaucgacgugaaggucaaggagaucuccaaccaggagccccugaagcuguga

SEQ ID NO: 6424 - RNA, 1290 nt, Artificial Sequence
  derived and/or modified CDS sequence (opt1) from HTNV(SN7)__AF288657.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgccagcauccaggccaagaucgacgagcucaagcggcagcuggcggaccgcaucgccaccggcaagaaccuggggaaggagcaggaccccaccggcguggagcccggggaccaccucaaggagcgguccaugcugagcuacggcaacguccuggaccucaaccaccuggacaucgacgagcccaccggccagacggccgacuggcuguccaucgugaucuaccucaccagcuucgugguccccauccugcugaaggcccucuacaugcugaccacccgcgggcggcagacgaccaaggacaacaagggcacccgcauccgguucaaggacgacuccagcuucgaggacgugaacgggauccgcaagccgaagcaccuguacgugucccuccccaacgcgcagagcuccaugaagaccgaggagaucacgcccggccgguaccgcaccgccaucugcgggcuguaccccgcccagaucaaggcccggcagaugaucagcccggucauguccgugaucggcuuccuggcccucgcgaaggacuggagcgaccgcaucgagcaguggcuguccgagcccugcaagcugcuccccgacaccgccgccgugagccugcacggcgggcccgccaccaaccgggacuaccugcgccagcggcaggucgcccucggcaacauggagacgaaggaguccaaggcgauccgccagcacgccgagagcgccgggugcuccaugaucgaggacaucgagagcccguccagcaucuggguguucgccggcgcccccgaccggugcccgccgaccugccuguucaucgcgggcaucgccgagcugggggccuucuucagcauccuccaggacaugcgcaacaccaucauggccuccaagaccgugggcacgagcgaggagaagcugcgcaagaaguccagcuucuaccaguccuaccugcggcgcacccagagcauggggauccagcucgaccagcggaucaucguccuguucaugguggccuggggcaaggaggcgguggacaacuuccaccugggggacgacauggaccccgagcuccgcacccuggcccagucccugaucgacgucaaggugaaggagaucagcaaccaggagccccucaagcuguga

SEQ ID NO: 6425 - RNA, 1290 nt, Artificial Sequence
  derived and/or modified CDS sequence (opt1) from HTNV(84FLi)__AF366568.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgccagcauccaggccaagaucgacgagcucaagcggcagcuggcggaccgcaucgccaccggcaagaaccuggggaaggagcaggacccgaccggcguggagcccggggaccaccucaaggagcgguccaugcugagcuacggcaacguccuggaccucaaccaccuggacaucgacgagcccaccggccagacggccgacuggcuguccaucgugaucuaccucaccagcuucgugguccccauccugcugaaggcccucuacaugcugaccacccgcgggcggcagacgaccaaggacaacaagggcacccgcauccgguucaaggacgacuccagcuucgaggacgugaacgggauccgcaagccgaagcaccuguacgugucccuccccaacgcgcagagcuccaugaaggccgaggagaucacccccggccgguaccgcacggccaucugcgggcuguaccccgcccagaucaaggcccggcagaugaucagcccggucauguccgugaucggcuuccuggcgcucgccaaggacuggagcgaccgcaucgagcaguggcuguccgagcccugcaagcugcuccccgacaccgccgccgugagccugcacggcgggcccgccaccaaccgggacuaccugcgccagcggcaggucgcgcucggcaacauggagaccaaggaguccaaggccauccgccagcacgccgagagcgccgggugcuccaugaucgaggacaucgagagcccguccagcaucuggguguucgccggcgcgcccaaccggugcccgcccacgugccuguucaucgccggcaucgccgagcugggggccuucuucagcauccuccaggacaugcgcaacaccaucauggccuccaagaccgugggcaccagcgaggagaagcugcgcaagaaguccagcuucuaccaguccuaccugcggcgcacgcagagcauggggauccagcucgaccagcggaucaucguccuguucaugguggcguggggcaaggaggccguggacaacuuccaccugggggacgacauggaccccgagcuccgcacccuggcccagucccugaucgacgucaaggugaaggagaucagcaaccaggagccccucaagcuguga

SEQ ID NO: 6426 - RNA, 1290 nt, Artificial Sequence
  derived and/or modified CDS sequence (opt1) from HTNV(KHF,clone:4)__LC209206.1__N
auggccaccauggaggagcugcagcgcgagaucaacgcccacgagggccagcucgugaucgcgcggcagaagguccgcgacgccgagaagcaguacgagaaggaccccgacgagcugaacaagcggacccugacggaccgcgaggggguggccgugagcauccaggccaagaucgacgagcucaagcggcagcuggccgaccgcaucgcgaccggcaagaaccuggggaaggagcaggacccgaccggcgucgagcccggggaccaccucaaggagcgguccaugcugagcuacggcaacgugcuggaccucaaccaccuggacaucgacgagcccaccggccagacggccgacuggcuguccaucguggucuaccucaccagcuucguggugcccauccugcugaaggcccucuacaugcugaccacccgcgggcggcagacgaccaaggacaacaagggcacccgcauccgguucaaggacgacuccagcuucgaggacgucaacgggauccgcaagccgaagcaccuguacgugucccuccccaacgcccagagcuccaugaaggcggaggagaucacccccggccgguaccgcacggccgugugcgggcuguaccccgcccagaucaaggcccggcagaugaucagcccggucauguccgugaucggcuuccuggcccucgcgaaggacuggagcgaccgcaucgagcaguggcuguccgagcccugcaagcugcuccccgacaccgccgccgugagccugcugggcgggcccgccaccaaccgggacuaccuccgccagcggcaggucgcccugggcaacauggagaccaaggaguccaaggcgauccgccagcacgccgaggccgccgggugcagcaugaucgaggacaucgaguccccgagcuccaucuggguguucgccggcgcgcccgaccggugcccgcccacgugccuguucaucgccggcaucgccgagcucggggccuucuucagcauccugcaggacaugcgcaacaccaucauggccagcaagaccgugggcaccuccgaggagaagcugcgcaagaaguccagcuucuaccagagcuaccuccggcgcacgcaguccauggggauccagcuggaccagcggaucaucguccuguucaugguggcguggggcaaggaggccguggacaacuuccaccucggggacgacauggaccccgagcugcgcacccuggcccagagccucaucgacgucaaggugaaggagaucuccaaccaggagccccugaagcuguga

SEQ ID NO: 6427 - RNA, 1287 nt, Artificial Sequence
  derived and/or modified CDS sequence (opt1) from LANV(510B)__AF005727.1__N
augagcaaccugcaggaggugcaggagggcaucacccuccacgagcagcagcuggucgccgcccgccagaagcugaaggacgcggagaaggccguggagguggaccccgacgacgucaacaaguccacccuccagagccggcgcgccgccguguccgcccuggagaacaagcuggcggagcucaagcggcagcuggccgaccugguggccgcccagaagcucgcggccaagccggucgaccccacggggcuggagcccgacgaccaccugaaggagaaguccgcccuccgcuacggcaacgugcuggacgugaacgccaucgaccuggaggagcccagcgggcagaccgccgacuggaaggcgaucggcgccuacauccucggguucgucaucccgaucauccugaaggcccuguacaugcucagcacccggggccgccagaccgugaaggagaacaagggcacgcggauccgcuucaaggacgacuccagcuucgaggaggugaacgggauccggaagcccaagcaccuguacgucuccaugcccaccgcccagagcaccaugaaggccgacgagaucacccccggccgcuuccggacgaucgcgugcgggcuguucccggcccagaucaaggcccgcaacaucaucucccccgugaugggcgugaucggguucggccacuucgucaaggacuggauggagcggaucgacaacuuccucggcgaggacugccccuuccugcccaaggcccgcgugcagagcgaggccuucauguccaccaaccgggcguacuuccugaaccgccagcgccagguggacgagagccggauccaggacaucgucgaccucauccaggccgccgaggccuccagcgccacccuguucaacgacaucgcgaccccgcacuccgccuggguguucgccugcgcccccgaccggugcccgcccacggcgcuguacguggccgggguccccgagcucggcgccuucuucgccauccugcaggacaugcgcaacaccaucauggccagcaaguccguggggaccgcggaggagaagcugaagaagaaguccgccuucuaccagagcuaccuccggcgcacccagagcaugggcauccagcuggaccagaagaucaucauccuguacaugcucagcuggggcaaggaggccgugaaccacuuccaccugggggacgacauggaccccgagcugcgccagcucgcccagacgcugaucgacgccaaggucaaggagaucuccaaccaggagccccugaagcucuga

SEQ ID NO: 6428 - RNA, 1287 nt, Artificial Sequence
  derived and/or modified CDS sequence (opt1) from LANV(12234)__ALD61435.1__N
augagcacccugcaggaggugcaggagggcaucacccuccacgagcagcagcuggucgccgcccgccagaagcugaaggacgcggagaaggccguggagguggaccccgacgacgucaacaaguccacgcuccagagccggcgcgccgccguguccgcccuggagaacaagcuggcggagcucaagcggcagcuggccgaccugguggccgcccagaagcucgcggccaagccggucgaccccaccgggcuggagcccgacgaccaccugaaggagaaguccgcccuccgcuacggcaacgugcuggacgugaacgccaucgaccuggaggagcccagcgggcagaccgccgacuggaaggcgaucggcgccuacauccucggguucgucaucccgaucauccugaaggcccuguacaugcucagcacccggggccgccagacggugaaggagaacaagggcacccggauccgcuucaaggacgacuccagcuucgaggaggugaacgggauccggaagcccaagcagcuguacgucuccaugcccaccgcccagagcaccaugaaggccgacgagaucacgcccggccgcuuccggaccaucgcgugcgggcuguucccggcccagaucaaggcccgcaacaucaucucccccgugaugggcgugaucggguucagccacuucgucaaggacuggauggagcggaucgacgacuuccucgccgccgacugccccuuccugcccaagccgcgcgugcaguccgaggcguucauggccaccaaccgggccuacuucaucaaccgccagcggcagaucgacgagagccgcaugcccgacaucauggaccugauccaggccgccgaggcgggcuccgccacccucuucaacgacaucgccacgccccacagcgccuggguguucgcgugcgcccccgaccggugcccgcccaccgcccuguacgucgccggcgugcccgagcugggggccuucuucgcgauccuccaggacaugcgcaacaccaucauggccuccaagagcgugggcaccgccgaggagaagcugaagaagaaguccgccuucuaccagagcuaccugcggcgcacgcagagcauggggauccagcucgaccagaagaucaucauccuguacaugcuguccuggggcaaggaggccgucaaccacuuccaccucggcgacgacauggaccccgagcugcgccagcuggcgcagacccucaucgacaccaaggugaaggagaucagcaaccaggagccgcugaagcuguga

SEQ ID NO: 6429 - RNA, 1272 nt, Artificial Sequence
  derived and/or modified CDS sequence (opt1) from LQUV(Longquan-Rs-32)__JX465422.1__N
auggccaccggccgcgaccugcaggacgagcucgagcagaucgagcaggagaucacccaggccaaggcgaaguacgagaagcagaaggccgccaucggggaggagcccgacacgaucgagcugaaggugcugcagcagcgggaggagaccauccacaugcucgaggagaagcgcaaggagcugcugcagcggaucgcccagcagaugaaguccccgcgccagcccgucaagggccgggaccucgacgaggacgagcaccugagcgagcgcagcacccugcgguacgggaacgugaucgaccucgaggagcuggacaucgacgagcccgccggcggguccgcggacuggcuggccaucggcaucuacaucuucagcuuccccgugcagcuccugcugaagacccucuacauccugacgacccgcggccggcagaccaucaaggagaacaaggggaaccgccugcgguucaaggacuccagcuccaccauggacgucaacggcgugaagacgccccgccaccucuacaucagccugcccaccgcccaguccagcaugaagaccgaggagaucacccccgggcgguaccgcacgguggccugcggcauccuguccggggagaugcgggcgcgcaagcucgucagccccgugaugggcgugaucggcuucaacuaccuggccgagaaguggggcgaguacaucgacgccuuccugaugaagcaguccccgcaccuccccgucagcaccgggucccccgagagcgccaccaacuucgccuaccugauccagcggcaggacgugcugaacaaguccaagaccguggaguaccucgagcugugggagcaggcggagaaggccgggcgccaccuggucgaccggaucgagagcccccucacgccguggcuguucgccggcucccccgaccgcugcccgcccaccagccuguacguggccggcaucgccgagcucggggcguucuucagcauccugcaggacauccggaacgccaucauggccuccaagcuggugggcaccgccgaggagaagcucaagcgcaagagcuccuucuaccagagcuaccugcgccggacccaguccauggggguccagcuggaccagcgcaucaucauccucuacaugauggaguggggcaagaugaugguggaccacuuccaccugggggacgacauggacagcgagcugcggaaggccugccagucccucaucgacgagaagguggcgcaggucagcaaccaggaggcccugaagcuguga

SEQ ID NO: 6430 - RNA, 1272 nt, Artificial Sequence
  derived and/or modified CDS sequence (opt1) from LQUV(Longquan-Ra-14)__JX465414.1__N
auggccaccggccgcgaccugcaggacgagcucgagcagaucgagcaggagaucacccaggccaaggcgaaguacgagaagcagaaggccgccaucggggaggagcacgacacgaucgagcugaaggugcugcagcagcgggaggagaccauccacaugcucgaggagaagcgcaaggagcugcugcagcggaucgcccagcagaugaaguccccgcgccagcccgucaagggccgggaccucgacgaggacgagcaccuguccgagcgcagcacccugcgguacgggaacgugaucgaccucgaggagcuggacaucgacgagcccgccggcggguccgcggacuggcuggccaucggcaucuacaucuucagcuuccccgugcagcuccugcugaagacccucuacauccugacgacccgcggccggcagaccaucaaggagaacaaggggaaccgccugcgguucaaggacuccagcuccaccauggacgucaacggcgugaagacgccccgccaccucuacaucagccugcccaccgcccaguccagcaugaagaccgaggagaucacccccgggcgguaccgcacgguggccugcggcauccuguccggggagaugcgggcgcgcaagcucgucagccccgugaugggcgugaucggcuucaacuaccuggccgagaaguggggcgaguacaucgacgccuuccugaugaagcagagcccccaccucccggucagcaccgggucccccgagagcgccaccaacuucgccuaccugauccagcggcaggacgugcugaacaaguccaagaccguggaguaccucgagcugugggagcaggcggagaaggccgggcgccaccuggucgaccggaucgagagcccccucacgcccuggcuguucgccggcuccccggaccgcugcccgcccaccagccuguacguggccggcaucgccgagcucggggcguucuucagcauccugcaggacauccggaacgccaucauggccuccaagcuggugggcaccgccgaggagaagcucaagcgcaagagcuccuucuaccagagcuaccugcgccggacccaguccauggggguccagcuggaccagcgcaucaucauccucuacaugauggaguggggcaagaugaugguggaccacuuccaccugggggacgacauggacagcgagcugcggaaggccugccagucccucaucgacgagaagguggcgcaggucagcaaccaggaggcccugaagcuguga

SEQ ID NO: 6431 - RNA, 1272 nt, Artificial Sequence
  derived and/or modified CDS sequence (opt1) from LQUV(Longquan-Ra-25)__JX465415.1__N
auggccaccggccgcgaccugcaggacgagcucgagcagaucgagcaggagaucacccaggccaaggcgaaguacgagaagcagaaggccgccaucggggaggagcccgacacgaucgagcugaaggugcugcagcagcgggaggagaccauccacaugcucgaggagaagcgcaaggagcugcugcagcggaucgcccagcagaugaagucccccaagcagcccgucaagggccgcgaccucgacgaggacgagcaccugagcgagcggagcacccugcgcuacgggaacgugaucgaccucgaggagcuggacaucgacgagcccgccggcggguccgcggacuggcuggccaucggcaucuacaucuucagcuuccccgugcagcuccugcugaagacccucuacauccugacgacccggggccgccagaccaucaaggagaacaaggggaaccggcugcgcuucaaggacuccagcuccaccauggacgucaacggcgugaagacgccgcggcaccucuacaucagccugcccaccgcccaguccagcaugaagaccgaggagaucacccccgggcgcuaccggacgguggccugcggcauccuguccggggagaugcgcgcgcggaagcucgucagccccgugaugggcgugaucggcuucaacuaccuggccgagaaguggggcgaguacaucgacgccuuccugaugaagcaguccccgcaccuccccgucagcaccgggucccccgagagcgccaccaacuucgccuaccugauccagcgccaggacgugcugaacaaguccaagaccguggaguaccucgagcugugggagcaggcggagaaggccgggcggcaccuggucgaccgcaucgagagcccccucacgccguggcuguucgccggcucccccgaccggugcccgcccaccagccuguacguggccggcaucgccgagcucggggcguucuucagcauccugcaggacauccgcaacgccaucauggccuccaagcuggugggcaccgccgaggagaagcucaagcgcaagagcuccuucuaccagagcuaccugcggcgcacccaguccauggggauccagcuggaccagcggaucaucauccucuacaugauggaguggggcaagaugauggucgaccacuuccaccugggggacgacauggacagcgagcugcgcaaggccugccagucccucaucgacgagaagguggcccaggugagcaaccaggaggcgcugaagcuguga

SEQ ID NO: 6432 - RNA, 1287 nt, Artificial Sequence
  derived and/or modified CDS sequence (opt1) from NYV(RI-1)__U09488.1__N
augagcacccugaaggaggugcaggacaacaucacccuccacgagcagcagcuggucacggcccgccagaagcugaaggacgccgagaaggcgguggagguggaccccgacgacgucaacaaguccacccuccagggccggcgcgccgccgugagcgcccuggagaccaagcugggggagcucaagcggcagcuggccgaccugaucgcggcccagaagcucgccuccaagccgaucgaccccaccggcaucgagcccgacgaccaccugaaggagaaguccagccugcgcuacgggaacgugcucgacgucaacagcaucgaccuggaggagcccuccggccagacggccgacuggaaggcgaucgggauguacauccugagcuucgccaucccgaucauccucaaggcccuguacaugcuguccacccggggccgccagaccgugaaggagaacaagggcacccggauccgcuucaaggacgacagcuccuacgaggaggugaacgggauccggaagccccgccaccucuacgucagcaugcccacggcccaguccaccaugaaggccgacgagaucacccccggccgguuccgcaccaucgcgugcgggcuguucccggcccaggugaaggcccggaacaucaucagccccgugaugggcgucaucggguucaacuucuucgugaaggacuggauggaccgcaucgacgacuuccuggccgagcggugccccuuccuccccgagccgcgcgaccccaaggacgccgcgcugggcacgaaccgggccuacuucaucacccgccaggcccagguggacgaguccaaggucguggacaucgaggagcugaucguggacgcccgggccgagagcgcgacccucuucgccgacaucgccacgccccacuccgucuggguguucgccugcgcccccgaccgcugcccgcccaccgcgcuguacguggccggcaugcccgagcugggggccuucuucgccauccuccaggacaugcggaacaccaucauggcgagcaaguccgucggcaccgccgaggagaagcugaagaagaaguccgccuucuaccagagcuaccugcgccgcacccagagcauggggauccagcucgaccagaagaucaucauccuguacaugauccacuggggcaaggaggccgugaaccacuuccaccugggcgacgacauggaccccgagcuccgggagcuggcccaggcgcugguggacgccaaggucaaggagaucagcaaccaggagccgcucaagcuguga

SEQ ID NO: 6433 - RNA, 1302 nt, Artificial Sequence
  derived and/or modified CDS sequence (opt1) from PUUV(K27)__L08804.1__N
augagcgaccugaccgacauccaggaggagaucacccgccacgagcagcagcucguggucgcccggcagaagcugaaggacgccgagcgcgcgguggagguguaccccgacgacgucaucaagaacacgcugcaggcccggcagcagaccguguccgcccucgaggacaagcuggccgacuacaagcgccggauggccgacgcggugagccgcaagaagauggacaccaagccgaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucaccaucccgaucauccugaaggcccucuacaugcugagcacgcgggggcgccagaccgugaaggagaacaagggcacccggauccgcuucaaggacgacaccuccuucgaggacaucaacggcauccggcgccccaagcaccuguacgugagcaugcccacggcgcaguccaccaugaaggccgaggagcucacccccgggcgguuccgcaccaucgucugcggccuguucccgacgcagauccaggugcggaacaucaugagccccgugaugggggucaucggcuucuccuucuucgugaaggacuggcccgagaagauccgcgaguucauggagaaggagugccccuucaucaagccggaggugaagcccgggacccccgcccaggaggucgaguuccugaagcggaaccgcguguacuucaugacccggcaggacgugcucgacaagaaccacgucgccgacaucgacaagcugaucgacuacgccgcgagcggcgaccccaccuccccggacgacaucaagagccccaacgcccccuggguguucgccugcgcccccgaccgcuccccgcccacgugcaucuacguggccggcauggcggagcugggggccuucuucagcauccuccaggacaugcgcaacaccaucauggccuccaagaccgucggcaccgccgaggagaagcugaagcgcaagagcuccuucuaccagagcuaccugcggcggacgcagagcauggggauccagcucgaccagcgcaucauccugcuguacaugcucgaguggggcaaggagaugguggaccacuuccaccugggcgacgacauggaccccgagcugcgggggcucgcccagucccugaucgaccagaaggucaaggagaucagcaaccaggagccccugaagaucuga

SEQ ID NO: 6434 - RNA, 1302 nt, Artificial Sequence
  derived and/or modified CDS sequence (opt1) from PUUV(KS13/855)__KX815394.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacugggccgagcggauccgcgaguucauggagaaggagugccccuucaucaagcccgaggugaagccggggacccccgcccaggagguggaguuccucaagaagaacaaggucuacuucaugcagcggcaggacgugcuggacaagaaccacguggccgacaucgacaagcugaucgacuacgcggccagcggcgaccccaccucccccgacaacaucgagagcccgaacgcccccugggucuucgccugcgcccccgaccgcugcccgccgaccugcaucuacguggcgggcauggccgagcucggggccuucuucuccauccugcaggacaugcggaacacgaucauggccagcaagaccgugggcaccgccgaggagaagcugaagaagaaguccagcuucuaccaguccuaccuccgccgcacccagagcauggggauccagcuggaccagcggaucauccugcucuacaugcuggaguggggcaaggagauggucgaccacuuccaccugggcgacgacauggaccccgagcuccgcgggcuggcgcaggcccugaucgaccagaaggugaaggagaucagcaaccaggagccccucaagaucuga

SEQ ID NO: 6435 - RNA, 1302 nt, Artificial Sequence
  derived and/or modified CDS sequence (opt1) from PUUV(KS14/118)__KX815395.1__N
augagcgaccugaccgacauccaggaggacaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuucaagcgccggauggccgacgcggugagccgcaagaagauggacaccaagcccaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucaccaucccgaucauccugaaggcccucuacaugcugagcacgcgggggcgccagaccgugaaggagaacaagggcacccggauccgcuucaaggacgacaccuccuucgaggacaucaacggcauccggcgccccaagcaccuguacgugagcaugcccacggcgcaguccaccaugaaggccgaggagcucacccccgggcgguuccgcaccaucgucugcggccuguucccgacgcagauccaggugcggaacaucaugagccccgugaugggggucaucggcuucuccuucuucgugaagaacuggcccgagcgcaucaaggaguucauggagaaggagugccccuucaucaagccggaggugaagcccgggacccccgcccaggaggucgaguuccugaagcggaacaagguguacuucaugaaccgccaggacgugcucgacaagaaccacgucgccgacaucgacaagcugaucgacuacgccgcgagcggcgaccccaccuccccggacgacaucgagagccccaacgcccccuggguguucgccugcgcccccgaccggugcccgccgaccugcaucuacguggccggcauggcggagcugggggccuucuucuccauccuccaggacaugcgcaacacgaucauggccagcaagaccgucggcaccgccgaggagaagcugaagaagaaguccagcuucuaccaguccuaccugcgccggacccagagcauggggauccagcucgaccagcgcaucauccugcuguacaugcucgaguggggcaaggagaugguggaccacuuccaccugggcgacgacauggaccccgagcugcgggggcucgcccaggcgcugaucgaccagaaggucaaggagaucagcaaccaggagccccugaagaucuga

SEQ ID NO: 6436 - RNA, 1302 nt, Artificial Sequence
  derived and/or modified CDS sequence (opt1) from PUUV(LT15/201)__KX757841.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagcccaucgaccccaccggcaucgagcccgacgaccaccugaaggagcgcuccagccuccgguacgggaacgugcuggacgucaacgccaucgacaucgaggagcccuccggccagacggccgacugguacaccaucgggguguacgugaucggcuucacccugccgaucauccucaaggcccuguacaugcugagcacccgcgggcggcagacggucaaggagaacaagggcacccgcauccgguucaaggacgacaccuccuucgaggacaucaacggcauccgccggcccaagcaccucuacgugagcaugcccaccgcgcaguccacgaugaaggccgaggagcugacccccgggcgcuuccggaccaucgugugcggccuguucccgacccagauccagguccgcaacaucaugagccccgugaugggggugaucggcuucuccuucuucgucaaggacugggccgagcggauccgcgaguucauggagaaggagugccccuucaucaagcccgaggugaagccggggacgcccgcccaggagguggaguuccucaagaagaacaaggucuacuucaugcagcggcaggacgugcuggacaagaaccacguggccgacaucgacaagcugaucgacuacgcggccagcggcgaccccaccucccccgacaacaucgagagcccgaacgcccccugggucuucgccugcgcccccgaccgcugcccgccgaccugcaucuacguggcgggcauggccgagcucggggccuucuucuccauccugcaggacaugcggaacaccaucauggccagcaagacggugggcaccgccgaggagaagcugaagaagaaguccagcuucuaccaguccuaccuccgccgcacccagagcauggggauccagcuggaccagcggaucauccugcucuacaugcuggaguggggcaaggagauggucgaccacuuccaccugggcgacgacauggaccccgagcuccgcgggcuggcgcaggcccugaucgaccagaaggugaaggagaucagcaaccaggagccccucaagaucuga

SEQ ID NO: 6437 - RNA, 1302 nt, Artificial Sequence
  derived and/or modified CDS sequence (opt1) from PUUV(PUU/Ernstbrunn/Cg641/1995)__AJ888752.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcaucaagcgccccaagcaccucuacgugagcaugcccacggcgcaguccaccaugaaggccgagaagcugacccccgggcgguuccgcaccaucgugugcggccuguucccgacgcagauccagguccggaacaucaugagccccgugaugggggugaucggcuucuccuucuucgucaaggacuggagcgagcgcgugcgggacuucauggagaaggagugccccuucaucaagcccgagaucaagccggggaccccgccccaggaggccgaguuccucaagcgcaacaagguguacuucaugcagcggcaggacguccuggacaagaaccacguggccgacaucgacaagcugaucgacuacgccgcguccggcgaccccaccagccccgacaaccucgagucccccaacgcccccuggguguucgccugcgcccccgaccgcugcccgccgaccugcaucuacgucgccggcauggcggagcugggggccuucuucagcauccugcaggacaugcggaacacgaucauggccuccaagaccgugggcaccgccgaggagaagcucaagaagaaguccagcuucuaccagagcuaccugcgccgcacccagagcauggggauccagcuggaccagcggaucauccuccuguacaugcuggaguggggcaaggagaugguggaccacuuccaccucggcgacgacauggaccccgagcugcgcgggcuggcccaggcgcucaucgaccagaaggucaaggagaucuccaaccaggagccccugaagaucuga

SEQ ID NO: 6438 - RNA, 1302 nt, Artificial Sequence
  derived and/or modified CDS sequence (opt1) from PUUV(PUU/Klippitztoerl/Cg9/1995)__AJ888751.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccggcgggcagaccgccgacugguacaccaucggcguguacgugaucggguucacccugccgaucauccucaaggcccuguacauguucuccacgcgcggccggcagaccgucaaggagaacaagggcacccgcauccgguucaaggacgacaccagcuucgaggacaucaacgggauccgccggcccaagcaccuguacguguccaugcccacggcgcagagcaccaugaaggccgaggagcucacccccggccgcuuccggaccaucgugugcgggcuguucccgacgcagauccagguccgcaacaucaugucccccgugaugggcgugaucggguucagcuucuucgucaaggacugguccgagcgggugcgcgacuucauggagaaggagugccccuucaucaagcccgagaucaagccgggcaccccgccccaggaggccgaguuccugaagcggaacaagguguacuucaugcagcgccaggacguccucgacaagaaccacguggccgacaucgacaagcugaucgacuacgccgcgagcggcgaccccaccucccccgacaaccuggagagccccaacgcccccuggguguucgccugcgcccccgaccggugcccgccgaccugcaucuacgucgccgggauggcggagcucggcgccuucuucuccauccugcaggacaugcgcaacacgaucauggccagcaagaccguggggaccgccgaggagaagcugaagaagaaguccagcuucuaccaguccuaccuccgccggacccagagcaugggcauccagcuggaccagcgcaucauccugcucuacaugcuggaguggggcaaggagaugguggaccacuuccaccugggggacgacauggaccccgagcuccggggccuggcccaggcgcugaucgaccagaaggucaaggagaucagcaaccaggagccccucaagaucuga

SEQ ID NO: 6439 - RNA, 1302 nt, Artificial Sequence
  derived and/or modified CDS sequence (opt1) from PUUV(Balkan-1)__AJ314600.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacuggagcgagcgggugcgcgaguucauggagaaggagugccccuucaucaagcccgagaucaagccggggaccccgccccaggaggccgaguuccucaagcggaacaagguguacuucaugcagcgccaggacguccuggacaagaaccacguggccgacaucgacaagcugcucgacuacgccgcguccggcgaccccaccagccacgacaacaucgagucccccaacgcccccuggguguucgccugcgcccccgaccggugcccgccgaccugcaucuacgucgccggcauggcggagcugggggccuucuucagcauccugcaggacaugcgcaacacgaucauggccuccaagaccgugggcaccgccgaggagaagcucaagaagaaguccagcuucuaccagagcuaccugcgccggacccagagcauggggauccagcuggaccagcgcaucauccuccuguacaugcuggaguggggcaaggagaugguggaccacuuccaccucggcgacgacauggaccccgagcugcgggggcuggcccaggcgcucaucgaccagaaggucaaggagaucuccaaccaggagccccugaagaucuga

SEQ ID NO: 6440 - RNA, 1302 nt, Artificial Sequence
  derived and/or modified CDS sequence (opt1) from PUUV(Balkan-2)__AJ314601.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucguguucggccuguucccgacgcagauccagguccgcaacaucaugagccccgugaugggggugaucggcuucuccuucuucgucaaggacuggagcgagcgggugcgcgaguucauggagaaggagugccccuucaucaagcccgagaucaagccgggggccccgccccaggaggccgaguuccucaagcggaacaagguguacuucaugcagcgccaggacguccuggacaagaaccacguggccgacaucgacaagcugaucgacuacgcggccuccggcgaccccaccagccccgacaacaucgagucccccaacgcccccuggguguucgccugcgcccccgaccggugcccgccgaccugcaucuacgucgcgggcauggccgagcucggggccuucuucagcauccugcaggacaugcgcaacaccaucauggccuccaagacggugggcaccgccgaggagaagcugaagaagaaguccagcuucuaccagagcuaccuccgccggacccagagcauggggauccagcuggaccagcgcaucauccugcucuacaugcuggaguggggcaaggagaugguggaccacuuccaccugggcgacgacauggaccccgagcuccgggggcuggcgcaggcccugaucgaccagaaggucaaggagaucuccaaccaggagccccucaagaucuga

SEQ ID NO: 6441 - RNA, 1302 nt, Artificial Sequence
  derived and/or modified CDS sequence (opt1) from PUUV(Baltic/205Cg/00)__AJ314599.1__N
augagcgaccuggccgacauccaggaggacaucacccgccacgagcagcagcucguggucgcccggcagaagcugaaggacgcggagcgcgccguggagguggaccccgacgacgucaacaagaacacccugcaggcccggcagcagacgguguccgcccucgaggacaagcuggccgacuacaagcgccggauggcggacgccgugagccgcaagaagauggacaccaagcccaccgaccccaccggcaucgagcccgacgaccaccugaaggagcgguccagccuccgcuacgggaacguccuggacgugaacgccaucgacaucgaggagcccuccggccagacggccgacugguacaccaucgggguguacgucaucggcuucacccugccgaucauccucaaggcgcuguacaugcugagcacccgggggcgccagacggugaaggagaacaagggcacccggauccgcuucaaggacgacaccuccuucgaggacaucaacggcauccggcgccccaagcaccucuacgugagcaugcccaccgcccaguccacgaugaaggccgaggagcugacccccgggcgguuccgcaccaucgucugcggccuguucccgacccagauccaggugcggaacaucaugagccccgugaugggggucaucggcuucuccuucuucgugaaggacuggcccgagcgcaucaaggaguucauggagaaggagugccccuucaucaagccggaggugaagcccgggacgcccacccaggaggucgaguuccucaagcggaacaagguguacuucaugaaccgccaggacgugcuggacaagaaccacgucgccgacaucgacaagcugaucgacuacgccgcgagcggcgaccccaccuccccggacgacaucgagagccccaacgcccccuggguguucgccugcgcccccgaccggugcccgccgaccugcaucuacguggccggcauggcggagcucggggccuucuucuccauccugcaggacaugcgcagcacgaucauggccuccaagaccgucggcaccgccgaggagaagcugaagaagaaguccagcuucuaccagagcuaccuccgccggacccagagcauggggauccagcuggaccagcgcaucauccugcucuacaugcuggaguggggcaaggagaugguggaccacuuccaccugggcgacgacauggaccccgagcuccgggggcuggcccaggcgcugaucgaccagaaggucaaggagaucuccaaccaggagccccucaagaucuga

SEQ ID NO: 6442 - RNA, 1302 nt, Artificial Sequence
  derived and/or modified CDS sequence (opt1) from PUUV(Baltic/49Cg/00)__AJ314598.1__N
augagcgaccuggccgacauccaggaggacaucacccgccacgagcagcagcucguggucgcccggcagaagcugaaggacgcggagcgcgccguggagguggaccccgacgacgucaacaagaacacccugcaggcccggcagcagacgguguccgcccucgaggacaagcuggccgacuacaagcgccggauggcggacgccgugagccgcaagaagauggacaccaagcccaccgaccccaccggcaucgagcccgacgaccaccugaaggagcgguccagccuccgcuacgggaacguccuggacgugaacgccaucgacaucgaggagcccuccggccagacggccgacugguacaccaucgggguguacgucaucggcuucacccugccgaucauccucaaggcgcuguacaugcugagcacccgggggcgccagacggugaaggagaacaagggcacccggauccgcuucaaggacgacaccuccuucgaggacaucaacggcauccggcgccccaagcaccucuacgugagcaugcccaccgcccaguccacgaugaaggccgaggagcugacccccgggcgguuccgcaccaucgucugcggccuguucccgacccagauccaggugcggaacaucaugagccccgugaugggggucaucggcuucuccuucuucgugaaggacuggcccgagcgcaucaaggaguucauggagaaggagugccccuucaucaagccggaggugaagcccgggacgcccgcccaggaggucgaguuccucaagcggaacaagguguacuucaugaaccgccaggacgugcuggacaagaaccacgucgccgacaucgacaagcugaucgacuacgcggccagcggcgaccccaccuccccggacgacaucgagagccccaacgcccccuggguguucgccugcgcccccgaccggugcccgccgaccugcaucuacguggcgggcauggccgagcucggggccuucuucuccauccugcaggacaugcgcaacaccaucauggccagcaagacggucggcaccgccgaggagaagcugaagaagaaguccagcuucuaccaguccuaccuccgccggacccagagcauggggauccagcuggaccagcgcaucauccugcucuacaugcuggaguggggcaaggagaugguggaccacuuccaccugggcgacgacauggaccccgagcuccgggggcuggcgcaggcccugaucgaccagaaggucaaggagaucagcaaccaggagccccucaagaucuga

SEQ ID NO: 6443 - RNA, 1302 nt, Artificial Sequence
  derived and/or modified CDS sequence (opt1) from PUUV(Pallasjarvi/63Cg/98)__AJ314597.1__N
augagcgaccugaccgacauccaggaggacaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgccggauggccgacgcggugagccgcaagaagauggacaccaagcccaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucacccugccgaucauccucaaggcccuguacaugcugagcacgcgggggcgccagaccgugaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgucugcggccuguucccgacgcagauccaggugcggaacaucaugagccccgugaugggggucaucggcuucuccuucuucgugaaggacuggagcgagcgcauccgggaguucauggagaaggagugccccuucaucaagcccgaggugaagccggggacccccgcccaggaggucgagaugcucaagcgcaacaagaucuacuucaugcagcggcaggacgugcuggacaagaaccacguggccgacaucgacaagcugaucgacuacgccgcguccggcgaccccaccagccccgacaacaucgacuccccgaacgcccccugggucuucgccugcgcccccgaccgcugcccgccgaccugcaucuacguggccggcauggcggagcucggggccuucuucagcauccugcaggacaugcgcaacacgaucauggccuccaagaccgugggcaccgccgaggagaagcugaagaagaaguccagcuucuaccagagcuaccuccggcgcacccagagcauggggauccagcuggaccagcggaucauccuccuguucaugcuggaguggggcaaggagauggucgaccacuuccaccugggcgacgacauggaccccgagcuccgcgggcuggcccaggcgcugaucgaccagaaggugaaggagaucuccaaccaggagccccucaagaucuga

SEQ ID NO: 6444 - RNA, 1302 nt, Artificial Sequence
  derived and/or modified CDS sequence (opt1) from PUUV(Sotkamo 2009)__HE801633.1__N
augagcgaccugaccgacauccaggaggacaucacccgccacgagcagcagcucaucguggcccggcagaagcugaaggacgccgagcgcgcggucgagguggaccccgacgacgugaacaagaacacgcugcaggcccggcagcagaccgucuccgcccucgaggacaagcuggccgacuacaagcgccggauggccgacgcggugagccgcaagaagauggacaccaagcccaccgaccccacgggcaucgagcccgacgaccaccugaaggagcgguccagccuccgcuacgggaacgugcuggacgucaacgccaucgacaucgaggagcccuccggccagaccgccgacugguacaccaucgggguguacgugaucggcuucacccugccgaucauccucaaggcccuguacaugcugagcacgcgggggcgccagaccgucaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgugugcggccuguucccgacgcagauccagguccggaacaucaugagccccgugaugggggugaucggcuucuccuucuucgucaaggacuggagcgagcgcauccgggaguucauggagaaggagugccccuucaucaagcccgaggugaagccggggacccccgcccaggagaucgagaugcucaagcgcaacaagaucuacuucaugcagcggcaggacgugcuggacaagaaccacgucgccgacaucgacaagcugaucgacuacgccgcguccggcgaccccaccagccccgacaacaucgacuccccgaacgcccccuggguguucgccugcgcccccgaccgcugcccgccgaccugcaucuacguggccggcauggcggagcucggggccuucuucagcauccugcaggacaugcgcaacacgaucauggccuccaagaccgucggcaccgccgaggagaagcugaagaagaaguccagcuucuaccagagcuaccuccggcgcacccagagcauggggauccagcuggaccagcggaucauccuccuguucaugcuggaguggggcaaggagaugguggaccacuuccaccugggcgacgacauggaccccgagcuccgcgggcuggcccaggcgcugaucgaccagaaggugaaggagaucuccaaccaggagccccucaagaucuga

SEQ ID NO: 6445 - RNA, 1302 nt, Artificial Sequence
  derived and/or modified CDS sequence (opt1) from PUUV(CG 13891)__U22423.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcagauggccgacgcggugagccgcaagaagauggacaccaagccgaccgaccccacgggcaucgagcccgacgaccaccugaaggagcgguccagccuccgcuacgggaacgugcuggacgucaacgccaucgacaucgaggagcccuccggccagaccgccgacugguacaccaucgggguguacgugaucggcuucacccugccgaucauccucaaggcccuguacaugcugagcacgcgggggcgccagaccgucaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgugugcggccuguucccgacgcagauccagguccggaacaucaugagccccgugaugggggugaucggcuucuccuucuucgucaaggacugggccgaccgcauccgggagagcauggagaaggagugccccuuccucaagcccgacgugaagccggggacccccgcccaggagaccgaguuccugaagcgcaacaagaucuacuucaugcagcggcaggaggugcuggacaagaaccacgucgccgagaucgacaagcucaucgacuacgcggccuccggcgaccccaccagccccgacaacaucgaguccccgaacgcccccuggguguucgccugcgcccccgaccgcugcccgcccacgugcaucuacguggcgggcauggccgagcugggggccuucuucagcauccugcaggacaugcggaacaccaucauggccuccaagaccgucggcaccgccgaggagaagcucaagaagaaguccagcuucuaccagagcuaccugcgccgcacgcagagcauggggauccagcuggaccagcggaucauccuccuguacaugcuggaguggggcaaggagaugguggaccacuuccaccucggcgacgacauggaccccgagcugcgcgggcuggcgcaggcccucaucgaccagaaggugaaggagaucuccaaccaggagccccugaagaucuga

SEQ ID NO: 6446 - RNA, 1302 nt, Artificial Sequence
  derived and/or modified CDS sequence (opt1) from PUUV(CG1820)__M32750.1__N
augagcgaccugaccgacauccaggaggagaucacccgccacgagcagcagcucguggucgcccggcagaagcugaaggacgccgagcgcgcgguggagguggaccccgacgacgucaacaaguccacgcugcaggcccggcagcagaccgugagcgcccucgaggacaagcuggccgacuacaagcgccggauggccgacgcggugucccgcaagaagauggacaccaagccgaccgaccccacgggcaucgagcccgacgaccaccugaaggagcggagcucccuccgcuacgggaacguccuggacgugaacgccaucgacaucgaggagcccagcggccagaccgccgacugguacaccaucgggguguacgucaucggcuucaccaucccgaucauccugaaggcccucuacaugcuguccacgcgggggcgccagaccgugaaggagaacaagggcacccggauccgcuucaaggacgacaccagcuucgaggacaucaacggcauccggcgccccaagcaccuguacguguccaugcccacggcgcagagcaccaugaaggccgaggagcucacccccgggcgguuccgcaccaucgucugcggccuguucccgacgcagauccaggugcggaacaucaugucccccgugaugggggucaucggcuucagcuucuucgugaaggacuggcccgagaagauccgcgaguucauggagaaggagugccccuucaucaagccggaggugaagcccgggacccccgcccaggaggucgaguuccugaagcggaaccgcguguacuucaugacccggcaggacgugcucgacaagaaccacgucgccgacaucgacaagcugaucgacuacgccgcguccggcgaccccaccagcccggacgacaucgagucccccaacgcccccuggguguucgccugcgcccccgaccgcugcccgcccacgugcaucuacguggccggcauggcggagcugggggccuucuucagcauccuccaggacaugcgcaacaccaucauggccuccaagaccgucggcaccgccgaggagaagcugaagaagaaguccagcuucuaccagagcuaccugcggcgcacgcagagcauggggauccagcucgaccagcggaucauccugcuguacaugcucgaguggggccgcgagaugguggaccacuuccaccugggcgacgacauggaccccgagcugcgggggcucgcccagucccugaucgaccagaaggucaaggagaucagcaaccaggagccccugaagaucuga

SEQ ID NO: 6447 - RNA, 1302 nt, Artificial Sequence
  derived and/or modified CDS sequence (opt1) from PUUV(Bussjo_95-1)__AM746297.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagccgaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacuggcccgaccggauccgcgaguucauggagaaggagugccccuucaucaagccggaggugaagcccgggacccccacccaggagaucgaguuccucaagaagaacaagguguacuucauggaccggcagaacguccuggacaagaaccacguggccgacaucgacaagcugaucgacuacgccgccagcggcgaccccaccuccccggacaacaucgagagccccaacgcgcccuggguguucgccugcgcccccgaccgcugcccgcccacgugcaucuacgucgccggcauggccgagcucggggcguucuucuccauccugcaggacaugcggaacaccaucauggccagcaagaccgugggcaccgccgaggagaagcugaagaagaaguccagcuucuaccaguccuaccuccgccgcacgcagagcauggggauccagcuggaccagcggaucauccugcucuacaugcuggaguggggcaaggagaugguggaccacuuccaccugggcgacgacauggaccccgagcuccgcgggcuggcccaggcccugaucgaccagaaggucaaggagaucagcaaccaggacccccucaagaucuga

SEQ ID NO: 6448 - RNA, 1302 nt, Artificial Sequence
  derived and/or modified CDS sequence (opt1) from PUUV(CG144)__AF367064.1__N
augagcgaccugaccgacauccaggaggacaucacccgccacgagcagcagcucguggccgcccggcagaagcugaaggacgcggagcgcgccgucgagauggaccccgacgacgugaacaagaacacgcugcaggcccggcagcagaccguguccgcccucgaggacaagcuggccgacuacaagcgccggauggcggacgccgucagccgcaagaagauggacaccaagcccgccgaccccaccggcaucgagcccgacgaccaccugaaggagcgguccagccuccgcuacgggaacgugcuggacgugaacgccaucgacaucgaggagcccuccggccagacggcggacugguacaccaucgggaucuacgucaucggcuucacccugccgaucauccucaaggcccuguacaugcugagcacccgggggcgccagacggugaaggagaacaagggcacccggauccgcuucaaggacgacaccuccuucgaggacaucaacggcauccggcgccccaagcaccucuacgugagcaugcccaccgcccaguccacgaugaaggccgaggagcugacccccgggcgguuccgcaccaucgucugcggccuguucccgacccagauccaggugcggaacaucaugagccccgugaugggggucaucggcuucuccuucuucgugaaggacuggcccgagcgcauccgggaguucauggagaaggagugccccuucaucaagccggaggugaagcccgggacgcccgcccaggagaucgagaugcucaagaagaacaagaucuacuucaugcaccgccaggacguccuggacaagaaccacguggcggacaucgacaagcugaucgacuacgccgccagcggcgaccccaccuccccggacaacaucgacagccccaacgcccccuggguguucgccugcgcgcccgaccggugcccgccgaccugcaucuacgucgccggcauggccgagcucggggccuucuucuccauccugcaggacaugcgcaacaccaucauggccagcaagacggugggcaccgcggaggagaagcugaagaagaaguccagcuucuaccaguccuaccuccgccggacccagagcauggggauccagcuggaccagcgcaucauccugcucuacaugcuggaguggggcaaggagaugguggaccacuuccaccugggcgacgacauggaccccgagcuccgggggcuggcccaggcccugaucgaccagaaggucaaggagaucagcaaccaggagccccucaagaucuga

SEQ ID NO: 6449 - RNA, 1302 nt, Artificial Sequence
  derived and/or modified CDS sequence (opt1) from PUUV(CG168)__AF367065.1__N
augagcgaccugaccgacauccaggaggacaucacccgccacgagcagcagcucguggccgcccggcagaagcugaaggacgcggagcgcgccgucgagauggaccccgacgacgugaacaagaacacgcugcaggcccggcagcagaccguguccgcccucgaggacaagcuggccgacuacaagcgccggauggcggacgccgucagccgcaagaagauggacaccaagcccgccgaccccaccggcaucgagcccgacgaccaccugaaggagcgguccagccuccgcuacgggaacgugcuggacgugaacgccaucgacaucgaggagcccuccggccagacggcggacugguacaccaucggggucuacgugaucggcuucacccugccgaucauccucaaggcccuguacaugcugagcacccgggggcgccagacggugaaggagaacaagggcacccggauccgcuucaaggacgacaccuccuucgaggacaucaacggcauccggcgccccaagcaccucuacgucagcaugcccaccgcccaguccacgaugaaggccgaggagcugacccccgggcgguuccgcaccaucgugugcggccuguucccgacccagauccaggugcggaacaucaugagccccgucaugggggugaucggcuucuccuucuucgugaaggacuggcccgagcgcauccgggaguucauggagaaggagugccccuucaucaagccggaggucaagcccgggauccccgcccaggagaucgagaugcucaagaagaacaagaucuacuucaugcaccgccaggacgugcuggacaagaaccacguggcggacaucgacaagcugaucgacuacgccgccagcggcgaccccacguccccggacaacaucgacagccccaacgcccccugggucuucgccugcgcgcccgaccggugcccgccgaccugcaucuacguggccggcauggccgagcucggggccuucuucuccauccugcaggacaugcgcaacaccaucauggccagcaagaccgugggcacggcggaggagaagcugaagaagaaguccagcuucuaccaguccuaccuccgccggacccagagcauggggauccagcuggaccagcgcaucauccugcucuacaugcuggaguggggcaaggagauggucgaccacuuccaccugggcgacgacauggaccccgagcuccgggggcuggcccaggcccugaucgaccagaaggugaaggagaucagcaaccaggagccccucaagaucuga

SEQ ID NO: 6450 - RNA, 1302 nt, Artificial Sequence
  derived and/or modified CDS sequence (opt1) from PUUV(CG17/Baskiria-2001)__AF442613.1__N
augagcgaccuggccgacauccaggaggagaucacccgccacgagcagcagcucguggccgcgcggcagaagcugaaggacgccgagcgcgccgucgagguggaccccgacgacgugaacaagaacacccugcaggcccggcagcagacggucuccgcccucgaggacaagcuggcggacuacaagcgccggauggccgacgccgugagccgcaagaagauggacaccaagcccaccgaccccaccggcaucgagcccgacgaccaccugaaggagcgguccagccuccgcuacgggaacgugcuggacgucaacgccaucgacaucgaggagcccuccggccagacggcggacugguacaccaucgggguguacgugaucggcuucaccaucccgaucauccugaaggcccucuacaugcugagcacccgggggcgccagacggucaaggagaacaagggcacccggauccgcuucaaggacgacaccuccuucgaggacaucaacggcauccggcgccccaagcaccuguacgugagcaugcccaccgcccaguccacgaugaaggccgaggagcucacccccgggcgguuccgcaccaucgugugcggccuguucccgacccagauccagguccggaacaucaugagccccgugaugggggugaucggcuucuccuucuucgucaaggacuggcccgagaagauccgcgaguucauggagaaggagugccccuucaucaagccggaggugaagcccgggacgcccgcccaggagguggaguuccugaagcggaaccgcgucuacuucaugacccggcaggacgugcucgacaagaaccacguggcggacaucgacaagcugaucgacuacgccgccagcggcgaccccaccuccccggacgacaucgagagccccaacgcccccugggucuucgccugcgcgcccgaccgcugcccgccgaccugcaucuacguggccggcauggccgagcugggggccuucuucuccauccuccaggacaugcgcaacacgaucauggccagcaagaccgugggcaccgcggaggagaagcugaagaagaaguccagcuucuaccaguccuaccugcggcgcacccagagcauggggauccagcucgaccagcggaucauccugcuguacaugcucgaguggggcaaggagauggucgaccacuuccaccugggcgacgacauggaccccgagcugcgcgggcucgcccagagccugaucgaccagaaggugaaggagaucuccaaccaggagccccugaagaucuga

SEQ ID NO: 6451 - RNA, 1302 nt, Artificial Sequence
  derived and/or modified CDS sequence (opt1) from PUUV(CG215)__AF367066.1__N
augagcgaccugaccgacauccaggaggacaucacccgccacgagcagcagcucguggccgcccggcagaagcugaaggacgcggagcgcgccgucgagauggaccccgacgacgugaacaagaacacgcugcaggcccggcagcagaccguguccgcccucgaggacaagcuggccgacuacaagcgccggauggcggacgccgucagccgcaagaagauggacaccaagcccgccgaccccaccggcaucgagcccgacgaccaccugaaggagcgguccagccuccgcuacgggaacgugcuggacgugaacgccaucgacaucgaggagcccuccggccagacggcggacugguacaccaucggggucuacgugaucggcuucacccugccgaucauccucaaggcccuguacaugcugagcacccgggggcgccagacggugaaggagaacaagggcacccggauccgcuucaaggacgacaccuccuucgaggacaucaacggcauccggcgccccaagcaccucuacgucagcaugcccaccgcccaguccacgaugaaggccgaggagcugacccccgggcgguuccgcaccaucgugugcggccuguucccgacccagauccaggugcggaacaucaugagccccgucaugggggugaucggcuucuccuucuucgugaaggacuggcccgagcgcauccgggaguucauggagaaggagugccccuucaucaagccggaggucaagcccgggacgcccgcccaggagaucgagaugcucaagaagaacaagaucuacuucaugcaccgccaggacgugcuggacaagaaccacguggcggacaucgacaagcugaucgacuacgccgccagcggcgaccccaccuccccggacaacaucgacagccccaacgcccccugggucuucgccugcgcgcccgaccggugcccgccgaccugcaucuacguggccggcauggccgagcucggggccuucuucuccauccugcaggacaugcgcaacaccaucauggccagcaagacggugggcaccgcggaggagaagcugaagaagaaguccagcuucuaccaguccuaccuccgccggacccagagcauggggauccagcuggaccagcgcaucauccugcucuacaugcuggaguggggcaaggagauggucgaccacuuccaccugggcgacgacauggaccccgagcuccgggggcuggcccagacccugaucgaccagaaggugaaggagaucagcaaccaggagccccucaagaucuga

SEQ ID NO: 6452 - RNA, 1302 nt, Artificial Sequence
  derived and/or modified CDS sequence (opt1) from PUUV(CG315)__AF367068.1__N
augagcgaccugaccgacauccaggaggacaucacccgccacgagcagcagcucguggccgcccggcagaagcugaaggacgcggagcgcgccgucgagauggaccccgacgacgugaacaagaacacgcugcaggcccggcagcagaccguguccgcccucgaggacaagcuggccgacuacaagcgccggauggcggacgccgucagccgcaagaagauggacaccaagcccgccgaccccaccggcaucgagcccgacgaccaccugaaggagcgguccagccuccgcuacgggaacgugcuggacgugaacgccaucgacaucgaggagcccuccggccagacggcggacugguacaccaucggggucuacgugaucggcuucacccugccgaucauccucaaggcccuguacaugcugagcacccgggggcgccagacggugaaggagaacaagggcacccggauccgcuucaaggacgacaccuccuucgaggacaucaacggcauccggcgccccaagcaccucuacgucagcaugcccaccgcccaguccacgaugaaggccgaggagcugacccccgggcgguuccgcaccaucgugugcggccuguucccgacccagauccaggugcggaacaucaugagccccgucaugggggugaucggcuucuccuucuucgugaaggacuggcccgagcgcauccgggaguucauggagaaggagugccccuucaugaagccggaggucaagcccgggacgcccgcccaggagaucgagaugcucaagaagaacaagaucuacuucaugcaccgccaggacgugcuggacaagaaccacguggcggacaucgacaagcugaucgacuacgccgccagcggcgaccccaccuccccggacaacaucgacagccccaacgcccccugggucuucgccugcgcgcccgaccggugcccgccgaccugcaucuacguggccggcauggccgagcucggggccuucuucuccauccugcaggacaugcgcaacaccaucauggccagcaagacggugggcaccgcggaggagaagcugaagaagaaguccagcuucuaccaguccuaccuccgccggacccagagcauggggauccagcuggaccagcgcaucauccugcucuacaugcuggaguggggcaaggagauggucgaccacuuccaccugggcgacgacauggaccccgagcuccgggggcuggcccaggcccugaucgaccagaaggugaaggagaucagcaaccaggagccccucaagaucuga

SEQ ID NO: 6453 - RNA, 1302 nt, Artificial Sequence
  derived and/or modified CDS sequence (opt1) from PUUV(CRF161)__AF367069.1__N
augagcgaccugaccgacauccaggaggacaucacccgccacgagcagcagcucguggccgcccggcagaagcugaaggacgcggagcgcgccgucgagauggaccccgacgacgugaacaagaacacgcugcaggcccggcagcagaccguguccgcccucgaggacaagcuggccgacuacaagcgccggauggcggacgccgucagccgcaagaagauggacaccaagcccgccgaccccaccggcaucgagcccgacgaccaccugaaggagcgguccagccuccgcuacgggaacgugcuggacgugaacgccaucgacaucgaggagcccuccggccagacggcggacugguacaccaucggggucuacgugaucggcuucacccugccgaucauccucaaggcccuguacaugcugagcacccgggggcgccagacggugaaggagaacaagggcacccggauccgcuucaaggacgacaccuccuucgaggacaucaacggcauccggcgccccaagcaccucuacgucagcaugcccaccgcccaguccacgaugaaggccgaggagcugacccccgggcgguuccgcaccaucgugugcggccuguucccgacccagauccaggugcggaacaucaugagccccgucaugggggugaucggcuucuccuucuucgugaaggacuggcccgagcgcauccgggaguucauggagaaggagugccccuucaucaagccggaggucaagcccgggacgcccgcccaggagaucgagaugcucaagaagaacaagaucuacuucaugcaccgccaggacgugcuggacaagaaccacguggcggacaucgacaagcugaucgacuacgccgccagcggcgaccccaccuccccggacaacaucgacagccccaacgcccccugggucuucgccugcgcgcccgaccggugcccgccgaccugcaucuacguggccggcauggccgagcucggggccuucuucuccauccugcaggacaugcgcaacaccaucauggccagcaagacggugggcaccgcggaggagaagcugaagaagaaguccagcuucuaccaguccuaccuccgccggacccagagcauggggauccagcuggaccagcgcaucauccugcucuacaugcuggaguggggcaaggagauggucgaccacuuccaccugggcgacgacauggaccccgagcuccgggggcuggcccaggcccugaucgaccagaaggugaaggagaucagcaaccaggagccccucaagaucuga

SEQ ID NO: 6454 - RNA, 1302 nt, Artificial Sequence
  derived and/or modified CDS sequence (opt1) from PUUV(CRF308)__AF367070.1__N
augagcgaccugaccgacauccaggaggacaucacccgccacgagcagcagcucguggccgcccggcagaagcugaaggacgcggagcgcgccgucgagauggaccccgacgacgugaacaagaacacgcugcaggcccggcagcagaccguguccgcccucgaggacaagcuggccgacuacaagcgccggauggcggacgccgucagccgcaagaagauggacaccaagcccgccgaccccaccggcaucgagcccgacgaccaccugaaggagcgguccagccuccgcuacgggaacgugcuggacgugaacgccaucgacaucgaggagcccuccggccagacggcggacugguacaccaucggggucuacgugaucggcuucacccugccgaucauccucaaggcccuguacaugcugagcacccgggggcgccagacggugaaggagaacaagggcacccggauccgcuucaaggacgacaccuccuucgaggacaucaacggcauccggcgccccaagcaccucuacgucagcaugcccaccgcccaguccacgaugaaggccgaggagcugacccccgggcgguuccgcaccaucgugugcggccuguucccgacccagauccaggugcggaacaucaugagccccgucaugggggugaucggcuucuccuucuucgugaaggacuggcccgagcgcauccgggaguucauggagaaggagugccccuucaucaagccggaggucaagcccgggacgcccgcccaggagaucgagaugcucaagaagaacaagaucuacuucaugcaccgccaggacgugcuggacaagaaccacguggcggacauggacaagcugaucgacuacgccgccagcggcgaccccaccuccccggacaacaucgacagccccaacgcccccugggucuucgccugcgcgcccgaccggugcccgccgaccugcaucuacguggccggcauggccgagcucggggccuucuucuccauccugcaggacaugcgcaacaccaucauggccagcaagacggugggcaccgcggaggagaagcugaagaagaaguccagcuucuaccaguccuaccuccgccggacccagagcauggggauccagcuggaccagcgcaucauccugcucuacaugcuggaguggggcaaggagauggucgaccacuuccaccugggcgacgacauggaccccgagcuccgggggcuggcccaggcccugaucgaccagaaggugaaggagaucagcaaccaggagccccucaagaucuga

SEQ ID NO: 6455 - RNA, 1302 nt, Artificial Sequence
  derived and/or modified CDS sequence (opt1) from PUUV(CRF366)__AF367071.1__N
augaccgaccugaccgacauccaggaggacaucacgcgccacgagcagcagcucguggccgcccggcagaagcugaaggacgcggagcgcgccgucgagauggaccccgacgacgugaacaagaacacccugcaggcccggcagcagaccgugagcgcccucgaggacaagcuggccgacuacaagcgccggauggcggacgccgucucccgcaagaagauggacaccaagccggccgaccccacgggcaucgagcccgacgaccaccugaaggagcggagcucccuccgcuacgggaacgugcuggacgugaacgccaucgacaucgaggagcccagcggccagaccgcggacugguacaccaucgggaucuacgucaucggcuucacccugccgaucauccucaaggcccuguacaugcuguccacgcgggggcgccagaccgugaaggagaacaagggcacccggauccgcuucaaggacgacaccagcuucgaggacaucaacggcauccggcgccccaagcaccucuacguguccaugcccacggcccagagcaccaugaaggccgaggagcugacccccgggcgguuccgcaccaucgucugcggccuguucccgacgcagauccaggugcggaacaucaugucccccgugaugggggucaucggcuucagcuucuucgugaaggacuggcccgagcgcauccgggaguucauggagaaggagugccccuucaucaagccggaggugaagcccgggacccccgcccaggagaucgagaugcucaagaagaacaagaucuacuucaugcaccgccaggacguccuggacaagaaccacguggcggacaucgacaagcugaucgacuacgccgccuccggcgaccccaccagcccggacaacaucgacucccccaacacccccuggguguucgccugcgcccccgaccggugcccgcccacgugcaucuacgucgcgggcauggccgagcucggggccuucuucagcauccugcaggacaugcgcaacaccaucauggccuccaagaccgugggcaccgccgaggagaagcugaagaagaaguccagcuucuaccagagcuaccuccgccggacgcaguccauggggauccagcuggaccagcgcaucauccugcucuacaugcuggaguggggcaaggagaugguggaccacuuccaccugggcgacgacauggaccccgagcuccgggggcuggcgcaggcccugaucgaccagaaggucaaggagaucagcaaccaggagccccucaagaucuga

SEQ ID NO: 6456 - RNA, 1302 nt, Artificial Sequence
  derived and/or modified CDS sequence (opt1) from PUUV(Djaknebole_98-1)__AM746310.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagccgaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacugggccgaccggauccgcgaguucauggagaaggagugccccuucaucaagcccgaggugaagccggggacccccacccaggagaucgaguuccucaagaagaacaagguguacuucauggaccggcagaacguccuggacaagaaccacguggccgacaucgacaagcugaucgacuacgccgcgagcggcgaccccaccucccccgacaacaucgagagcccgaacgcccccuggguguucgccugcgcccccgaccgcugcccgcccacgugcaucuacgucgccggcauggcggagcucggggccuucuucuccauccugcaggacaugcggaacaccaucauggccagcaagaccgugggcaccgccgaggagaagcugaagaagaaguccagcuucuaccaguccuaccuccgccgcacgcagagcauggggauccagcuggaccagcggaucauccugcucuacaugcuggaguggggcaaggagaugguggaccacuuccaccugggcgacgacauggaccccgagcuccgcgggcuggcccaggcgcugaucgaccagaaggucaaggagaucagcaaccaggacccccucaagaucuga

SEQ ID NO: 6457 - RNA, 1302 nt, Artificial Sequence
  derived and/or modified CDS sequence (opt1) from PUUV(Fusong 114-05)__EF488804.1__N
augagcgaccugaaggacauccaggaggacaucgcccgccacgagcagcagcucguggucgcccggcagaagcugcgcgacgcggagaaggccguggagauggaccccgacgacgugaacaagaacacccugcaggcccggcagcagaccgucuccgcccucgaggacaagaucgccgacuucaagcgccggauggcggacaucgugagccgcaagaagauggacacgaagccggccgaccccaccggcaucgagcccgacgaccaccugaaggagcgguccagccugcgcuacgggaacgugcucgacgucaacgccaucgacaucgaggagcccuccggccagaccgccgacugguacaccaucgggguguacaucaucgaguucacgcugccgaucauccugaaggcgcucuacaugcugagcacccggggccgccagaccgccaaggagaacaaggggacccggauccgcuucaaggacgacacguccuucgaggacgugaacggcauccggcgccccaagcaccuguacgucagcaugcccaccgcccaguccaccaugaaggccgaggagcucacccccggccgguuccgcacgaucgugugcgggcuguucccgacccagauccaggugcggaacaucaugagccccgucaugggcgugaucggguucuccuucuucgccaaggacuggcccgaccgcaucaaggaguucauggagaaggagugccccuucaucaagccggaggugaagcccggcacccccgcgaaggaggucgagauccugaagcggaacaagaucuacuucaugcagcgccagggggugcucgacaagaaccacgugcccgacaucgacaagcugaucgacuacgccgccagcggcgacccgaccagcccccggaacaucgacucccccaacgcccccugggucuucgccugcgcgccggaccgcugcccgcccacgugcaucuacguggccggcauggccgagcugggggccuucuucuccauccuccaggacaugcgcaacaccaucauggccagcaagaccgugggcaccgcggaggagaagcugaagaagaaguccagcuucuaccaguccuaccugcggcgcacgcagagcauggggauccagcucgaccagcggaucauccugcuguacaugcucgaguggggcaaggagauggucgaccacuuccaccugggcgacgacauggaccccgagcugcgcagccucgcccaggcccugaucgaccagaaggugaaggagaucuccaaccaggagccccugaagaucuga

SEQ ID NO: 6458 - RNA, 1302 nt, Artificial Sequence
  derived and/or modified CDS sequence (opt1) from PUUV(Fusong 199-05)__EF488803.1__N
augagcgaccugaaggacauccaggaggacaucgcccgccacgagcagcagcucguggccgcgcggcagaagcugcgcgacgccgagaaggccgucgagauggaccccgacgacgugaacaagaacacccugcaggcccggcagcagaccguguccgcccucgaggacaagaucgcggacuucaagcgccggauggccgacaucgucagccgcaagaagauggacacgaagccggccgaccccaccggcaucgagcccgacgaccaccugaaggagcgguccagccugcgcuacgggaacgugcucgacgugaacgccaucgacaucgaggagcccuccggccagaccgcggacugguacaccaucggggucuacaucaucggcuucacgcugccgaucauccugaaggcccucuacaugcugagcacccgggggcgccagaccgugaaggagaacaagggcacccggauccgcuucaaggacgacacguccuucgaggacgugaacggcauccggcgccccaagcaccuguacgucagcaugcccaccgcccaguccaccaugaaggccgaggagcucacccccgggcgguuccgcacgaucgugugcggccuguucccgacccagauccaggugcggaacaucaugagccccgucaugggggugaucggcuucuccuucuucgccaaggacuggcccgaccgcaucaaggaguucauggagaaggagugccccuucaucaagccggaggugaagcccgggacccccgcgaaggaggucgagauccugaagcggaacaagaucuacuucaugcagcgccaggacgugcucgacaagaaccacgugcccgacaucgacaagcugaucgacuacgccgccagcggcgacccgaccucccccgagaacaucgacagccccaacgcccccugggucuucgccugcgcgccggaccggugcccgcccacgugcaucuacguggccggcauggccgagcugggggccuucuucuccauccuccaggacaugcgcaacaccaucauggccagcaagaccgugggcaccgcggaggagaagcugaagaagaaguccagcuucuaccaguccuaccugcgccggacgcagagcauggggauccagcucgaccagcgcaucauccugcuguacaugcucgaguggggcaaggagauggucgaccacuuccaccugggcgacgacauggaccccgagcugcggagccucgcccaggcccugaucgaccagaaggugaaggagaucuccaaccaggagccccugaagaucuga

SEQ ID NO: 6459 - RNA, 1302 nt, Artificial Sequence
  derived and/or modified CDS sequence (opt1) from PUUV(Fusong 200-05)__EF211820.1__N
augagcgaccugaaggacauccaggaggacaucgcccgccacgagcagcagcucguggucgcccggcagaagcugcgcgacgcggagaaggccguggagauggaccccgacgacgugaacaagaacacccugcaggcccggcagcagaccgucuccgcccucgaggacaagaucgccgacuucaagcgccggauggcggacaucgugagccgcaagaagauggacacgaagccggccgaccccaccggcaucgagcccgacgaccaccugaaggagcgguccagccugcgcuacgggaacgugcucgacgucaacgccaucgacaucgaggagcccuccggccagaccgccgacugguacaccaucgggguguacaucaucggcuucacgcugccgaucauccugaaggcgcucuacaugcugagcacccgggggcgccagaccgugaaggagaacaagggcacccggauccgcuucaaggacgacacguccuucgaggacgucaacggcauccggcgccccaagcaccuguacgugagcaugcccaccgcccaguccaccaugaaggccgaggagcucacccccgggcgguuccgcacgaucgugugcggccuguucccgacccagauccagguccggaacaucaugagccccgugaugggggugaucggcuucuccuucuucgccaaggacuggcccgaccgcaucaaggaguucauggagaaggagugccccuucaucaagccggaggucaagcccgggacccccgccaaggagguggagauccugaagcggaacaagaucuacuucaugcagcgccaggacgugcucgacaagaaccacguccccgacaucgacaagcugaucgacuacgcggccagcggcgacccgaccucccccgagaacaucgacagccccaacgcccccuggguguucgccugcgccccggaccggugcccgcccacgugcaucuacguggcgggcauggccgagcugggggccuucuucuccauccuccaggacaugcgcaacaccaucauggccagcaagaccgucggcaccgccgaggagaagcugaagaagaaguccagcuucuaccaguccuaccugcgccggacgcagagcauggggauccagcucgaccagcgcaucauccugcuguacaugcucgaguggggcaaggagaugguggaccacuuccaccugggcgacgacauggaccccgagcugcggagccucgcgcaggcccugaucgaccagaaggugaaggagaucuccaaccaggagccccugaagaucuga

SEQ ID NO: 6460 - RNA, 1302 nt, Artificial Sequence
  derived and/or modified CDS sequence (opt1) from PUUV(Fusong 900-06)__EF488806.1__N
augagcgaccugaaggacauccaggaggacaucgcccgccacgagcagcagcucguggucgcccggcagaagcugcgcgacgcggagaaggccguggagauggaccccgacgacgugaacaagaacacccugcaggcccggcagcagaccgucuccgcccucgaggacaagaucgccgacuucaagcgccggauggcggacaucgugagccgcaagaagauggacacgaagccggccgaccccaccggcaucgagcccgacgaccaccugaaggagcgguccagccugcgcuacgggaacgugcucgacgucaacgccaucgacaucgaggagcccuccggccagaccgccgacugguacaccaucgggguguacaucaucggcuucacgcugccgaucauccugaaggcgcucuacaugcugagcacccgggggcgccagaccgugaaggagaacaagggcacccggauccgcuucaaggacgacacguccuucgaggacgucaacggcauccggcgccccaagcaccuguacgugagcaugcccaccgcccaguccaccaugaaggccgaggagcucacccccgggcgguuccgcacgaucgugugcggccuguucccgacccagauccagguccggaacaucaugagccccgugaugggggugaucggcuucuccuucuucgccaaggacuggcccgaccgcaucaaggaguucauggagaaggagugccccuucaucaagccggaggucaagcccgggacccccgccaaggagguggagauccugaagcggaacaagaucuacuucaugcagcgccgggacgugcucgacaagaaccacguccccgacaucgacaagcugaucgacuacgcggccagcggcgacccgaccucccccgagaacaucgacagccccaacgcccccuggguguucgccugcgccccggaccgcugcccgcccacgugcaucuacguggcgggcauggccgagcugggggccuucuucuccauccuccaggacaugcgcaacaccaucauggccagcaagaccgucggcaccgccgaggagaagcugaagaagaaguccagcuucuacaaguccuaccugcggcgcacgcagagcauggggauccagcucgaccagcggaucauccugcuguacaugcucgaguggggcaaggagaugguggaccacuuccaccugggcgacgacauggaccccgagcugcgcagccucgcgcaggcccugaucgaccagaaggugaaggagaucuccaaccaggagccccugaagaucuga

SEQ ID NO: 6461 - RNA, 1302 nt, Artificial Sequence
  derived and/or modified CDS sequence (opt1) from PUUV(Gumboda_98-2)__AM746316.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagccgaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacugggccgaccggauccgcgaguucauggagaaggagugccccuucaucaagcccgaggugaagccggggacccccacccaggagaucgaguuccucaagaagaacaagguguacuucauggaccggcagaacguccuggagaagaaccacguggccgacaucgacaagcugaucgacuacgccgcgagcggcgaccccaccucccccgacaacaucgagagcccgaacgcccccuggguguucuccugcgcccccgaccgcugcccgcccacgugcaucuacgucgccggcauggccgagcucggggcguucuucagcauccugcaggacaugcggaacaccaucauggccuccaagaccgugggcaccgccgaggagaagcugaagaagaaguccagcuucuaccagagcuaccuccgccgcacgcagagcauggggauccagcuggaccagcggaucauccugcucuacaugcuggaguggggcaaggagaugguggaccacuuccaccugggcgacgacauggaccccgagcuccgcgggcuggcccaggcccugaucgaccagaaggucaaggagaucuccaaccaggacccccucaagaucuga

SEQ ID NO: 6462 - RNA, 1302 nt, Artificial Sequence
  derived and/or modified CDS sequence (opt1) from PUUV(Gumboda_98-4)__AM746318.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagccgaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacugggccgaccggauccgcgaguucauggagaaggagugccccuucaucaagcccgaggugaagccggggacccccacccaggagaucgaguuccucaagaagaacaagguguacuucauggaccggcagaacguccuggacaagaaccacguggccgacaucgacaagcugaucgacuacgccgcgagcggcgaccccaccucccccgacaacaucgagagcccgaacgcccccuggguguucuccugcgcccccgaccgcugcccgcccacgugcaucuacgucgccggcauggccgagcucggggcguucuucagcauccugcaggacaugcggaacaccaucauggccuccaagaccgugggcaccgccgaggagaagcugaagaagaaguccagcuucuaccagagcuaccuccgccgcacgcagagcauggggauccagcuggaccagcggaucauccugcucuacaugcuggaguggggcaaggagaugguggaccacuuccaccugggcgacgacauggaccccgagcuccgcgggcuggcccaggcccugaucgaccagaaggucaaggagaucuccaaccaggacccccucaagaucuga

SEQ ID NO: 6463 - RNA, 1302 nt, Artificial Sequence
  derived and/or modified CDS sequence (opt1) from PUUV(Kamiiso-8Cr-95)__AB010730.1__N
augagcgaccugaaggacauccaggaggacaucacccgccacgagcagcagcucguggucgcccggcagaagcugcgcgacgccgagaaggcgguggagauggaccccgacgacgugaacaagaacacccugcaggcccggcagcagacggucuccgcccucgaggacaagcuggccgacuucaagcgccggauggccgacguggugagccgcaagaagauggacaccaagcccgcggaccccaccggcaucgagcccgacgaccaccugaaggagcgguccagccuccgcuacgggaacguccuggacgugaacgccaucgacaucgaggagcccuccggccagaccgccgacugguacacgaucgggguguacaucaucggcuucacccugccgaucauccucaaggcccuguacaugcugagcacccgggggcgccagaccgucaaggagaacaagggcacgcggauccgcuucaaggacgacaccuccuucgaggacaucaacggcauccggcgccccaagcaccucuacgugagcaugcccaccgcgcaguccaccaugaaggccgaggagaucacgcccgggcgguuccgcaccaucgugugcggccuguucccgacccagauccagguccggaacaucaugagccccgugaugggggugaucggcuucuccuucuucgucaaggacuggcccgagcgcaucaaggaguucauggagaaggagugccccuucaucaagccggaggugaagcccgggacccccgccaaggagguggagauccugaagcggaacaaggucuacuucaugcagcgccaggacgugcucgacaagaaccacgugcccgacaucgacaagcugaucgacuacgccgccagcggcgacccgacgucccccgacaacaucgacagccccaacgcgcccugggucuucgccugcgccccggaccggugcccgccgaccugcaucuacguggccggcauggccgagcugggggcguucuucuccauccuccaggacaugcgcaacaccaucauggccagcaagaccgugggcacggccgaggagaagcugaagaagaaguccagcuucuaccaguccuaccugcgccggacccagagcauggggauccagcucgaccagcgcaucauccugcuguacaugcucgaguggggcaaggagauggucgaccacuuccaccugggcgacgacauggaccccgagcugcgggggcucgcccaggcccugaucgaccagaaggugaaggagaucagcaaccaggagccccugaagaucuga

SEQ ID NO: 6464 - RNA, 1302 nt, Artificial Sequence
  derived and/or modified CDS sequence (opt1) from PUUV(Mu/07/1219)__KJ994776.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuacaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacugggccgagcggauccgcgaguucauggagaaggagugccccuucaucaagcccgaggugaagccggggacccccgcccaggaggccgaguuccucaagcggaacaagguguacuucaugcagcgccaggacguccuggacaagaaccacguggcggacaucgacaagcugaucgacuacgccgccagcggcgaccccaccucccccgacaacaucgagagcccgaacgcccccuggguguucgccugcgcgcccgaccggugcccgccgaccugcaucuacgucgccggcauggccgagcucggggccuucuucuccauccugcaggacaugcgcaacacgaucauggccagcaagaccgugggcaccgcggaggagaagcugaagaagaaguccagcuucuaccaguccuaccuccgccggacccagagcauggggauccagcuggaccagcgcaucauccugcucuacaugcuggaguggggcaaggagaugguggaccacuuccaccugggcgacgacauggaccccgagcuccgggggcuggcccaggcccugaucgaccagaaggucaaggagaucagcaaccaggagccccucaagaucuga

SEQ ID NO: 6465 - RNA, 1302 nt, Artificial Sequence
  derived and/or modified CDS sequence (opt1) from PUUV(Opina916)__AF294652.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagcccguggaccccaccggcaucgagcccgacgaccaccugaaggagcgcuccagccuccgguacgggaacguccuggacgugaacgccaucgacaucgaggagcccuccggccagacggccgacugguacaccaucgggguguacgucaucggcuucacccugccgaucauccucaaggcccuguacaugcugagcacccgcgggcggcagacggugaaggagaacaagggcacccgcauccgguucaaggacgacaccuccuucgaggacaucaacggcauccgccggcccaagcaccucuacgugagcaugcccaccgcgcaguccacgaugaaggccgaggagcugacccccgggcgcuuccggaccaucgucugcggccuguucccgacccagauccaggugcgcaacaucaugagccccgugaugggggucaucggcuucuccuucuucgugaaggacugggccgagcggauccgcgaguucauggagaaggagugccccuucaucaagcccgaggugaagccggggacgcccgcccaggaggccgaguuccucaagaagaaccggaucuacuucaugcagcgccaggagguccuggacaagaaccacguggcggacaucgacaagcugaucgacuacgccgccagcggcgaccccaccucccccgacaacaucgagagcccgaacgcccccuggguguucgccugcgcgcccgaccggugcccgccgaccugcaucuacgucgccggcauggccgagcucggggccuucuucuccauccugcaggacaugcgcaacaccaucauggccagcaagacggugggcaccgcggaggagaagcugaagaagaaguccagcuucuaccaguccuaccuccgccggacccagagcauggggauccagcuggaccagcgcaucauccugcucuacaugcuggaguggggcaaggagaugguggaccacuuccaccugggcgacgacauggaccccgagcuccgggggcuggcccaggcccugaucgaccagaaggucaaggagaucagcaaccaggagccccucaagaucuga

SEQ ID NO: 6466 - RNA, 1302 nt, Artificial Sequence
  derived and/or modified CDS sequence (opt1) from PUUV(Palbole_98-1)__AM746327.1__N
augagcgaccugaccgacauccaggaggacaucacgugccacgagcagcagcucguggucgcccgccagaagcugaaggacgccgagaaggcgguggagauggaccccgacgacgugaacaagaacacccugcaggcccggcagcagaccgucuccgcccucgaggacaagcuggccgacuucaagcgccggauggccgacgcggugagccgcaagaagauggacaccaagccgaccgaccccacgggcaucgagcccgacgaccaccugaaggagcgguccagccuccgcuacgggaacgugcuggacgucaacgccaucgacaucgaggagcccuccggccagaccgccgacugguacaccaucgggguguacgugaucggcuucacccugccgaucauccucaaggcccuguacaugcugagcacgcgggggcgccagaccgucaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgugugcggccuguucccgacgcagauccagguccggaacaucaugagccccgugaugggggugaucggcuucuccuucuucgucaaggacugggccgaccgcauccgggaguucauggagaaggagugccccuucaucaagcccgaggugaagccggggacccccacccaggagaucgaguuccucaagaagaacaagguguacuucauggaccgccagaacguccuggacaagaaccacguggccgacaucgacaagcugaucgacuacgccgcgagcggcgaccccaccucccccgacaacaucgagagcccgaacgcccccuggguguucgccugcgcccccgaccggugcccgcccacgugcaucuacgucgccggcauggcggagcucggggccuucuucuccauccugcaggacaugcgcaacaccaucauggccagcaagaccgugggcaccgccgaggagaagcugaagaagaaguccagcuucuaccaguccuaccuccggcgcacgcagagcauggggauccagcuggaccagcgcaucauccugcucuacaugcuggaguggggcaaggagaugguggaccacuuccaccugggcgacgacauggaccccgagcuccgggggcuggcccaggcgcugaucgaccagaaggucaaggagaucagcaaccaggacccccucaagaucuga

SEQ ID NO: 6467 - RNA, 1302 nt, Artificial Sequence
  derived and/or modified CDS sequence (opt1) from PUUV(Palbole_98-2)__AM746328.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagccgaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacugggccgaccggauccgcgaguucauggagaaggagugccccuucaucaagcccgaggugaagccggggacccccacccaggagaucgaguuccucaagaagaacaagguguacuucauggaccggcagaacguccuggacaagaaccacguggccgacaucgacaagcugaucgacuacgccgcgagcggcgaccccaccucccccgacaacaucgagagcccgaacgcccccuggguguucgccugcgcccccgaccgcugcccgcccacgugcaucuacgucgccggcauggcggagcucggggccuucuucuccauccugcaggacaugcggaacaccaucauggccagcaagaccgugggcaccgccgaggagaagcugaagaagaaguccagcuucuaccaguccuaccuccgccgcacgcagagcauggggauccagcuggaccagcggaucauccugcucuacaugcuggaguggggcaaggagaugguggaccacuuccaccugggcgacgacauggaccccgagcuccgcggguucgcccaggcgcugaucgaccagaaggucaaggagaucagcaaccaggacccccugaagaucuga

SEQ ID NO: 6468 - RNA, 1302 nt, Artificial Sequence
  derived and/or modified CDS sequence (opt1) from PUUV(Palbole_98-3)__AM746329.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagccgaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacugggccgaccggauccgcgaguucauggagaaggagugccccuucaucaagcccgaggugaagccggggacccccacccaggagaucgaguuccucaagaagaacaagguguacuucauggaccggcagaacguccuggacaagaaccacguggccgacaucgacaagcugaucgacuacgccgcgagcggcgaccccaccucccccgacagcaucgaguccccgaacgcccccuggguguucgccugcgcccccgaccgcugcccgcccacgugcaucuacgucgccggcauggcggagcucggggccuucuucagcauccugcaggacaugcggaacaccaucauggccuccaagaccgugggcaccgccgaggagaagcugaagaagaaguccagcuucuaccagagcuaccuccgccgcacgcagagcauggggauccagcuggaccagcggaucauccugcucuacaugcuggaguggggcaaggagaugguggaccacuuccaccugggcgacgacauggaccccgagcuccgcgggcuggcccaggcgcugaucgaccagaaggucaaggagaucuccaaccaggacccccucaagaucuga

SEQ ID NO: 6469 - RNA, 1302 nt, Artificial Sequence
  derived and/or modified CDS sequence (opt1) from PUUV(PUUV/Ardennes/Mg156/2011)__KT247592.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcagauggccgacgcggugagccgcaagaagauggacaccaagcccaccgaccccacgggcaucgagcccgacgaccaccugaaggagcgguccagccuccgcuacgggaacgugcuggacgucaacgccaucgacaucgaggagcccuccggccagaccgccgacugguacaccaucgggguguacgugaucggcuucacccugccgaucauccucaaggcccuguacaugcugagcacgcgggggcgccagaccgucaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgugugcggccuguucccgacgcagauccagguccggaacaucaugagccccgugaugggggugaucggcuucuccuucuucgucaaggacugggccgaccgcauccgggaguucauggagaaggagugccccuucaucaagcccgaggugaagccggggacccccgcccaggagguggaguuccucaagcgcaacaagaucuacuucaugcagcggcaggacguccuggacaagaaccacguggccgacaucgacaagcugaucgacuacgcggccagcggcgaccccaccucccccgacaacaucgaggccccgaacgcccccuggguguucgccugcgcgcccgaccgcugcccgccgaccugcaucuacgucgccggcauggccgagcucggggccuucuucagcauccugcaggacaugcggaacacgaucauggccuccaagaccgugggcaccgcggaggagaagcugaagaagaaguccagcuucuaccagagcuaccuccgccgcacccaguccauggggauccagcuggaccagcggaucauccugcucuacaugcuggaguggggcaaggagaugguggaccacuuccaccugggcgacgacauggaccccgagcuccgcgggcuggcccaggcccugaucgaccagaaggucaaggagaucagcaaccaggagccccucaagaucuga

SEQ ID NO: 6470 - RNA, 1302 nt, Artificial Sequence
  derived and/or modified CDS sequence (opt1) from PUUV(PUUV/Jelgava/Mg136/2008)__JN657230.1__N
augagcgaccuggccgacauccaggaggacaucacccgccacgagcagcagcucguggucgcccggcagaagcugaaggacgcggagcgcgccguggagguggaccccgacgacgucaacaagaacacccugcaggcccggcagcagacgguguccgcccucgaggacaagcuggccgacuacaagcgccggauggcggacgccgugagccgcaagaagauggacaccaagcccgccgaccccaccggcaucgagcccgacgaccaccugaaggagcgguccagccuccgcuacgggaacguccuggacgugaacgccaucgacaucgaggagcccuccggccagaccgcggacugguacacgaucgggguguacgucaucggcuucacccugccgaucauccucaaggcccuguacaugcugagcacccgggggcgccagaccgugaaggagaacaagggcacgcggauccgcuucaaggacgacaccuccuucgaggacaucaacggcauccggcgccccaagcaccucuacgugagcaugcccaccgcccaguccaccaugaaggccgaggagcugacgcccgggcgguuccgcaccgucgugugcggccuguucccgacccagauccaggugcggaacaucaugagccccgucaugggggugaucggcuucuccuucuucgugaaggacuggcccgaccgcaucaaggaguucauggagaaggagagccccuucaucaagccggacgucaagcccgggacccccgcccaggagguggaguuccucaagcggaacaagguguacuucaugaaccgccaggacguccuggacaagaaccacguggcggacaucgacaagcugaucgacuacgccgccuccggcgaccccacgagcccggacgacaucgagucccccaacgcccccuggguguucgccugcgcgcccgaccggugcccgccgaccugcaucuacgucgccggcauggccgagcucggggccuucuucagcauccugcaggacaugcgcaacaccaucauggccuccaagaccgugggcacggcggaggagaagcugaagaagaaguccagcuucuaccagagcuaccuccgccggacccagagcauggggauccagcuggaccagcgcaucauccugcucuacaugcuggaguggggcaaggagauggucgaccacuuccaccugggcgacgacauggaccccgagcuccgggggcuggcccaggcccugaucgaccagaaggugaaggagaucuccaaccaggagccccucaagaucuga

SEQ ID NO: 6471 - RNA, 1302 nt, Artificial Sequence
  derived and/or modified CDS sequence (opt1) from PUUV(PUUV/Jelgava/Mg140/2008)__JN657231.1__N
augagcgaccuggccgacauccaggaggacaucacccgccacgagcagcagcucguggucgcccggcagaagcugaaggacgcggagcgcgccguggagguggaccccgacgacgucaacaagaacacccugcaggcccggcagcagacgguguccgcccucgaggacaagcuggccgacuacaagcgccggauggcggacgccgugagccgcaagaagauggacaccaagcccgccgaccccaccggcaucgagcccgacgaccaccugaaggagcgguccagccuccgcuacgggaacguccuggacgugaacgccaucgacaucgaggagcccuccggccagaccgcggacugguacacgaucgggguguacgucaucggcuucacccugccgaucauccucaaggcccuguacaugcugagcacccgggggcgccagaccgugaaggagaacaagggcacgcggauccgcuucaaggacgacaccuccuucgaggacaucaacggcauccggcgccccaagcaccucuacgugagcaugcccaccgcccaguccaccaugaaggccgaggagcugacgcccgggcgguuccgcaccgucgugugcggccuguuccacacccagauccaggugcggaacaucaugagcccggucaugggggugaucggcuucuccuucuucgugaaggacuggcccgaccgcaucaaggaguucauggagaaggagugccccuucaucaagcccgacgucaagccggggacccccgcccaggagguggaguuccucaagcggaacaagguguacuucaugaaccgccaggacguccuggacaagaaccacguggcggacaucgacaagcugaucgacuacgccgccagcggcgaccccacgucccccgacgacaucgagagcccgaacgcccccuggguguucgccugcgcgcccgaccggugcccgccgaccugcaucuacgucgccggcauggccgagcucggggccuucuucuccauccugcaggacaugcgcaacaccaucauggccagcaagaccgugggcacggcggaggagaagcugaagaagaaguccagcuucuaccaguccuaccuccgccggacccagagcauggggauccagcuggaccagcgcaucauccugcucuacaugcuggaguggggcaaggagauggucgaccacuuccaccugggcgacgacauggaccccgagcuccgggggcuggcccaggcccugaucgaccagaaggugaaggagaucagcaaccaggagccccucaagaucuga

SEQ ID NO: 6472 - RNA, 1302 nt, Artificial Sequence
  derived and/or modified CDS sequence (opt1) from PUUV(PUUV/Jura/Mg2/2010)__KT247596.2__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacugggccgaccggauccgcgaguucauggagaaggagugccccuucaucaagcccgagaucaagccggggacccccgcccaggaggccgaguuccucaagcggaacaagaucuacuucaugcagcgccaggacgugcuggacaagaaccacguggcggacaucgacaagcugaucgacuacgccgccagcggcgaccccaccucccccgacaacaucgagagcccgaacgcccccugggucuucgccugcgcgcccgaccggugcccgccgaccugcaucuacguggccggcauggccgagcucggggccuucuucuccauccugcaggacaugcgcaacacgaucauggccagcaagaccgugggcaccgcggaggagaagcugaagaagaaguccagcuucuaccaguccuaccuccgccggacccagagcauggggauccagcuggaccagcgcaucauccugcucuacaugcuggaguggggcaaggagauggucgaccacuuccaccugggcgacgacauggaccccgagcuccgggggcuggcccaggcccugaucgaccagaaggugaaggagaucagcaaccaggagccccucaagaucuga

SEQ ID NO: 6473 - RNA, 1302 nt, Artificial Sequence
  derived and/or modified CDS sequence (opt1) from PUUV(PUUV/Madona/Mg233/2008)__JN657232.1__N
augagcgaccuggccgacauccaggaggacaucacccgccacgagcagcagcucguggucgcccggcagaagcugaaggacgcggagcgcgccguggagguggaccccgacgacgucaacaagaacacccugcaggcccggcagcagacgguguccgcccucgaggacaagcuggccgacuacaagcgccggauggcggacgccgugagccgcaagaagauggacaccaagcccaccgaccccaccggcaucgagcccgacgaccaccugaaggagcgguccagccuccgcuacgggaacguccuggacgugaacgccaucgacaucgaggagcccuccggccagacggccgacugguacaccaucgggguguacgucaucagcuucacccugccgaucauccucaaggcgcuguacaugcuguccacccggggccgccagacggugaaggagaacaaggggacccggauccgcuucaaggacgacaccagcuucgaggacaucaacggcauccggcgccccaagcaccucuacguguccaugcccaccgcccagagcacgaugaaggccgaggagcugacccccggccgguuccgcaccaucgucugcgggcuguucccgacccagauccaggugcggaacaucaugucccccgugaugggcgucaucggguucagcuucuucgugaaggacuggcccgaccgcaucaaggaguucauggagaaggagugccccuucaucaagccggacgugaagcccggcacgcccgcccaggagaucgaguuccucaagcggaacaaggucuacuucaugaaccgccaggacgugcuggacaagaaccacguggccgacaucgacaagcugaucgacuacgcggccuccggggaccccaccagcccggacgacaucgagucccccaacgcccccugggucuucgccugcgcccccgaccggugcccgccgaccugcaucuacguggcgggcauggccgagcucggcgccuucuucagcauccugcaggacaugcgcaacaccaucauggccuccaagacgguggggaccgccgaggagaagcugaagaagaaguccagcuucuaccagagcuaccuccgccggacccagagcaugggcauccagcuggaccagcgcaucauccugcucuacaugcuggagugggggaaggagauggucgaccacuuccaccugggcgacgacauggaccccgagcuccggggccuggcgcaggcccugaucgaccagaaggugaaggagaucuccaaccaggagccccucaagaucuga

SEQ ID NO: 6474 - RNA, 1302 nt, Artificial Sequence
  derived and/or modified CDS sequence (opt1) from PUUV(PUUV/Orleans/Mg23/2010)__KT247594.1__N
augagcgaccugaccgacauccaggaggugaucacccgccacgagcagcagcucgucguggcccggcagaagcugaaggacgccgagaaggcgguggagauggaccccgacgacgucaacaagaacacgcugcaggcccgccagcagaccguguccgcccucgaggacaagcuggccgacuucaagcggcgcauggccgacgcggugagccggaagaagauggacaccaagcccgccgaccccaccggcaucgagcccgacgaccaccugaaggagcgcuccagccuccgguacgggaacguccuggacgugaacgccaucgacaucgaggagcccuccggccagacggccgacugguacaccaucgggguguacgucaucggcuucacccugccgaucauccucaaggcgcuguacaugcugagcacccgcgggcggcagacggugaaggagaacaagggcacccgcauccgguucaaggacgacaccuccuucgaggacaucaacggcauccgccggcccaagcaccucuacgugagcaugcccaccgcccaguccacgaugaaggccgaggagcugacccccgggcgcuuccggaccaucgucugcggccuguucccgacccagauccaggugcgcaacaucaugagccccgugaugggggucaucggcuucuccuucuucgugaaggacugggccgaccggaucaaggaguucauggagaaggagugccccuucaucaagcccgaggugaagccggggacgcccgucaaggaggccgaguuccucaagaagaaccgcguguacuucaugcagcggcaggacgugcuggacaagaaccacgucgcggacaucgacaagcugaucgacuacgccgccgccggcgaccccaccagccccgacaacaucgaguccccgaacgcccccuggguguucgcgugcgcccccgaccgcugcccgccgaccugcaucuacguggccggcauggccgagcucggggccuucuucagcauccugcaggacaugcggaacaccaucauggcguccaagacggucggcaccgccgaggagaagcugaagaagaaguccagcuucuaccagagcuaccuccgccgcacccaguccauggggauccagcuggaccagcggaucauccugcucuacaugcuggaguggggcaaggagaugguggaccacuuccaccugggcgacgacauggaccccgagcuccgcgggcuggcccaggcccugaucgaccagaaggucaaggagaucagcaaccaggagccccucaagaucuga

SEQ ID NO: 6475 - RNA, 1302 nt, Artificial Sequence
  derived and/or modified CDS sequence (opt1) from PUUV(Tobetsu-60Cr-93)__AB010731.1__N
augagcgaccugaaggacauccaggaggacaucacccgccacgagcagcagcucguggucgcccggcagaagcugcgcgacgccgagaaggcgguggagauggaccccgacgacgugaacaagaacacccugcaggcccggcagcagacggucuccgcccucgaggacaagcuggccgacuucaagcgccggauggccgacguggugagccgcaagaagauggacaccaagcccgcggaccccaccggcaucgagcccgacgaccaccugaaggaccgguccagccuccgcuacgggaacguccuggacgugaacgccaucgacaucgaggagcccuccggccagaccgccgacugguacacgaucgggguguacaucaucggcuucacccugccgaucauccucaaggcccuguacaugcugagcacccgggggcgccagaccgucaaggagaacaagggcacgcggauccgcuucaaggacgacaccuccuucgaggacaucaacggcauccggcgccccaagcaccucuacgugagcaugcccaccgcgcaguccaccaugaaggccgaggagaucacgcccgggcgguuccgcaccaucgugugcggccuguucccgacccagauccagguccggaacaucaugagccccgugaugggggugaucggcuucuccuucuucgucaaggacuggcccgagcgcaucaaggaguucauggagaaggagugccccuucaucaagccggaggugaagcccgggacccccgccaaggagguggagauccugaagcggaacaaggucuacuucaugcagcgccaggacgugcucgacaagaaccacgugcccgacaucgacaagcugaucgacuacgccgccagcggcgacccgacgucccccgacaacaucgacagccccaacgcgcccugggucuucgccugcgccccggaccggugcccgccgaccugcaucuacguggccggcauggccgagcugggggcguucuucuccauccuccaggacaugcgcaacaccaucauggccagcaagaccgugggcacggccgaggagaagcugaagaagaaguccagcuucuaccaguccuaccugcgccggacccagagcauggggauccagcucgaccagcgcaucauccugcuguacaugcucgaguggggcaaggagauggucgaccacuuccaccugggcgacgacauggaccccgagcugcgggggcucgcccaggcccugaucgaccagaaggugaaggagaucagcaaccaggagccccugaagaucuga

SEQ ID NO: 6476 - RNA, 1302 nt, Artificial Sequence
  derived and/or modified CDS sequence (opt1) from PUUV(Vranica)__U14137.1__N
augagcgaccugaccgacauccaggaggacaucacccgccacgagcagcagcucguggucgcccggcagaagcugaaggacgccgagaaggcgguggagauguaccccgacgacgugaacaagaacacgcugcaggcccgccagcagaccgucuccgcccucgaggacaagcuggccgacuucaagcggcgcauggccgacgcggugagccggaagaagauggacaccaagccgaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcuaccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacugggccgaccggauccgcgaguucauggagaaggagugccccuucaucaagcccgaggugaagccggggacccccacccaggagaucgaguuccucaagaagaacaagguguacuucauggaccggcagaacguccuggacaagaaccacguggccgacaucgacaagcugaucgacuacgccgcgagcggcgaccccaccucccccgacaacaucgagagcccgaacgcccccuggguguucgccugcgcccccgaccgcugcccgcccacgugcaucuacgucgccggcauggcggagcucggggccuucuucuccauccugcaggacaugcggaacaccaucauggccagcaagaccgugggcaccgccgaggagaagcugaagaagaaguccagcuucuaccaguccuaccuccgccgcacgcagagcauggggauccagcuggaccagcggaucauccugcucuacaugcuggaguggggcaaggagaugguggaccacuuccaccugggcgacgacauggaccccgagcuccgcgggcuggcccaggcgcugaucgaccagaaggucaaggagaucagcaaccaggacccccucaagaucuga

SEQ ID NO: 6477 - RNA, 1302 nt, Artificial Sequence
  derived and/or modified CDS sequence (opt1) from PUUV(P360)__L11347.1__N
augagcgaccugaccgacauccaggaggagaucacccgccacgagcagcagcucguggucgcccggcagaagcugaaggacgccgagcgcgcgguggagguguaccccgacgacgucaacaagaacacgcugcaggcccggcagcagaccguguccgcccucgaggacaagcuggccgacuacaagcgccggauggccgacgcggugagccgcaagaagauggacaccaagccgaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucaccaucccgaucauccugaaggcccucuacaugcugagcacgcgggggcgccagaccgugaaggagaacaagggcacccggauccgcuucaaggacgacaccuccuucgaggacaucaacggcauccggcgccccaagcaccuguacgugagcaugcccacggcgcaguccaccaugaaggccgaggagcucacccccgggcgguuccgcaccaucgucugcggccuguucccgacgcagauccaggugcggaacaucaugagccccgugaugggggucaucggcuucuccuucuucgugaaggacuggcccgagaagauccgcgaguucauggagaaggagugccccuucaucaagccggaggugaagcccgggacccccgcccaggaggucgaguuccugaagcggaaccgcguguacuucaugacccggcaggacgugcucgacaagaaccacgucgccgacaucgacaagcugaucgacuacgccgcgagcggcgaccccaccuccccggacgacaucgagagccccaacgcccccuggguguucgccugcgcccccgaccgcugcccgcccacgugcaucuacguggccggcauggcggagcugggggccuucuucuccauccuccaggacaugcgcaacaccaucauggccagcaagaccgucggcaccgccgaggagaagcugaagaagaaguccagcuucuaccaguccuaccugcggcgcacgcagagcauggggauccagcucgaccagcggaucauccugcuguacaugcucgaguggggcaaggagaugguggaccacuuccaccugggcgacgacauggaccccgagcugcgcgggcucgcccagagccugaucgaccagaaggucaaggagaucuccaaccaggagccccugaagaucuga

SEQ ID NO: 6478 - RNA, 1302 nt, Artificial Sequence
  derived and/or modified CDS sequence (opt1) from PUUV(Aijajarvi/Mg7/05)__GQ339476.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcagauggccgacgcggugagccgcaagaagauggacaccaagccgaccgaccccacgggcaucgagcccgacgaccaccugaaggagcgguccagccuccgcuacgggaacgugcuggacgucaacgccaucgacaucgaggagcccuccggccagaccgccgacugguacaccaucgggguguacgugaucggcuucacccugccgaucauccucaaggcccuguacaugcugagcacgcgggggcgccagaccgucaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgugugcggccuguucccgacgcagauccagguccggaacaucaugagccccgugaugggggugaucggcuucuccuucuucgucaaggggugggccgaccgcauccgggaguucauggagaaggagugccccuucaucaagcccgaggugaagccgggcacccccacccaggagguggaguuccucaagaagaacaaggucuacuuccuggaccgccagaacgugcuggacaagaaccacguggccgacaucgacaagcucaucgacuacgccgcgagcggcgaccccaccucccccgacaacaucgagagcccgaacgcccccugggucuucgccugcgcccccgaccggugcccgcccacgugcaucuacguggccgggauggcggagcugggcgccuucuucuccauccugcaggacaugcgcaacaccaucauggccagcaagaccguggggaccgccgaggagaagcucaagaagaaguccagcuucuaccaguccuaccugcggcgcacgcagagcaugggcauccagcuggaccagcgcaucauccuccuguucaugcuggaguggggcaaggagauggucgaccacuuccaccucggggacgacauggaccccgagcugcggggccuggcccaggcgcucaucgaccagaaggugaaggagaucagcaaccaggagccccugaagaucuga

SEQ ID NO: 6479 - RNA, 1302 nt, Artificial Sequence
  derived and/or modified CDS sequence (opt1) from PUUV(Bavaria 151/05)__EU439968.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuacaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacugggccgagcggauccgcgaguucauggagaaggagugccccuuccucaagcccgagaucaagccggggacccccgcccaggaggccgaguuccugaagaagaacaagguguacuucaugcagcggcaggacgugcuggacaagaaccacgucgcggacaucgacaagcucaucgacuacgccgccagcggcgaccccaccucccccgacaacaucgagagcccgaacgcccccuggguguucgccugcgcgcccgaccgcugcccgccgaccugcaucuacguggccggcauggccgagcugggggccuucuucuccauccugcaggacaugcggaacacgaucauggccagcaagaccgucggcaccgcggaggagaagcucaagaagaaguccagcuucuaccaguccuaccugcgccgcacccagagcauggggauccagcuggaccagcggaucauccuccuguacaugcuggaguggggcaaggagaugguggaccacuuccaccucggcgacgacauggaccccgagcugcgcgggcuggcccaggcccucaucgaccagaaggugaaggagaucagcaaccaggagccccugaagaucuga

SEQ ID NO: 6480 - RNA, 1302 nt, Artificial Sequence
  derived and/or modified CDS sequence (opt1) from PUUV(Bavaria 159/05)__EU439972.1__N
augagcgaccugaccgacauccacgaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuacaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacugggccgagcggauccgcgaguucauggagaaggagugccccuucaucaagcccgagaucaagccggggacccccgcccaggaggccgaguuccucaagcggaacaagguguacuucaugcagcgccaggacgugcuggacaagaaccacgucgcggacaucgacaagcugaucgacuacgccgccagcggcgaccccaccucccccgacaacaucgagagcccgaacgcccccuggguguucgccugcgcgcccgaccggugcccgccgaccugcaucuacguggccggcauggccgagcucggggccuucuucuccauccugcaggacaugcgcaacacgaucauggccagcaagaccgucggcaccgcggaggagaagcugaagaagaaguccagcuucuaccaguccuaccuccgccggacccagagcauggggauccagcuggaccagcgcaucauccugcucuacaugcuggaguggggcaaggagaugguggaccacuuccaccugggcgacgacauggaccccgagcuccgggggcuggcccaggcccugaucgaccagaaggugaaggagaucagcaaccaggagccccucaagaucuga

SEQ ID NO: 6481 - RNA, 1299 nt, Artificial Sequence
  derived and/or modified CDS sequence (opt1) from PUUV(Bavaria CG 33/04)__DQ016430.2__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuacaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacugggccgagcggauccgcgaguucauggagaaggagugccccuucaucaagcccgagaucaagccggggacccccgcccaggaggccgaguuccucaagcggaacaagguguacuucaugcagcgccaggacgugcuggacaagaaccacgucgcggacaucgacaagcugaucgacuacgccgccagcggcgaccccaccucccccgacaacaucgagagcccgaacgcccccuggguguucgccugcgcgcccgaccggugcccgccgaccugcaucuacguggccggcauggccgagcucggggccuucuccauccugcaggacaugcgcaacacgaucauggccagcaagaccgucggcaccgcggaggagaagcugaagaagaaguccagcuucuaccaguccuaccuccgccggacccagagcauggggauccagcuggaccagcgcaucauccugcucuacaugcuggaguggggcaaggagaugguggaccacuuccaccugggcgacgacauggaccccgagcuccgggggcuggcccaggcccugaucgaccagaaggugaaggagaucagcaaccaggagccccucaagaucuga

SEQ ID NO: 6482 - RNA, 1302 nt, Artificial Sequence
  derived and/or modified CDS sequence (opt1) from PUUV(Bavaria CG 34/04)__AY954723.2__N
augagcgaccugaccgacauccaggaggacaucacccgccacgagcagcagcucguggucgcccggcagaagcugaaggacgccggcaaggcgguggagauggaccccgacgacgugaacaagaacacgcugcaggcccgccagcagaccgucuccgcccucgaggacaagcuggccgacuacaagcggcgcauggccgacgcggugagccggaagaagauggacaccaagcccaccgaccccacggggaucgagcccgacgaccaccugaaggagcgcuccagccuccgguacggcaacgugcuggacgucaacgccaucgacaucgaggagcccuccgggcagaccgccgacugguacaccaucggcguguacgugaucggguucacccugccgaucauccucaaggcccuguacaugcugagcacgcgcggccggcagaccgucaaggagaacaagggcacccgcauccgguucaaggacgacaccuccuucgaggacaucaacgggauccgccggcccaagcaccucuacgugagcaugcccacggcgcaguccaccaugaaggccgaggagcugacccccggccgcuuccggaccaucgugugcgggcuguucccgacgcagauccagguccgcaacaucaugagccccgugaugggcgugaucggguucuccuucuucgucaaggacugggccgagcggauccgcgaguucauggagaaggagugccccuucaucaagcccgagaugaagccgggcacccccgcccaggaggccgaguuccucaagcggaacaagguguacuucaugcagcgccaggacgugcuggacaagaaccacgucgcggacaucgacaagcugaucgacuacgccgccagcggcgaccccaccucccccgacaacaucgagagcccgaacgcccccuggguguucgccugcgcgcccgaccggugcccgccgaccugcaucuacguggccgggauggccgagcucggcgccuucuucuccauccugcaggacaugcgcaacacgaucauggccagcaagaccgucgggaccgcggaggagaagcugaagaagaaguccagcuucuaccaguccuaccuccgccggacccagagcaugggcauccagcuggaccagcgcaucauccugcucuacaugcuggaguggggcaaggagaugguggaccacuuccaccugggggacgacauggaccccgagcuccggggccuggcccaggcccugaucgaccagaaggugaaggagaucagcaaccaggagccccucaagaucuga

SEQ ID NO: 6483 - RNA, 1302 nt, Artificial Sequence
  derived and/or modified CDS sequence (opt1) from PUUV(Bavaria CG 41/04)__DQ016432.2__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaaccuggccgacuacaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacugggccgagcggauccgcgaguucauggagaaggagugccccuucaucaagcccgagaugaagccggggacccccgcccaggaggccgaguuccucaagcggaacaagguguacuucaugcagcgccaggacgugcuggacaagaaccacgucgcggacaucgacaagcugaucgacuacgccgccagcggcgaccccaccucccccgacaacaucgagagcccgaacgcccccuggguguucgccugcgcgcccgaccggugcccgccgaccugcaucuacguggccggcauggccgagcucggggccuucuucuccauccugcaggacaugcgcaacacgaucauggccagcaagaccgucggcaccgcggaggagaagcugaagaagaaguccagcuucuaccaguccuaccuccgccggacccagagcauggggauccagcuggaccagcgcaucauccugcucuacaugcuggaguggggcaaggagaugguggaccacuuccaccugggcgacgacauggaccccgagcuccgggggcuggcccaggcccugaucgaccagaaggugaaggagaucagcaaccaggagccccucaagaucuga

SEQ ID NO: 6484 - RNA, 1302 nt, Artificial Sequence
  derived and/or modified CDS sequence (opt1) from PUUV(Bavaria CG 9/04)__AY954722.2__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuacaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacugggccgagcggauccgcgaguucauggagaaggagugccccuucaucaagcccgagaugaagccggggauccccgcccaggaggccgaguuccucaagcggaacaagguguacuucaugcagcgccaggacgugcuggacaagaaccacgucgcggacaucgacaagcugaucgacuacgccgccagcggcgaccccaccucccccgacaacaucgagagcccgaacgcccccuggguguucgccugcgcgcccgaccggugcccgccgaccugcaucuacguggccggcauggccgagcucggggccuucuucuccauccugcaggacaugcgcaacaccaucauggccagcaagacggucggcaccgcggaggagaagcugaagaagaaguccagcuucuaccaguccuaccuccgccggacccagagcauggggauccagcuggaccagcgcaucauccugcucuacaugcuggaguggggcaaggagaugguggaccacuuccaccugggcgacgacauggaccccgagcuccgggggcuggcccaggcccugaucgaccagaaggugaaggagaucagcaaccaggagccccucaagaucuga

SEQ ID NO: 6485 - RNA, 1302 nt, Artificial Sequence
  derived and/or modified CDS sequence (opt1) from PUUV(Bergsjobo/Mg25/05)__GQ339483.1__N
augagcgaccuggccgacauccaggacgagaucacccgccacgagcagcagcucguggccgcgcggcagaagcugaaggacgccgagcgcgccgucgagguggaccccgacgacgugaacaagaacacccugcaggcccggcagcagacggucuccgcccucgaggacaagcuggcggacuucaagcgccggauggccgacgccgugagccgcaagaagauggacaccaagcccaccgaccccaccggcaucgagcccgacgaccaccugaaggagcgguccagccuccgcuacgggaacgugcuggacgucaacgccaucgacaucgaggagcccuccggccagacggcggacugguacaccaucgggguguacgugaucggcuucacccugccgaucauccucaaggcccuguacaugcugagcacccgggggcgccagacggucaaggagaacaagggcacccggauccgcuucaaggacgacaccuccuucgaggacaucaacggcauccggcgccccaagcaccucuacgugagcaugcccaccgcccaguccacgaugaaggccgaggagcugacccccgggcgguuccgcaccaucgugugcggccuguucccgacccagauccagguccggaacaucaugagccccgugaugggggugaucggcuucuccuucuucgucaaggacugggccgagcgcauccgggaguucauggagaaggagugccccuucaucaagcccgaggugaagccggggacgcccgcgcaggagguggaguuccucaagaagaacaagaucuacuucaugcagcgccaggacguccuggacaagaaccacguggccgacaucgacaagcugaucgacuacgccgccagcggcgaccccaccucccccgacaacaucgagagcccgaacgcccccuggguguucgcgugcgcccccgaccggugcccgccgaccugcaucuacgucgccggcauggccgagcucggggccuucuucuccauccugcaggacaugcgcaacaccaucauggcgagcaagacggugggcaccgccgaggagaagcugaagaagaaguccagcuucuaccaguccuaccuccgccggacccagagcauggggauccagcuggaccagcgcaucauccugcucuacaugcuggaguggggcaaggagaugguggaccacuuccaccugggcgacgacauggaccccgagcuccgggggcuggcccaggcccugaucgaccagaaggucaaggagaucagcaaccaggagccccucaagaucuga

SEQ ID NO: 6486 - RNA, 1302 nt, Artificial Sequence
  derived and/or modified CDS sequence (opt1) from PUUV(CG14444)__AJ277075.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcagauggccgacgcggugagccgcaagaagauggacaccaagcccaccgaccccacgggcaucgagcccgacgaccaccugaaggagcgguccagccuccgcuacgggaacgugcuggacgucaacgccaucgacaucgaggagcccuccggccagaccgccgacugguacaccaucgggguguacgugaucggcuucacccugccgaucauccucaaggcccuguacaugcugagcacgcgggggcgccagaccgucaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgugugcggccuguucccgacgcagauccagguccggaacaucaugagccccgugaugggggugaucggcuucuccuucuucgucaaggacugggccgaccgcauccgggaguucauggagaaggagugccccuucaucaagcccgaggugaagccggggacccccgcccaggaggccgaguuccucaagcgcaacaagaucuacuucaugcagcggcaggaggugcuggacaagaaccacgucgcggacaucgacaagcugaucgacuacgccgccagcggcgaccccaccucccccgacaacaucgaggccccgaacgcccccuggguguucgcgugcgcccccgaccgcugcccgccgaccugcaucuacguggccggcauggccgagcucggggccuucuucagcauccugcaggacaugcggaacacgaucauggcguccaagaccgucggcaccgccgaggagaagcugaagaagaaguccagcuucuaccagagcuaccuccgccgcacccaguccauggggauccagcuggaccagcggaucauccugcucuacaugcuggaguggggcaaggagaugguggaccacuuccaccugggcgacgacauggaccccgagcuccgcgggcuggcccaggcccugaucgaccagaaggugaaggagaucagcaaccaggagccccucaagaucuga

SEQ ID NO: 6487 - RNA, 1302 nt, Artificial Sequence
  derived and/or modified CDS sequence (opt1) from PUUV(CG14445)__AJ277076.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcagauggccgacgcggugagccgcaagaagauggacaccaagcccaccgaccccacgggcaucgagcccgacgaccaccugaaggagcgguccagccuccgcuacgggaacgugcuggacgucaacgccaucgacaucgaggagcccuccggccagaccgccgacugguacaccaucgggguguacgugaucggcuucacccugccgaucauccucaaggcccuguacaugcugagcacgcgggggcgccagaccgucaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgugugcggccuguucccgacgcagauccagguccggaacaucaugagccccgugaugggggugaucggcuucuccuucuucgucaaggacugggccgaccgcauccgggaguucauggagaaggagugccccuucaucaagcccgaggugaagccggggacccccgcccaggaggccgaguuccucaagcgcaacaucaucuacuucaugcagcggcaggaggugcuggacaagaaccacgucgcggacaucgacaagcugaucgacuacgccgccagcggcgaccccaccucccccgacaacaucgaggccccgaacgcccccuggguguucgcgugcgcccccgaccgcugcccgccgaccugcaucuacguggccggcauggccgagcucggggccuucuucagcauccugcaggacaugcggaacacgaucauggcguccaagaccgucggcaccgccgaggagaagcugaagaagaaguccagcuucuaccagagcuaccuccgccgcacccaguccauggggauccagcuggaccagcggaucauccugcucuacaugcuggaguggggcaaggagaugguggaccacuuccaccugggcgacgacauggaccccgagcuccgcgggcuggcccaggcccugaucgaccagaaggugaaggagaucagcaaccaggagccccucaagaucuga

SEQ ID NO: 6488 - RNA, 1302 nt, Artificial Sequence
  derived and/or modified CDS sequence (opt1) from PUUV(CG1820/POR)__KT885052.1__N
augagcgaccugaccgacauccaggaggagaucacccgccacgagcagcagcucguggucgcccggcagaagcugaaggacgccgagcgcgcgguggagguggaccccgacgacgucaacaaguccacgcugcaggcccggcagcagaccgugagcgcccucgaggacaagcuggccgacuacaagcgccggauggccgacgcggugucccgcaagaagauggacaccaagccgaccgaccccacgggcaucgagcccgacgaccaccugaaggagcggagcucccuccgcuacgggaacguccuggacgugaacgccaucgacaucgaggagcccagcggccagaccgccgacugguacaccaucgggguguacgucaucggcuucaccaucccgaucauccugaaggcccucuacaugcuguccacgcgggggcgccagaccgugaaggagaacaagggcacccggauccgcuucaaggacgacaccagcuucgaggacaucaacggcauccggcgccccaagcaccuguacguguccaugcccacggcgcagagcaccaugaaggccgaggagcucacccccgggcgguuccgcaccaucgucugcggccuguucccgacgcagauccaggugcggaacaucaugucccccgugaugggggucaucggcuucagcuucuucgugaaggacuggcccgagaagauccgcgaguucauggagaaggagugccccuucaucaagccggaggugaagcccgggacccccgcccaggaggucgaguuccugaagcggaaccgcguguacuucaugacccggcaggacgugcucgacaagaaccacgucgccgacaucgacaagcugaucgacuacgccgcguccggcgaccccaccagcccggacgacaucgagucccccaacgcccccuggguguucgccugcgcccccgaccgcugcccgcccacgugcaucuacguggccggcauggcggagcugggggccuucuucagcauccuccaggacaugcgcaacaccaucauggccuccaagaccgucggcaccgccgaggagaagcugaagaagaaguccagcuucuaccagagcuaccugcggcgcacgcagagcauggggauccagcucgaccagcggaucauccugcuguacaugcucgaguggggcaaggagaugguggaccacuuccaccugggcgacgacauggaccccgagcugcgcgggcucgcccagucccugaucgaccagaaggucaaggagaucagcaaccaggagccccugaagaucuga

SEQ ID NO: 6489 - RNA, 1302 nt, Artificial Sequence
  derived and/or modified CDS sequence (opt1) from PUUV(Couvin/59Cg/97)__AJ277034.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcagauggccgacgcggugagccgcaagaagauggacaccaagcccaccgaccccacgggcaucgagcccgacgaccaccugaaggagcgguccagccuccgcuacgggaacgugcuggacgucaacgccaucgacaucgaggagcccuccggccagaccgccgacugguacaccaucgggguguacgugaucggcuucacccugccgaucauccucaaggcccuguacaugcugagcacgcgggggcgccagaccgucaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgugugcggccuguucccgacgcagauccagguccggaacaucaugagccccgugaugggggugaucggcuucuccuucuucgucaaggacugggccgaccgcauccgggaguucauggagaaggagugccccuucaucaagcccgaggugaagccggggacccccgcccaggaggccgaguuccucaagcgcaacaagaucuacuucaugcagcggcaggacgugcuggacaagaaccacgucgcggacaucgacaagcugaucgacuacgccgccagcggcgaccccaccucccccgacaacaucgaggccccgaacgcccccuggguguucgcgugcgcccccgaccgcugcccgccgaccugcaucuacguggccggcauggccgagcucggggccuucuucagcauccugcaggacaugcggaacacgaucauggcguccaagaccgucggcaccgccgaggagaagcugaagaagaaguccagcuucuaccagagcuaccuccgccgcacccaguccauggggauccagcuggaccagcggaucauccugcucuacaugcuggaguggggcaaggagaugguggaccacuuccaccugggcgacgacauggaccccgagcuccgcgggcuggcccaggcccugaucgaccagaaggugaaggagaucagcaaccaggagccccucaagaucuga

SEQ ID NO: 6490 - RNA, 1302 nt, Artificial Sequence
  derived and/or modified CDS sequence (opt1) from PUUV(Evo/12Cg/93)__Z30702.1__N
augagcgaccugaccgacauccaggaggacaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgccggauggccgacgcggugagccgcaagaagauggacaccaagcccaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucaccaucccgaucauccugaaggcccucuacaugcugagcacgcgggggcgccagaccgugaaggagaacaagggcacccggauccgcuucaaggacgacaccuccuucgaggacaucaacggcauccggcgccccaagcaccuguacgugagcaugcccacggcgcaguccaccaugaaggccgaggagcucacccccgggcgguuccgcaccaucgucugcggccuguucccgacgcagauccaggugcggaacaucaugagccccgugaugggggucaucggcuucuccuucuucgugaaggacuggcccgagcgcauccgggaguucauggagaaggagugccccuucaucaagccggagaucaagcccgggacccccgcccaggagauggagaugcugaagcgcaacaagaucuacuucaugcagcggcaggacgugcucgacaagaaccacgucgccgacaucgacaagcugaucgacuacgccgcgagcggcgaccccaccuccccggacaacaucgacagccccaacgcccccuggguguucgccugcgcccccgaccgcugcccgccgaccugcaucuacguggccggcauggcggagcugggggccuucuucuccauccuccaggacaugcgcaacacgaucauggccagcaagaccgucggcaccgccgaggagaagcugcggaagaaguccagcuucuaccaguccuaccugcgccggacccagagcauggggauccagcucgaccagcgcaucauccugcuguucaugcucgaguggggcaaggagaugguggaccacuuccaccugggcgacgacauggaccccgagcugcgggggcucgcccaggcgcugaucgaccagaaggugaaggagaucagcaaccaggagccccugaagaucuga

SEQ ID NO: 6491 - RNA, 1302 nt, Artificial Sequence
  derived and/or modified CDS sequence (opt1) from PUUV(Evo/14Cg/93)__Z30704.1__N
augagcgaccugaccgacauccaggaggacaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccaacuacaagcgccggauggccgacgcggugagccgcaagaagauggacaccaagcccaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucaccaucccgaucauccugaaggcccucuacaugcugagcacgcgggggcgccagaccgugaaggagaacaagggcacccggauccgcuucaaggacgacaccuccuucgaggacaucaacggcauccggcgccccaagcaccuguacgugagcaugcccacggcgcaguccaccaugaaggccgaggagcucacccccgggcgguuccgcaccaucgucugcggccuguucccgacgcagauccaggugcggaacaucaugagccccgugaugggggucaucggcuucuccuucuucgugaaggacuggcccgagcgcauccgggaguucauggagaaggagugccccuucaucaagccggagaucaagcccgggacccccgcccaggagauggagaugcugaagcgcaacaagaucuacuucaugcagcggcaggacgugcucgacaagaaccacgucgccgacaucgacaagcugaucgacuacgccgcgagcggcggccccaccuccccggacaacaucgacagccccaacgcccccuggguguucgccugcgcccccgaccgcugcccgccgaccugcaucuacguggccgggauggcggagcugggcgccuucuucuccauccuccaggacaugcgcaacacgaucauggccagcaagaccgucgggaccgccgaggagaagcugaagaagaaguccagcuucuaccaguccuaccugcggcgcacccagagcaugggcauccagcucgaccagcggaucauccugcuguucaugcucgaguggggcaaggagaugguggaccacuuccaccugggggacgacauggaccccgagcugcgcggccucgcccaggcgcugaucgaccagaaggugaaggagaucagcaaccaggagccccugaagaucuga

SEQ ID NO: 6492 - RNA, 1302 nt, Artificial Sequence
  derived and/or modified CDS sequence (opt1) from PUUV(Evo/15Cg/93)__Z30705.1__N
augagcgaccugaccgacauccaggaggacaucacccgccacgagcagcagcucguggucgcccggcagggccugaaggacgccgagcgcgcgguggagguggaccccgacgacgucaacaagaacgcccugcaggcccggcagcagacgguguccgcccucgaggacaagcuggccgacuacaagcgccggauggcggacgccgugagccgcaagaagauggacaccaagcccaccgaccccaccgggaucgagcccgacgaccaccugaaggagcgguccagccuccgcuacggcaacgucuucgacgugaacgccaucgacaucgaggagcccuccgggcagacggccgacugguacaccaucggcguguacgucaucggguucaccaucccgaucauccugaaggcgcuguacaugcucagcacccggggccgccagacggugaaggagaacaagggcacccggauccgcuucaaggacgacaccuccuucgaggacaucaacgggauccggcgccccaagcaccuguacgugagcaugcccaccgcccaguccacgaugaaggccgaggagcugacccccggccgguuccgcaccaucgucugcggccucuucccgacccagauccaggugcggaacaucaugagccccgugaugggggucaucggguucuccuucuucgugaaggacuggcccgagcgcauccgggaguucauggagaaggagugccccuucaucaagccggagaucaagcccggcacgcccgcccaggagauggagaugcugaagcgcaacaagaucuacuucaugcagcggcaggacgugcuggacaagaaccacgucgccgacaucgacaagcucaucgacuacgcggccagcggcgaccccaccuccccggacaacaucgacagccccaacgcccccuggguguucgccugcgcccccgaccgcugcccgccgaccugcaucuacguggcggggauggccgagcugggcgccuucuucuccauccugcaggacaugcgcaacaccaucauggccagcaagacggucgggaccgccgaggagaagcucaagaagaaguccagcuucuaccaguccuaccugcggcgcacccagagcaugggcauccagcuggaccagcggaucauccuccuguucaugcuggaguggggcaaggagaugguggaccacuuccaccucggggacgacauggaccccgagcugcgcggccuggcgcaggcccucaucgaccagaaggugaaggagaucagcaaccaggagccccugaagaucuga

SEQ ID NO: 6493 - RNA, 1302 nt, Artificial Sequence
  derived and/or modified CDS sequence (opt1) from PUUV(Faboviken/Mg26/05)__GQ339484.1__N
augagcgaccuggccgacauccaggacgagaucacccgccacgagcagcagcucguggccgcgcggcagaagcugaaggacgccgagcgcgccgucgagauggaccccgacgacgugaacaagaacacccugcaggcccggcagcagacgguguccgcccucgaggacaagcuggcggacuucaagcgccggauggccgacgccgucagccgcaagaagauggacaccaagcccaccgaccccaccggcaucgagcccgacgaccaccugaaggagaucuccagccuccgguacgggaacgugcuggacgugaacgccaucgacaucgaggagcccuccggccagacggcggacugguacaccaucggggucuacgugaucggcuucacccugccgaucauccucaaggcccuguacaugcugagcacccgcgggcggcagacggugaaggagaacaagggcacccgcauccgguucaaggacgacaccuccuucgaggacaucaacggcauccgccggcccaagcaccucuacgucagcaugcccaccgcccaguccacgaugaaggccgaggagcugacccccgggcgcuuccggaccaucgugugcggccuguucccgacccagauccaggugcgcaacaucaugagccccgucaugggggugaucggcuucuccuucuucgugaaggacugggccgagcggauccgcgaguucauggagaaggagugccccuucaucaagcccgaggucaagccggggacgcccgcgcaggagguggaguuccucaagaagaacaagaucuacuucaugcagcggcaggacgugcuggacaagaaccacgucgccgacaucgacaagcugaucgacuacgccgccagcggcgaccccaccucccccgacaacaucgagagcccgaacgcccccuggguguucgcgugcgcccccgaccgcugcccgccgaccugcaucuacguggccggcauggccgagcucggggccuucuucuccauccugcaggacaugcggaacaccaucauggcgagcaagacggucggcaccgccgaggagaagcugaagaagaaguccagcuucuaccaguccuaccuccgccgcacccagagcauggggauccagcuggaccagcggaucauccugcucuacaugcuggaguggggcaaggagaugguggaccacuuccaccugggcgacgacauggaccccgagcuccgcgggcuggcccaggcccugaucgaccagaaggugaaggagaucagcaaccaggagccccucaagaucuga

SEQ ID NO: 6494 - RNA, 1302 nt, Artificial Sequence
  derived and/or modified CDS sequence (opt1) from PUUV(Fyn)__AJ238791.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacugggccgagcggauccgcgaguucauggagaaggagugccccuucaucaagcccgagcucaagccggggaccaacgcccaggaggccgaguuccugaagaagaaccggguguacuuccugaaccgccaggacgugcucgacaagaaccacgucgcggacaucgacaagcugaucgacuacgccgccagcggcgaccccaccucccccgacaacaucgaggcccccaacgccccguggguguucagcugcgcgcccgaccggugcccgccgaccugcaucuacguggccggcauggccgagcugggggccuucuucuccauccuccaggacaugcgcaacacgaucauggccagcaagaccgucggcaccgcggaggagaagcugaagaagaaguccagcuucuaccaguccuaccugcgccggacccagagcauggggauccagcucgaccagcgcaucauccugcuguacaugcucgaguggggcaaggagaugguggaccacuuccaccugggcgacgacauggaccccgagcugcgggggcucgcccaggcccugaucgaccagaaggugaaggagaucagcaaccaggagccccugaagaucuga

SEQ ID NO: 6495 - RNA, 1302 nt, Artificial Sequence
  derived and/or modified CDS sequence (opt1) from PUUV(Fyn131)__AJ278093.1__N
augagcgaccugaccgacauccaggaggacaucacccgccacgagcagcagcucguggucgcccggcagaagcugaaggacgccgagaaggcgguggagauggaccccgacgacgugaacaagaacacgcuggaggcccgccagcagaccgucuccgcccucgaggacaagcuggccgacuucaagcggcgcaugaccgacgccgugagccggaagaagauggacaccaagccgacggaccccaccggcaucgagcccgacgaccaccugaaggagcgcuccagccuccgguacgggaacgugcuggacgucaacgcgaucgacaucgaggagcccuccggccagaccgccgacugguacaccaucgggguguacgugaucggcuucacgcugccgaucauccucaaggcccuguacaugcugagcacccgcgggcggcagaccgucaaggagaacaagggcacccgcauccgguucaaggacgacacguccuucgaggacaucaacggcauccgccggcccaagcaccucuacgugagcaugcccaccgcccccuccaccaugaaggcggaggagcugaccccggggcgcuuccggacgaucgugugcggccuguuccccacccagauccagguccgcaacaucaugagccccgugaugggggugaucggcuccagcuucuucgucaaggacugggccgaccggauccgcgaguucauggagaaggagugccccuucgugaagccggagcucaagcccgggaccaacgcccaggaggccgaguuccugaagaagaaccggguguacuucaugaaccgccaggacguccuggacaagaaccacguggccgacaucgacaagcucaucgacuacgcggccuccggcgacccgaccugccccgacaacaucgaggcccccaacgcccccuggggcuucgccugcgcgccccaccggugcccgcccacgugcaucuacguggccgggauggccgagcugggcgccuucuucagcauccugcaggacaugcgcaacaccaucauggccuccaagaccgucgggaccgcggaggagaagcucaagaagaaguccagcuucuaccagagcuaccugcgccggacgcaguccaugggcauccagcuggaccagcgcaucauccuccuguacaugcuggaguggggccgggagaugguggaccacuuccaccucggggacgacauggaccccgagcugcgcggccuggcccaggcccucaucaaccagaaggugaaggagaucagcaaccaggagccccugaagaucuga

SEQ ID NO: 6496 - RNA, 1302 nt, Artificial Sequence
  derived and/or modified CDS sequence (opt1) from PUUV(Fyn47)__AJ278092.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcccuccaccaugaaggccgaggagcugaccccggggcgcuuccggaccaucgugugcggccuguuccccacgcagauccagguccgcaagaucaugagccccgugaugggggugaucggcuucuccuucuucgucaaggacuggguggagcggauccgcgaguucauggagaaggagugccccuucgugaagccggagcucaagcccgggaccaacgcccaggaggccgaguuccugaagaagaaccgggucuacuucaugaaccgccaggacgugcuggacaagaaccacguggccgacaucgacaagcucaucgacuacgcggccagcggcgaccccaccucccccgacaacaucgaggccccgaacgcccccugggucuucgccugcgcgccccaccggugcccgccgaccugcaucuacguggccggcauggccgagcugggggccuucuucagcauccugcaggacaugcgcaacgccaucauggcguccaagacggugggcaccgccgaggagaagcucaagaagaaguccagcuucuaccagagcuaccugcgccggacccaguccgucgggauccagcuggaccagcgcaucauccuccuguacaugcuggaguggggccgggagaugguggaccacuuccaccucggcgacgacauggaccccgagcugcgcgggcuggcccaggcccucaucgaccagaaggucaaggagaucagcaaccaggagccccugaagaucuga

SEQ ID NO: 6497 - RNA, 1302 nt, Artificial Sequence
  derived and/or modified CDS sequence (opt1) from PUUV(Gomselga)__AJ238790.1__N
augagcgaccugaccgacauccaggaggacaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgcaagauggccgacgcggugagccggaagaagauggacaccaagccgaccgaccccacgggcaucgagcccgacgaccaccugaaggagcgcuccagccuccgguacgggaacguccuggacgugaacgccaucgacaucgaggaccccuccggccagaccgccgacugguacaccaucgggguguacgucaucggcuucacccugccgaucauccucaaggcccuguacaugcugagcacgcgcgggcggcagaccgugaaggagaacaagggcacccgcauccgguucaaggacgacaccuccuucgaggagaucaacggcauccgccggcccaagcaccucuacgugagcaugcccacggcgcaguccaccaugaaggccgaggagcugacccccgggcgcuuccggaccaucgucugcggccuguucccgacgcagauccaggugcgcaacaucgugagccccgucaugggggugaucggcuucuccuucuucgugaaggacuggagccagcggaucaccgaguucauggagaaggagugccccuucaucaagcccgaggucaagccggggacccccgcccaggagaucgagauguucaagcgcaacaagaucuacuucaugcagcggcaggacgugcucgacaagaaccacguggccgacaucgacaaguccaucgacuacgccgcgagcgaggaccccaccucccccgacaacaucgacagcccgaacgcccccugggucuucgccugcgcccccgaccgcugcccgcccacgugcaucuacguggccggcauggcggagcugggcgccuucuucuccauccugcaggacaugcggaacaccaucauggccagcaagaccguggggaccgccgaggagaagcucaagaagaaguccagcuucuaccagagcuaccugcgccgcacgcaguccaugggcauccagcuggaccagcggaucauccuccuguucaugcuggagugggggaaggagauggucgaccacuuccaccucggcgacgacauggaccccgagcugcgcggccuggcccaggcgcucaucgaccagaaggugaaggagaucagcaaccaggagccccugaagaucuga

SEQ ID NO: 6498 - RNA, 1302 nt, Artificial Sequence
  derived and/or modified CDS sequence (opt1) from PUUV(Gyttjea/Mg19/05)__GQ339480.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcagauggccgacgcggugagccgcaagaagauggacaccaagcccaccgaccccacgggcaucgagcccgacgaccaccugaaggagcgguccagccuccgcuacgggaacgugcuggacgucaacgccaucgacaucgaggagcccuccggccagaccgccgacugguacaccaucgggguguacgugaucggcuucacccugccgaucauccucaaggcccuguacaugcugagcacgcgggggcgccagaccgucaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgugugcggccuguucccgacgcagauccagguccggaacaucaugagccccgugaugggggugaucggcuucgccuucuucgucaaggggugggccgaccgcauccgggaguucauggagaaggagugccccuucaucaagcccgaggugaagccgggcacccccacccaggagaucgaguuccucaagaagaacaagguguacuuccuggaccgccagaccguccuggacaagaaccacguggccgacaucgacaagcucaucgacuacgcggccuccggcgaccccacgagccccgacaacaucgaguccccgaacgcccccuggguguucgccugcgcccccgaccggugcccgccgaccugcaucuacgucgcggggauggccgagcugggcgccuucuucagcauccugcaggacaugcgcaacaccaucauggccuccaagaccguggggacggccgaggagaagcucaagaagaaguccagcuucuaccagagcuaccugcggcgcacccaguccaugggcauccagcuggaccagcgcaucauccuccuguucaugcuggaguggggcaaggagaugguggaccacuuccaccucggggacgacauggaccccgagcugcggggccuggcgcaggcccucaucgaccagaaggucaaggagaucagcaaccaggagccccugaagaucuga

SEQ ID NO: 6499 - RNA, 1302 nt, Artificial Sequence
  derived and/or modified CDS sequence (opt1) from PUUV(Karhumaki)__AJ238788.1__N
augagcgaccugaccgacauccaggaggacaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgcaagauggccgacgcggugagccggaagaagauggacaccaagcccaccgaccccacgggcaugaagcccgacguccaccugaaggagcgcuccagccucgaguacgggaacgugcuggacgugaacgccaucgacaucgaggagcccuccggccagaccgccgacugguacaccaucggggucuacgugaucggcuucacccugccgaucauccucaaggcccuguacaugcugagcacgcgggggcgccagaccgugaaggagaacaagggcacccggauccgcuucaaggacgacaccuccuucgaggacaucaacggcauccggcgccccaagcaccucuacgucagcaugcccacggcgcaguccaccaugaaggccgaggagcugacccccgggcgguuccgcaccaucgugugcggccuguucccgacgcagauccaggugcggaacaucaugagccccgucaugggggugaucggcuucuccuucuucgugaaggacuggagcgagcgcauccgggaguucauggagaaggagugccccuucaucaagcccgaggucaagccggggacccccgcccaggagaucgagaugcuccgccggaacaagaucuacuucaugcagcgccaggacgugcuggacaagaaccacguggccgacaucgacaagcugaucgaccucgccgcguccggcgaccccaccagccccgacaacaucgacuccccgaacgcccccugggucuucgccugcgcccccgugcggugcccgccgaccugcaucuacguggccggcauggcggagcugggggccuucuucagcauccugcaggacaugcgcaacacgaucauggccuccaagaccgucggcaccgccgaggagaagcucaagaagaaguccagcuucuaccagagcuaccugcgccggacccagagcauggggauccagcuggaccagcgcaucauccuccuguucaugcuggaguggggcaaggagaugguggaccacuuccaccucggcgacgacauggaccccgagcugcgggggcuggcccaggcgcucaucgaccagaaggucaaggagaucuccaaccaggagccccugaagaucuga

SEQ ID NO: 6500 - RNA, 1302 nt, Artificial Sequence
  derived and/or modified CDS sequence (opt1) from PUUV(Kolodozero)__AJ238789.1__N
augagcgaccugaccgacauccaggaggacaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgccggauggccgacgcggugagccgcaagaagauggacaccaagcccaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucacccugccgaucauccucaaggcccuguacaugcugagcacgcgggggcgccagaccgugaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgucugcggccugaucccgacgcagauccaggugcggaacaucaugagccccgugaugggggucaucggcuucuccuucuucgugaaggacuggagcgagcgcauccgggaguucauggagaaggagugccccuucaucaagcccgaggugaagccggggaccuccgcccaggagaucgagaugcucaagcgcaacaagaucuacuucaugcagcggcaggacguccuggacaagaaccacguggccgacaucgacaagcugaucgacuacgccgcgagcggcgaccccaccucccccgacaacaucgacagccccaacgccccguggguguucgccugcgcccccgaccgcugcccgccgaccugcaucuacgucgccggcauggcggagcucggggccuucuucuccauccugcaggacaugcgcaacacgaucauggccagcaagaccgugggcaccgccgaggagaagcugaagaagaaguccagcuucuaccagagcuaccuccggcgcacccaguccauggggaucccccuggaccagcggaucauccuccuguucaugcuggaguggggccaggagaugguggaccacuuccaccugggcgacgacauggaccccgagcuccgcgggcuggcccaggcgcugaucgaccagaaggucaaggagaucagcaaccaggagccccucaagaucuga

SEQ ID NO: 6501 - RNA, 1302 nt, Artificial Sequence
  derived and/or modified CDS sequence (opt1) from PUUV(Kuhmo/X11)__GU808825.1__N
augagcgaccugaccgacauccaggaggacaucacccgccacgagcagcagcucguggucgcccggcagaagcugaaggacgccgagcgcgcggugggcguggaccccgacgacgucaacaagaacacgcugcaggcccggcagcagaccguguccgcccucgaggacaagcuggccgacuacaagcgccggauggccgacgcggugagccgcaagaagauggacaccaagcccaccgaccccacggggaucgagcccgacgaccaccugaaggagcgguccagccuccgcuacggcaacguccuggacgugaacgccaucgacaucgaggagcccuccgggcagaccgccgacugguacaccaucggcguguacgucaucggguucacccugccgaucauccucaaggcccuguacaugcugagcacgcggggccgccagaccgugaaggagaacaagggcacccggauccgcuucaaggacgacaccuccuucgaggacaucaacgggauccggcgccccaagcaccucuacgugagcaugcccacggcgcaguccaccaugaaggccgaggagcugacccccggccgguuccgcaccaucgucugcgggcuguucccgacgcagauccaggugcggaacaucaugagccccgugaugggcgucaucggguucuccuucuucgugaaggacuggagcgagcgcauccgggaguucauggagaaggagugccccuucaucaagcccgaggugaagccgggcacccccgcccaggagaucgagaugcucaagcgcaaccggaucuacuucaugcagcgccaggacguccuggacaagaaccacguggccgacaucgacaagcugaucgacuacgccgcguccggcgaccccaccagccccgacaacaucgacuccccgaacgcccccuggguguucgccugcgcccccgaccgcugcccgccgaccugcaucuacgucgccgggauggcggagcucggcgccuucuucagcauccugcaggacaugcggaacacgaucauggccuccaagaccguggggaccagcgaggagaagcugaagaagaaguccagcuucuaccagagcuaccuccgccggacccaguccaugggcauccagcuggaccagcgcaucauccuccuguucaugcuggaguggggcaaggagaugguggaccacuuccaccugggggacgacauggaccccgagcuccggggccuggcccaggcccugaucgaccagaaggucaaggagaucagcaaccaggagccccucaagaucuga

SEQ ID NO: 6502 - RNA, 1302 nt, Artificial Sequence
  derived and/or modified CDS sequence (opt1) from PUUV(Kuhmo/X5)__GU808824.1__N
augagcgaccugaccgacauccaggaggacaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgccggauggccgacgcggugagccgcaagaagauggacaccaagcccaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucacccugccgaucauccucaaggcccuguacaugcugagcacgcgggggcgccagaccgugaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgucugcggccuguucccgacgcagauccaggugcggaacaucaugagccccgugaugggggucaucggcuucuccuucuucgugaaggacuggagcgagcgcauccgggaguucauggagaaggagugccccuucaucaagcccgaggugaagccggggacccccgcccaggagaucgagaugcucaagcgcaaccggaucuacuucaugcagcgccaggacguccuggacaagaaccacguggccgacaucgacaagcugaucgacuacgccgcguccggcgaccccaccagccccgacaacaucgacuccccgaacgcccccuggguguucgccugcgcccccgaccgcugcccgccgaccugcaucuacgucgccggcauggcggagcucggggccuucuucagcauccugcaggacaugcggaacacgaucauggccuccaagaccgugggcaccgccgaggagaagcugaagaagaaguccagcuucuaccagagcuaccuccgccggacccagagcauggggauccagcuggaccagcgcaucauccuccuguucaugcuggaguggggcaaggagaugguggaccacuuccaccugggcgacgacauggaccccgagcuccgggggcuggcccaggcgcugaucgaccagaaggucaaggagaucuccaaccaggagccccucaagaucuga

SEQ ID NO: 6503 - RNA, 1302 nt, Artificial Sequence
  derived and/or modified CDS sequence (opt1) from PUUV(Ljustrask/Mg20/05)__GQ339481.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcagauggccgacgcggugagccgcaagaagauggacaccaagccgaccgaccccacgggcaucgagcccgacgaccaccugaaggagcgguccagccuccgcuacgggaacgugcuggacgucaacgccaucgacaucgaggagcccuccggccagaccgccgacugguacaccaucgggguguacgugaucggcuucacccugccgaucauccucaaggcccuguacaugcugagcacgcgggggcgccagaccgucaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgugugcggccuguucccgacgcagauccagguccggaacaucaugagccccgugaugggggugaucggcuucgccuucuucgucaaggggugggccgaccgcauccgggaguucauggagaaggagugccccuucaucaagcccgaggugaagccgggcacccccacccaggagaucgaguuccucaagaagaacaagguguacuuccuggaccgccagaacguccuggacaagaaccacguggccgacaucgacaagcucaucgacuacgcggccuccggcgaccccaccagccccgacaacaucgaguccccgaacgcccccuggguguucgccugcgcccccgaccggugcccgcccacgugcaucuacgucgcggggauggccgagcugggcgccuucuucagcauccugcaggacaugcgcaacaccaucauggccuccaagaccguggggaccgccgaggagaagcucaagaagaaguccagcuucuaccagagcuaccugcggcgcacgcaguccaugggcauccagcuggaccagcgcaucauccuccuguucaugcuggaguggggcaaggagaugguggaccacuuccaccucggggacgacauggaccccgagcugcggggccuggcgcaggcccucaucgaccagaaggucaaggagaucagcaaccaggagccccugaagaucuga

SEQ ID NO: 6504 - RNA, 1302 nt, Artificial Sequence
  derived and/or modified CDS sequence (opt1) from PUUV(Mangelbo/Mg1/05)__GQ339485.1__N
augagcgaccugaccgacauccaggacgagaucacccgccacgagcagcagcucguggccgcccggcagaagcugaaggacgcggagcgcgccgucgagauggaccccgacgacgugaacaagaacacgcugcaggcccggcagcagaccguguccgcccucgaggacaagcuggccgacuucaagcgccggauggcggacgccgucagccgcaagaagauggacaccaagcccaccgaccccacgggcaucgagcccgacgaccaccugaaggagcgguccagccuccgcuacggggacgugcuggacgugaacgccaucgacaucgaggagcccuccggccagaccgccgacugguacaccaucggggucuacgugaucggcuucacccugccgaucauccucaaggcgcuguacaugcugagcacgcgggggcgccagaccgugaaggagaacaagggcacccggauccgcuucaaggacgacaccuccuucgaggacaucaacggcauccggcgccccaagcaccucuacgucagcaugcccacggcccaguccaccaugaaggccgaggagcugacccccgggcgguuccgcaccaucgugugcggccuguucccgacgcagauccaggugcggaacaucaugagccccgucaugggggugaucggcuucuccuucuucgugaaggacugggccgagcgcauccgggaguucauggacaaggagugccccuucaucaagcccgaggucaagccggggacccccgcccaggagaucgaguuccucaagaagaacaagaucuacuucaugcagcgccaggacgugcuggacaagaaccacguggcggacaucgacaagcugaucgacuacgccgccagcggcgaccccaccucccccgacaacaucgagagcccgaacgcccccugggucuucgccugcgcgcccgaccggugcccgccgaccugcaucuacguggccggcauggccgagcucggggccuucuucuccauccugcaggacaugcgcaacacgaucauggccagcaagaccgugggcaccgcggaggagaagcugaagaagaaguccagcuucuaccaguccuaccuccgccggacccagagcauggggauccagcuggaccagcgcaucauccugcucuacaugcuggaguggggcaaggagauggucgaccacuuccaccugggcgacgacauggaccccgagcuccgggggcugacgcaggcccugaucgaccagaaggugaaggagaucagcaaccccgagccccucaagaucuga

SEQ ID NO: 6505 - RNA, 1302 nt, Artificial Sequence
  derived and/or modified CDS sequence (opt1) from PUUV(Momignies/55Cg/96)__AJ277033.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcagauggccgacgcggugagccgcaagaagauggacaccaagcccaccgaccccacgggcaucgagcccgacgaccaccugaaggagcgguccagccuccgcuacgggaacgugcuggacgucaacgccaucgacaucgaggagcccuccggccagaccgccgacugguacaccaucgggguguacgugaucggcuucacccugccgaucauccucaaggcccuguacaugcugagcacgcgggggcgccagaccgucaaggagaacaagggcacccggauccgcuucaaggacgacaccuccuucgaggacaucaacggcauccggcgcagcaagcaccucuacguguccaugcccacggcgcagagcaccaugaaggccgaggagcugacccccgggcgguuccgcaccaucgugugcggccuguuccccacgcagauccagguccggaacaucauguccccggugaugggggugaucggcuucagcuucuucgucaaggacugggccgaccgcauccgggaguucauggagaaggagugccccuucaucaagcccgaggugaagcccgggaccccggcccaggaggccgaguuccucaagcgcaacaagaucuacuucaugcagcggcaggacgugcuggacaagaaccacgucgcggacaucgacaagcugaucgacuacgccgccuccggcgaccccaccagccccgacaacaucgaggcccccaacgccccguggguguucgcgugcgcccccgaccgcugcccgccgaccugcaucuacguggccggcauggccgagcucggggccuucuucuccauccugcaggacaugcggaacacgaucauggcgagcaagaccgucggcaccgccgaggagaagcugaagaagaaguccagcuucuaccaguccuaccuccgccgcacccagagcauggggauccagcuggaccagcggaucauccugcucuacaugcuggaguggggcaaggagaugguggaccacuuccaccugagcgacgacauggaccccgagcuccgcggccuggcccaggcccugaucgaccagaaggugaaggagaucuccaaccaggagccccucaagaucuga

SEQ ID NO: 6506 - RNA, 1302 nt, Artificial Sequence
  derived and/or modified CDS sequence (opt1) from PUUV(Montbliart/23Cg/96)__AJ277031.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcagauggccgacgcggugagccgcaagaagauggacaccaagcccaccgaccccacgggcaucgagcccgacgaccaccugaaggagcgguccagccuccgcuacgggaacgugcuggacgucaacgccaucgacaucgaggagcccuccggccagaccgccgacugguacaccaucgggguguacgugaucggcuucacccugccgaucauccucaaggcccuguacaugcugagcacgcgggggcgccagaccgucaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgugugcggccuguucccgacgcagauccagguccggaacaucaugagccccgugaugggggugaucggcuucuccuucuucgucaaggacugggccgaccgcauccgggaguucauggagaaggagugccccuucaucaagcccgaggugaagccggggacccccgcccaggaggccgaguuccuccgccggaacaagaucuacuucaugcagcgccaggaggugcuggacaagaaccacgucgcggacaucgacaagcugaucgacuacgccgccagcggcgaccccaccucccccgacaacaucgaggccccgaacgcccccuggguguucgcgugcgcccccgaccggugcccgccgaccugcaucuacaucgccggcauggccgagcucggggccuucuucagcauccugcaggacaugcgcaacacgaucauggcguccaagaccgugggcaccgccgaggagaagcugaagaagaaguccagcuucuaccagagcuaccuccgccggacccaguccauggggauccagcuggaccagcgcaucauccugcucuacaugcuggaguggggcaaggagauggucgaccacuuccaccugggcgacgacauggaccccgagcuccgggggcuggcccaggcccugaucgaccagaaggugaaggagaucagcaaccaggagccccucaagaucuga

SEQ ID NO: 6507 - RNA, 1302 nt, Artificial Sequence
  derived and/or modified CDS sequence (opt1) from PUUV(MuEb10Karlstadt/10)__JN696373.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuacaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacugggccgagcggauccgcgaguucauggagaaggagugccccuucaucaagcccgagaucaagccggggacccccgugcaggaggccgaguuccucaagcggaacaagguguacuucaugcagcgccaggagguccuggacaagaaccacguggccgacaucgacaagcugaucgacuacgcggccagcggcgaccccaccucccccgacaacaucgagagcccgaacgcccccuggguguucgccugcgcccccgaccggugcccgccgaccugcaucuacgucgcgggcauggccgagcucggggccuucuucuccauccugcaggacaugcgcaacacgaucauggccagcaagaccgugggcaccgccgaggagaagcugaagaagaaguccagcuucuaccaguccuaccuccgccggacccagagcauggggauccagcuggaccagcgcaucauccugcucuacaugcuggaguggggcaaggagaugguggaccacuuccaccugggcgacgacauggaccccgagcuccgggggcuggcgcaggcccugaucgaccagaaggucaaggagaucagcaaccaggagccccucaagaucuga

SEQ ID NO: 6508 - RNA, 1302 nt, Artificial Sequence
  derived and/or modified CDS sequence (opt1) from PUUV(MuEb12Lackenberg/10)__JN696374.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuacaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacugggccgagcggauccgcgaguucauggagaaggagugccccuucaucaagcccgagaugaagccggggacccccgcccaggaggccgaguuccucaagcggaacaagguguacuucaugcagcgccaggacgugcuggacaagaaccacgucgcggacaucgacaagcugaucgacuacgccgccagcggcgaccccaccucccccgacaacaucgagagcccgaacgcccccuggguguucgccugcgcgcccgaccggugcccgccgaccugcaucuacguggccggcauggccgagcucggggccuucuucuccauccugcaggacaugcgcaacacgaucauggccagcaagaccgucggcaccgcggaggagaagcugaagaagaaguccagcuucuaccaguccuaccuccgccggacccagagcauggggauccagcuggaccagcgcaucauccugcucuacaugcuggaguggggcaaggagaugguggaccacuuccaccugggcgacgacauggaccccgagcuccgggggcuggcccaggcccugaucgaccagaaggugaaggagaucagcaaccaggagccccucaagaucuga

SEQ ID NO: 6509 - RNA, 1302 nt, Artificial Sequence
  derived and/or modified CDS sequence (opt1) from PUUV(Munga/Mg16/05)__GQ339487.1__N
augagcgaccugaccgacauccaggacgagaucacccgccacgagcagcagcucguggccgcccggcagaagcugaaggacgcggagcgcgccgucgagauggaccccgacgacgugaacaagaacacgcugcaggcccggcagcagaccguguccgcccucgaggacaagcuggccgacuucaagcgccggauggcggacgccgucagccgcaagaagauggacaccaagcccaccgaccccacgggcaucgagcccgacgaccaccugaaggagcgguccagccuccgcuacgggaacgugcuggacgugaacgccaucgacaucgaggagcccuccggccagaccgccgacugguacaccaucggggucuacgugaucggcuucacccugccgaucauccucaaggcgcuguacaugcugagcacgcgggggcgccagaccgugaaggagaacaagggcacccggauccgcuucaaggacgacaccuccuucgaggacaucaacggcauccggcgccccaagcaccucuacgucagcaugcccacggcccaguccaccaugaaggccgaggagcugacccccgggcgguuccgcaccaucgugugcggccuguucccgacgcagauccaggugcggaacaucaugagccccgucaugggggugaucggcuucuccuucuucgugaaggacugggccgagcgcauccgggaguucauggagaaggagugccccuucaucaagcccgaggucaagccggggacccccgcccaggagaucgaguuccucaagaagaacaagaucuacuucaugcagcgccaggacgugcuggacaagaaccacguggcggacaucgacaagcugaucgacuacgccgccagcggcgaccccaccucccccgacaacaucgagagcccgaacgcccccugggucuucgccugcgcgcccgaccggugcccgccgaccugcaucuacguggccggcauggccgagcucggggccuucuucuccauccugcaggacaugcgcaacacgaucauggccagcaagaccgugggcaccgcggaggagaagcugaagaagaaguccagcuucuaccaguccuaccuccgccggacccagagcauggggauccagcuggaccagcgcaucauccugcucuacaugcuggaguggggcaaggagauggucgaccacuuccaccugggcgacgacauggaccccgagcuccgggggcuggcccaggcccugaucgaccagaaggugaaggagaucagcaaccaggagccccucaagaucuga

SEQ ID NO: 6510 - RNA, 1302 nt, Artificial Sequence
  derived and/or modified CDS sequence (opt1) from PUUV(Munga/Mg2/05)__GQ339486.1__N
augagcgaccugaccgacauccaggacgagaucacccgccacgagcagcagcucguggccgcccggcagaagcugaaggacgcggagcgcgccgucgagauggaccccgacgacgugaacaagaacacgcugcaggcccggcagcagaccguguccgcccucgaggacaagcuggccgacuucaagcgccggauggcggacgccgucagccgcaagaagauggacaccaagcccaccgaccccacgggcaucgagcccgacgaccaccugaaggagcgguccagccuccgcuacgggaacgugcuggacaugaacgccaucgacaucgaggagcccuccggccagaccgccgacugguacaccaucgggguguacgucaucggcuucacccugccgaucauccucaaggcgcuguacaugcugagcacgcgggggcgccagaccgugaaggagaacaagggcacccggauccgcuucaaggacgacaccuccuucgaggacaucaacggcauccggcgccccaagcaccucuacgugagcaugcccacggcccaguccaccaugaaggccgaggagcugacccccgggcgguuccgcaccaucgucugcggccuguucccgacgcagauccaggugcggaacaucaugagccccgugaugggggucaucggcuucuccuucuucgugaaggacugggccgagcgcauccgggaguucauggagaaggagugccccuucaucaagcccgaggugaagccggggacccccgcccaggagaucgaguuccucaagaagaacaagaucuacuucaugcagcgccaggacguccuggacaagaaccacguggcggacaucgacaagcugaucgacuacgccgccagcggcgaccccaccucccccgacaacaucgagagcccgaacgcccccuggguguucgccugcgcgcccgaccggugcccgccgaccugcaucuacgucgccggcauggccgagcucggggccuucuucuccauccugcaggacaugcgcaacacgaucauggccagcaagaccgugggcaccgcggaggagaagcugaagaagaaguccagcuucuaccaguccuaccuccgccggacccagagcauggggauccagcuggaccagcgcaucauccugcucuacaugcuggaguggggcaaggagaugguggaccacuuccaccugggcgacgacauggaccccgagcuccgggggcuggcccaggcccugaucgaccagaaggucaaggagaucagcaaccaggagccccucaagaucuga

SEQ ID NO: 6511 - RNA, 1302 nt, Artificial Sequence
  derived and/or modified CDS sequence (opt1) from PUUV(PUU/Cg-Erft)__AJ238779.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcagauggccgacgcggugagccgcaagaagauggacaccaagcccaccgaccccacgggcaucgagcccgacgaccaccugaaggagcgguccagccuccgcuacgggaacgugcuggacgucaacgccaucgacaucgaggagcccuccggccagaccgccgacugguacaccaucgggguguacgugaucggcuucacccugccgaucauccucaaggcccuguacaugcugagcacgcgggggcgccagaccgucaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgugugcggccuguucccgacgcagauccagguccggaacaucaugagccccgugaugggggugaucggcuucuccuucuucgucaaggacugggccgaccgcaucaagaaguucauggagaaggagugccccuucaucaagcccgaggugaagccggggacccccagccaggaggccgaguuccucaagaugaaccggaucuacuucaugcagcgccaggaggugcuggacaagaaccacgucgccgacaucgacaagcugaucgacuacgcggccuccggcgaccccaccagccccgacaacaucgaggccccgaacgcccccuggguguucgccugcgcgcccgaccggugcccgccgaccugcaucuacguggccggcauggccgagcucggggccuucuucuccauccugcaggacaugcgcaacacgaucauggccagcaagaccgucggcaccgcggaggagaagcugaagaagaaguccagcuucuaccaguccuaccuccggcgcacccagagcauggggauccagcuggaccagcgcaucauccugcucuacaugcuggaguggggcaaggagaugguggaccacuuccaccugggcgacgacauggaccccgagcuccgggggcuggcccaggcccugaucgaccagaaggugaaggagaucagcaaccaggagccccucaagaucuga

SEQ ID NO: 6512 - RNA, 1302 nt, Artificial Sequence
  derived and/or modified CDS sequence (opt1) from PUUV(Puu/Kazan)__Z84204.1__N
augagcgaccugaccgacauccaggaggagaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgccggauggccgacgcggugagccgcaagaagauggacaccaagccgaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucaccaucccgaucauccugaaggcccucuacaugcugagcacgcgggggcgccagaccgugaaggagaacaagggcacccggauccgcuucaaggacgacaccuccuucgaggacaucaacggcauccggcgccccaagcaccuguacgugagcaugcccacggcgcaguccaccaugaaggccgaggagcucacccccgggcgguuccgcaccaucgucugcggccuguucccgacgcagauccaggugcggaacaucaugagccccgugaugggggucaucggcuucuccuucuucgugaaggacuggcccgagcgcauccgggacuucauggagaaggagagccccuucaucaagccggaggugaagcccgggacccccgcccaggagaucgaguuccugaagcgcaaccgggucuacuucaugacccgccaggacgugcucgacaagaaccacguggccgacaucgacaagcugaucgacuacgccgcguccggcgaccccaccagcccggacgacaucgagucccccaacgcccccugggucuucgccugcgcccccgaccgcugcccgcccacgugcaucuacguggccggcauggcggagcugggggccuucuucagcauccuccaggacaugcggaacaccaucauggccuccaagaccgugggcaccgccgaggagaagcugaagaagaaguccagcuucuaccagagcuaccugcgccggacgcagagcauggggauccagcucgaccagcgcaucauccugcuguacaugcucgaguggggcaaggagauggucgaccacuuccaccugggcgacgacauggaccccgagcugcgggggcucgcccagucccugaucgaccagaaggugaaggagaucagcaaccaggagccccugaagaucuga

SEQ ID NO: 6513 - RNA, 1302 nt, Artificial Sequence
  derived and/or modified CDS sequence (opt1) from PUUV(PUU/Mignovillard/CgY02/2005)__AM695638.1__N
augggcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucagcgcccucgaggacaagcuggccgacuucaagcggcgcauggccgacgcggugucccggaagaagauggacaccaagccgaccgaccccacggggaucgagcccgacgaccaccugaaggagcgcagcucccuccgguacggcaacgugcuggacgucaacgccaucgacaucgaggagcccagcgggcagaccgccgacugguacaccaucggcguguacgugaucggguucacccugccgaucauccucaaggcccuguacaugcuguccacgcgcggccggcagaccgucaaggagaacaagggcacccgcauccgguucaaggacgacaccagcuucgaggacaucaacgggauccgccggcccaagcaccucuacguguccaugcccacggcgcagagcaccaugaaggccgaggagcugacccccggccgcuuccggaccaucgugugcgggcuguucccgacgcagauccagguccgcaacaucaugucccccgugaugggcgugaucggguucagcuucuucgucaaggacuggaccgaccggauccgcgaguucauggagaaggagugccccuucaucaagcccgagaugaagccgggcacccccgcccaggaggccgaguuccucaagcggaacaagaucuacuucaugcagcgccaggacgugcuggacaagaaccacguggccgacaucgacaagcugaucgacuacgcggccuccggcgaccccaccagccccgacaacaucgaguccccgaacgcccccugggucuucgccugcgcccccgaccggugcccgcccacgugcaucuacguggcggggauggccgagcucggcgccuucuucagcauccugcaggacaugcgcaacaccaucauggccuccaagaccguggggaccgccgaggagaagcugaagaagaaguccagcuucuaccagagcuaccuccgccggacgcaguccaugggcauccagcuggaccagcgcaucauccugcucuacaugcuggaguggggcaaggagauggucgaccacuuccaccugggggacgacauggaccccgagcuccggggccuggcgcaggcccugaucgaccagaaggugaaggagaucagcaaccaggagccccucaagaucuga

SEQ ID NO: 6514 - RNA, 1302 nt, Artificial Sequence
  derived and/or modified CDS sequence (opt1) from PUUV(PUUV/Croatia_Gerovo/Mg938/2008)__KC676609.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaugggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacuggagcgagcgggugcgcgacuucauggagaaggagugccccuucaucaagcccgagaucaagccggggacgccccagcaggaggccgaguuccucaagcggaacaagguguacuucaugcagcgccaggacguccuggacaagaaccacguggccgacaucgacaagcugaucgacuacgccgcguccggcgaccccaccagccccgacaacaucgaguccccgaacgcccccuggguguucgccugcgcccccgaccggugcccgccgaccugcaucuacgucgccggcauggcggagcucggggccuucuucagcauccugcaggacaugcgcaacaccaucauggccuccaagaccgugggcaccgccgaggagaagcugaagaagaaguccagcuucuaccagagcuaccuccgccggacccagagcauggggauccagcuggaccagcgcaucauccugcucuacaugcuggaguggggcaaggagaugguggaccacuuccaccugggcgacgacauggaccccgagcuccgggggcuggcccaggcgcugaucgaccagaaggucaaggagaucuccaaccaggagccccucaagaucuga

SEQ ID NO: 6515 - RNA, 1302 nt, Artificial Sequence
  derived and/or modified CDS sequence (opt1) from PUUV(PUUV/Croatia_Gerovo/Mg979/2008)__KC676613.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacuggagcgagcgggugcgcgacuucauggagaaggagugccccuucaucaagcccgagaucaagccggggaccccgccccaggaggccgaguuccucaagcggaacaagguguacuucaugcagcgccaggacguccuggacaagaaccacguggccgacaucgacaagcugaucgacuacgccgcguccggcgaccccaccagccccgacaacaucgagucccccaacgcccccuggguguucgccugcgcccccgaccggugcccgccgaccugcaucuacgucgccggcauggcggagcucggggccuucuucagcauccugcaggacaugcgcaacacgaucauggccuccaagaccgugggcaccgccgaggagaagcugaagaagaaguccagcuucuaccagagcuaccuccgccggacccagagcauggggauccagcuggaccagcgcaucauccugcucuacaugcuggaguggggcaaggagaugguggaccacuuccaccugggcgacgacauggaccccgagcuccgggggcuggcccaggcgcugaucgaccagaaggucaaggagaucuccaaccaggagccccucaagaucuga

SEQ ID NO: 6516 - RNA, 1302 nt, Artificial Sequence
  derived and/or modified CDS sequence (opt1) from PUUV(PUUV/Konnevesi/Mg_M114B/2005)__JQ319171.1__N
augagcgaccugaccgacauccaggaggacaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgccggauggccgacgcggugagccgcaagaagauggacaccaagcccaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucacccugccgaucauccucaaggcccuguacaugcugagcacgcgggggcgccagaccgugaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgucugcggccuguucccgacgcagauccaggugcggaacaucaugagccccgugaugggggucaucggcuucuccuucuucgugaaggacuggcccgagcgcauccgggaguucauggagaaggagugccccuucaucaagccggaggugaagcccgggacccccgcccaggagaucgagaugcucaagcgcaacaagaucuacuucaugcagcggcaggacguccuggacaagaaccacguggccgacaucgacaagcugaucgacuacgccgcgagcggcgaccccaccuccccggacaacaucgacagccccaacgcccccuggguguucgccugcgcccccgaccgcugcccgccgaccugcaucuacgucgccggcauggcggagcucggggccuucuucuccauccugcaggacaugcgcaacacgaucauggccagcaagaccgugggcaccgccgaggagaagcugaagaagaaguccagcuucuaccaguccuaccuccggcgcacccagagcauggggauccagcuggaccagcggaucauccuccuguucaugcuggaguggggcaaggagaugguggaccacuuccacuucggcgacgacauggaccccgagcugcgcgggcucgcccaggcgcugaucgaccagaaggucaaggagaucagcaaccaggagccccugaagaucuga

SEQ ID NO: 6517 - RNA, 1302 nt, Artificial Sequence
  derived and/or modified CDS sequence (opt1) from PUUV(PUUV/Konnevesi/Mg_M94A/2005)__JQ319163.2__N
augagcgaccugaccgacauccaggaggacaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgccggauggccgacgcggugagccgcaagaagauggacaccaagcccaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucacccugccgaucauccucaaggcccuguacaugcugagcacgcgggggcgccagaccgugaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgucugcggccuguucccgacgcagauccaggugcggaacaucaugagccccgugaugggggucaucggcuucuccuucuucgugaaggacuggcccgagcgcaucaaggaguucauggagaaggagugccccuucaucaagccggaggugaagcccgggacccccgcccaggagaucgagaugcucaagcggaacaagaucuacuucaugcagcgccaggacguccuggacaagaaccacguggccgacaucgacaagcugaucgacuacgccgcgagcggcgaccccaccuccccggacaacaucgacagccccaacgcccccuggguguucgccugcgcccccgaccggugcccgccgaccugcaucuacgucgccggcauggcggagcucggggccuucuucuccauccugcaggacaugcgcaacacgaucauggccagcaagaccgugggcaccgccgaggaggaggugaagaagaaguccagcuucuaccaguccuaccugcgccggacccagagcauggggauccagcucgaccagcgcaucauccugcuguucaugcucgaguggggcaaggagauggucgaccacuuccaccugggcgacgacauggaccccgagcugcgggggcucgcccaggcgaugaucgaccagaaggugaaggagaucagcaaccaggagccccugaagaucuga

SEQ ID NO: 6518 - RNA, 1302 nt, Artificial Sequence
  derived and/or modified CDS sequence (opt1) from PUUV(PUUV/Konnevesi/Mg_O14B/2005)__JQ319166.1__N
augagcgaccugaccgacauccaggaggacaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgccggauggccgacgcggugagccgcaagaagauggacaccaagcccaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucacccugccgaucauccucaaggcccuguacaugcugagcacgcgggggcgccagaccgugaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgucugcggccuguucccgacgcagauccaggugcggaacaucaugagccccgugaugggggucaucggcuucuccuucuucgugaaggacuggcccgagcgcauccgggaguucauggagaaggagugccccuucaucaagccggaggugaagcccgggacccccgcccaggagaucgagaugcucaagcgcaacaagaucuacuucaugcagcggcaggacguccuggacaagaaccacguggccgacaucgacaagcugaucgacuacgccgcgagcggcgaccccaccuccccggacaacaucgacagccccaacgcccccuggguguucgccugcgcccccgaccgcugcccgccgaccugcaucuacgucgccggcauggcggagcucggggccuucuucuccauccugcaggacaugcgcaacacgaucauggccagcaagaccgugggcaccgccgaggagaagcugaagaagaaguccagcuucuaccaguccuaccuccggcgcacccagagcauggggauccagcuggaccagcggaucauccuccuguucaugcuggaguggggcaaggagaugguggaccacuuccaccugggcgacgacauggaccccgagcuccgcgggcuggcccaggcgcugaucgaccagaaggucaaggagaucagcaaccaggagccccucaagaucuga

SEQ ID NO: 6519 - RNA, 1302 nt, Artificial Sequence
  derived and/or modified CDS sequence (opt1) from PUUV(PUUV/Konnevesi/Mg_O22B/2005)__JQ319168.2__N
augagcgaccugaccgacauccaggaggacaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgccggauggccgacgcggugagccgcaagaagauggacaccaagcccaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucacccugccgaucauccucaaggcccuguacaugcugagcacgcgggggcgccagaccgugaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgucugcggccuguucccgacgcagauccaggugcggaacaucaugagccccgugaugggggucaucggcuucuccuucuucgugaaggacuggcccgagcgcauccgggaguucauggagaaggagugccccuucaucaagccggaggugaagcccgggacccccgcccaggagaucgagaugcucaagcgcaacaagaucuacuucaugcagcggcaggacguccuggacaagaaccacguggccgacaucgacaagcugaucgacuacgccgcgagcggcgaccccaccuccccggagaacaucgacagccccaacgcccccuggguguucgccugcgcccccgaccgcugcccgccgaccugcaucuacgucgccggcauggcggagcucggggccuucuucuccauccugcaggacaugcgcaacacgaucauggccagcaagaccgugggcaccgccgaggagaagcugaagaagaaguccagcuucuaccaguccuaccuccggcgcacccagagcauggggauccagcuggaccagcggaucauccuccuguucaugcuggaguggggcaaggagaugguggaccacuuccaccugggcgacgacauggaccccgagcuccgcgggcacgcccaggcgcugaucgaccagaaggucaaggagaucagcaaccaggagccccugaagaucuga

SEQ ID NO: 6520 - RNA, 1302 nt, Artificial Sequence
  derived and/or modified CDS sequence (opt1) from PUUV(PUUV/Konnevesi/Mg_O57A/2005)__JQ319161.2__N
augagcgaccugaccgacauccaggaggacaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgccggauggccgacgcggugagccgcaagaagauggacaccaagcccaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucacccugccgaucauccucaaggcccuguacaugcugagcacgcgggggcgccagaccgugaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgucugcggccuguucccgacgcggauccaggugcgcaacaucaugagccccgugaugggggucaucggcuucuccuucuucgugaaggacuggcccgagcggaucaaggaguucauggagaaggagugcagcuucaucaagcccgaggugaagccggggacccccgcccaggagaucgagaugcucaagcgcaacaagaucuacuucaugcagcggcaggacguccuggacaagaaccacguggccgacaucgacaagcugaucgacuacgccgcguccggcgaccccaccagccccgacaacaucgacuccccgaacgcccccuggguguucgccugcgcccccgaccgcugcccgccgaccugcaucuacgucgccggcauggcggagcucggggccuucuucagcauccugcaggacaugcgcaacacgaucauggccuccaagaccgugggcaccgccgaggaggaggugaagaagaaguccagcuucuaccagagcuaccugcggcgcacccagagcauggggauccagcucgaccagcggaucauccugcuguucaugcucgaguggggcaaggagauggucgaccacuuccaccugggcgacgacauggaccccgagcugcgcgggcucgcccaggcgcugaucgaccagaacgugaaggagaucuccaaccaggagccccugaagaucuga

SEQ ID NO: 6521 - RNA, 1302 nt, Artificial Sequence
  derived and/or modified CDS sequence (opt1) from PUUV(PUUV/Konnevesi/Mg_O6B/2005)__JQ319164.1__N
augagcgaccugaccgacauccaggaggacaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgccggauggccgacgcggugagccgcaagaagauggacaccaagcccaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucacccugccgaucauccucaaggcccuguacaugcugagcacgcgggggcgccagaccgugaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcgccaucgucugcggccuguucccgacccagauccaggugcggaacaucaugagccccgugaugggggucaucggcuucuccuucuucgugaaggacuggcccgagcgcauccgggaguucauggggaaggagugccccuucaucaagccggaggugaagcccggcacgcccgcccaggagaucgagaugcucaagcgcaacaagaucuacuucaugcagcggcaggacguccuggacaagaaccacguggccgacaucgacaagcugaucgacuacgcggccagcggcgaccccaccuccccggacaacaucgacagccccaacgcccccuggguguucgccugcgcccccgaccgcugcccgccgaccugcaucuacgucgcggggauggccgagcucggcgccuucuucuccauccugcaggacaugcgcaacaccaucauggccagcaagacgguggggaccgccgaggagaagcugaagaagaaguccagcuucuaccaguccuaccuccggcgcacccagagcaugggcauccagcuggaccagcggaucauccuccuguucaugcuggaguggggcaaggagaugguggaccacuuccaccugggggacgacauggaccccgagcuccgcggccuggcgcaggcccugaucgaccagaaggucaaggagaucagcaaccaggagccccucaagaucuga

SEQ ID NO: 6522 - RNA, 1302 nt, Artificial Sequence
  derived and/or modified CDS sequence (opt1) from PUUV(PUUV/Konnevesi/Mg_O74B/2005)__JQ319170.1__N
augagcgaccugaccgacauccaggaggacaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgccggauggccgacgcggugagccgcaagaagauggacaccaagcccaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucacccugccgaucauccucaaggcccuguacaugcugagcacgcgggggcgccagaccgugaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgucugcggccuguucccgacgcagauccaggugcggaacaucaugagccccgugaugggggucaucggcuucuccuucuucgugaaggacuggcccgagcgcauccgggaguucauggagaaggagugccccuucaucaagccggaggugaagcccgggacccccgcccaggagaucgagaugcucaagcgcaacaagaucuacuucaugcagcggcaggacguccuggacaagaaccacguggccgacaucgacaagcugaucgacuacgccgcgagcggcgaccccaccuccccggacaacaucgacagccccaacgcccccuggguguucgccugcgcccccgaccgcugcccgccgaccugcaucuacgucgccggcauggcggagcucggggccuucuucuccauccugcaggacaugcgcaacacgaucauggccagcaagaccgugggcaccguggaggagaagcugaagaagaaguccagcuucuaccaguccuaccuccggcgcacccagagcauggggauccagcuggaccagcggaucauccuccuguucaugcuggaguggggcaaggagauggucgaccacuuccaccugggcgacgacauggaccccgagcuccgcgggcuggcccaggcccugaucgaccagaaggugaaggagaucagcaaccaggagccccucaagaucuga

SEQ ID NO: 6523 - RNA, 1302 nt, Artificial Sequence
  derived and/or modified CDS sequence (opt1) from PUUV(PUUV/Konnevesi/Mg_O78A/2005)__JQ319162.2__N
augagcgaccugaccgacauccaggaggacaucacccgccacgagcagcagcucguggucgcccggcagaagcugaaggacgccgagaaggcgguggagguggaccccgacgacgucaacaagaacacgcugcaggcccgccagcagaccguguccgcccucgaggacaagcuggccgacuacaagcggcgcauggccgacgcggugagccggaagaagauggacaccaagcccaccgaccccacgggcaucgagcccgacgaccaccugaaggagcgcuccagccuccgguacgggaacguccuggacgugaacgccaucgacaucgaggagcccuccggccagaccgccgacugguacaccaucgggguguacgucaucggcuucacccugccgaucauccucaaggcccuguacaugcugagcacgcgcgggcggcagaccgugaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgucugcggccuguucccgacgcagauccaggugcgcaacaucaugagccccgugaugggggucaucggcuucuccuucuucgugaaggacuggcccgagcggauccgcgaguucauggagaaggagugccccuucaucaagccggaggugaagcccgggacccccgcccaggagaucgagaugcucaagcggaacaagaucuacuucaugcagcgccaggacguccuggacaagaaccacguggccgacaucgacaagcugaucgacuacgccgcgagcggcgaccccaccuccccggacaacaucgacagccccaacgcccccugggugcucgccugcggccccgagcggugcccgccgaccugcaucuacgucgccgggauggccgagcugggcgcguucuucuccauccugcaggacaugcgcaacacgaucauggccagcaagaccgugggguccgacgaggugaagcucaagaagaaguccuucuucuaccaguacuaccugcgccggacccacagcaugggcauccagcuggaccagcgcaucauccuccugugcaugcuggaguggggcaucgagauggucgaccacuuccaccucggggacgacauggaccccgagcugcggggccuggcccaggccaugaucgaccagaaggugaaggagaucagcaaccaggagccccucaucaucuga

SEQ ID NO: 6524 - RNA, 1302 nt, Artificial Sequence
  derived and/or modified CDS sequence (opt1) from PUUV(PUUV/Mg23/HungaryTR17/00)__FN377822.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacuggagcgagcgggugcgcgaguucauggagaaggagugccccuucaucaagcccgagaucaagccggggaccccgccccaggaggccgaguuccucaagcggaacaagguguacuucaugcagcgccaggacguccuggacaagaaccacguggccgacaucgacaagcugaucgacuacgccgcguccggcgaccccaccagccccgacaacaucgagucccccaacgcccccuggguguucgccugcgcccccgaccggugcccgccgaccugcaucuacgucgccggcauggcggagcucggggccuucuucagcauccugcaggacaugcgcaacacgaucauggccuccaagaccgugggcaccgccgaggagaagcugaagaagaaguccagcuucuaccagagcuaccuccgccggacccagagcauggggauccagcuggaccagcgcaucauccugcucuacaugcuggaguggggcaaggagaugguggaccacuuccaccugggcgacgacauggaccccgagcuccgggggcuggcccaggcgcugaucgaccagaaggucaaggagaucuccaaccaggagccccucaagaucuga

SEQ ID NO: 6525 - RNA, 1302 nt, Artificial Sequence
  derived and/or modified CDS sequence (opt1) from PUUV(PUUV/Mg9/HungaryTR17/00)__FN377821.1__N
augagcgaccuggccgacauccaggaggacaucacccgccacgagcagcagcucguggucgcccggcagaagcugaaggacgcggagaaggccguggagauggaccccgacgacgugaacaagaacacccugcaggcccgccagcagacggucuccgcccucgaggacaagcuggccgacuucaagcggcgcauggcggacgccgugagccggaagaagauggacaccaagcccaccgaccccaccggcaucgagcccgacgaccaccugaaggagcgcuccagccuccgguacgggaacgugcuggacgucaacgccaucgacaucgaggagcccuccggccagacggccgacugguacaccaucgggguguacgugaucggcuucacccugccgaucauccucaaggcgcuguacaugcugagcacccgcgggcggcagacggucaaggagaacaagggcacccgcauccgguucaaggacgacaccuccuucgaggacaucaacggcauccgccggcccaagcaccucuacgugagcaugcccaccgcccaguccacgaugaaggccgaggagcugacccccgggcgcuuccggaccaucgugugcggccuguucccgacccagauccagguccgcaacaucaugagccccgugaugggggugaucggcuucuccuucuucgucaaggacuggagcgagcgggugcgcgaguucauggagaaggagugccccuucaucaagcccgagaucaagccggggacgccgccccaggaggccgaguuccucaagcggaacaagguguacuucaugcagcgccaggacguccuggacaagaaccacguggccgacaucgacaagcugaucgacuacgcggccuccggcgaccccaccagccccgacaacaucgagucccccaacgcccccuggguguucgccugcgcccccgaccggugcccgccgaccugcaucuacgucgcgggcauggccgagcucggggccuucuucagcauccugcaggacaugcgcaacaccaucauggccuccaagacggugggcaccgccgaggagaagcugaagaagaaguccagcuucuaccagagcuaccuccgccggacccagagcauggggauccagcuggaccagcgcaucauccugcucuacaugcuggaguggggcaaggagaugguggaccacuuccaccugggcgacgacauggaccccgagcuccgggggcuggcgcaggcccugaucgaccagaaggucaaggagaucuccaaccaggagccccucaagaucuga

SEQ ID NO: 6526 - RNA, 1302 nt, Artificial Sequence
  derived and/or modified CDS sequence (opt1) from PUUV(PUUV/NL/Mg1012/2010)__KU314900.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuacaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacuggcccgaccggauccgcgaguucauggagaaggagugccccuucaucaagccggaggugaagcccgggacccccgcccaggaggccgaguuccucaagcggaacaagguguacuucaugcagcgccaggacguccuggacaagaaccacguggccgacaucgacaagcugaucgacuacgcggccagcggcgaccccaccuccccggacaacaucgagagccccaacgcccccuggguguucgccugcgcccccgaccggugcccgccgaccugcaucuacgucgcgggcauggccgagcucggggccuucuucuccauccugcaggacaugcgcaacacgaucauggccagcaagaccgugggcgccgcggaggagaagcugaagaagaaguccagcuucuaccaguccuaccuccgccggacccagagcauggggauccagcuggaccagcgcaucauccugcucuacaugcuggaguggggcaaggagaugguggaccacuuccaccugggcgacgacauggaccccgagcuccgggggcuggcccaggcccugaucgaccagaaggucaaggagaucagcaaccaggagccccucaagaucuga

SEQ ID NO: 6527 - RNA, 1302 nt, Artificial Sequence
  derived and/or modified CDS sequence (opt1) from PUUV(PUUV/NL/Mg1439/2011)__KU314901.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuacaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcgcgcgcauccgguucaaggacgacaccuccuucgaggacaucaacggcauccgccggcccaagcaccucuacgugagcaugcccaccgcccaguccacgaugaaggccgaggagcugacccccgggcgcuuccggaccaucgugugcggccuguucccgacccagauccagguccgcaacaucaugagccccgugaugggggugaucggcuucuccuucuucgucaaggacuggcccgaccggauccgcgaguucauggagcgggagugccccuucaucaagccggaggugaagcccgggacgcccgcccaggaggccgaguuccucaagcgcaacaagguguacuucaugcagcggcaggacguccuggacaagaaccacguggcggacaucgacgagcugaucgacuacgccgccagcggcgaccccaccuccccggacaacaucgagagccccaacgcccccuggguguucgccugcgcgcccgaccgcugcccgccgaccugcaucuacgucgccggcauggccgagcucggggccuucuucuccauccugcaggacaugcgcaacaccaucauggccagcaagacggugggcaccgcggaggagaagcugaagaagaaguccagcuucuaccaguccuaccuccggcgcacccagagcauggggauccagcuggaccagcggaucauccugcucuacaugcuggaguggggcaaggagaugguggaccacuuccaccugggcgacgacauggaccccgagcuccgcgggcuggcccaggcccugaucgaccagaaggucaaggagaucagcaaccaggagccccucaagaucuga

SEQ ID NO: 6528 - RNA, 1302 nt, Artificial Sequence
  derived and/or modified CDS sequence (opt1) from PUUV(PUUV/NL/Mg2/2008)__KU314902.1__N
augagcgaccugaccgacauccaggaggacaucacccgccacgagcagcagcucguggucgcccggcagaagcugaaggacgccgagaaggcgguggagauggaccccgacgacgugaacaagacgacccugcaggcccgccagcagaccgucuccgcccucgaggacaagcuggccgacuucaagcggcagauggccgacgcggugagccgcaagaagauggacaccaagcccgccgaccccacgggcaucgagcccgacgaccaccugaaggagcgguccagccuccgcuacgggaacgugcuggacgucaacgccaucgacaucgaggagcccuccggccagaccgccgacugguacaccaucgggguguacgugaucggcuucacccugccgaucauccucaaggcgcuguacaugcugagcacgcgggggcgccagaccgucaaggagaacaagggcacccggauccgcuucaaggacgacaccuccuucgaggacaucaacggcauccggcgccccaagcaccucuacgugagcaugcccacggcccaguccaccaugaaggccgaggagcugacccccgggcgguuccgcaccaucgugugcggccuguucccgacgcagauccagguccggaacaucaugagccccgugaugggggugaucggcuucuccuucuucgucaaggacugggccgaccgcauccgggaguucauggagaaggagugccccuucaucaagcccgacgugaagccggggacccccgcccaggaggcggaguuccucaagcgcaacaagaucuacuucaugcagcggcaggaggugcuggacaagaaccacgucgccgacaucgacaagcugaucgacuacgccgccagcggcgaccccaccucccccgacaacaucgagagcccgaacucccccuggguguucgccugcgcgcccgaccgcugcccgccgaccugcaucuacguggccggcauggccgagcucggggccuucuucagcauccugcaggacaugcggaacacgaucauggccuccaagaccgucggcaccgcggaggagaagcugaagaagaaguccagcuucuaccagagcuaccuccgccgcacccagagcauggggauccagcuggaccagcggaucauccugcucuacaugcuggaguggggcaaggagaugguggaccacuuccaccugggcgacgacauggaccccgagcuccgcgggcuggcccaggcccugaucgaccagaagguggaggagaucuccaaccaggagccccucaagaucuga

SEQ ID NO: 6529 - RNA, 1302 nt, Artificial Sequence
  derived and/or modified CDS sequence (opt1) from PUUV(PUUV/NL/Mg25/2007)__KU314897.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuacaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacuggcccgaccggauccgcgaguucauggagaaggagugccccuucaucaagccggaggugaagcccgggacccccgcccaggaggccgaguuccucaagcggaacaagguguacuucaugcagcgccaggacguccuggacaagaaccacguggccgacaucgacaagcugaucgacuacgcggccagcggcgaccccaccuccccggacaacaucgagagccccaacgcccccuggguguucgccugcgcccccgaccggugcccgccgaccugcaucuacgucgcgggcauggccgagcucggggccuucuucuccauccugcaggacaugcgcaacacgaucauggccagcaagaccgugggcaccgccgaggagaagcugaagaagaaguccagcuucuaccaguccuaccuccgccggacccagagcauggggauccagcuggaccagcgcaucauccugcucuacaugcuggaguggggcaaggagaugguggaccacuuccaccugggcgacgacauggaccccgagcuccgggggcuggcgcaggcccugaucgaccagaaggucaaggagaucagcaaccaggagccccucaagaucuga

SEQ ID NO: 6530 - RNA, 1302 nt, Artificial Sequence
  derived and/or modified CDS sequence (opt1) from PUUV(PUUV/NL/Mg31/2007)__KU314896.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuacaagcggcgcauggccgacgcggugagccggaagaagauggacaccaagcccaccgaccccacgggcaucgagcccgacgaccaccugaaggagcgcuccagccuccgguacgggaacgugcuggacgucaacgccaucgacaucgaggagcccuccggccagaccgccgacugguacaccaucgggguguacgugaucggcuucacccugccgaucauccucaaggcccuguacaugcugagcacgcgcgggcggcagaccgucaaggagaacaagggcacccgcauccgguucaaggacgacaccuccuucgaggacaucaacggcauccgccggcccaagcaccucuacgugagcaugcccacggcgcaguccaccaugaaggccgaggagcugacccccgggcgcuuccggaccaucgugugcggccuguucccgacgcagauccagguccgcaacaucaugagccccgugaugggggugaucggcuucuccuucuucgucaaggacuggcccgaccggauccgcgaguucauggagaaggagugccccuucaucaagccggaggugaagcccgggacccccgcccaggaggccgaguuccucaagcggaacaagguguacuucaugcagcgccaggacguccccgacaagaaccacguggccgacaucgacaagcugaucgacuacgcggccagcggcgacccgaccucccccgacaacaucgagagccccaacgcccccuggguguucgccugcgccccggaccggugcccgccgaccugcaucuacgucgcgggcauggccgagcugggggccuucuucuccauccuccaggacaugcgcaacacgaucauggccagcaagaccgugggcaccgccgaggagaagcugaagaagaaguccagcuucuaccaguccuaccugcgccggacccagagcauggggauccagcucgaccagcgcaucauccugcuguacaugcucgaguggggcaaggagaugguggaccacuuccaccugggcgacgacauggaccccgagcugcgggggcucgcgcaggcccugaucgaccagaaggucaaggagaucagcaaccaggagccccugaagaucuga

SEQ ID NO: 6531 - RNA, 1302 nt, Artificial Sequence
  derived and/or modified CDS sequence (opt1) from PUUV(PUUV/NL/Mg502/2008)__KU314904.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcagauggccgacgcggugagccgcaagaagauggacaccaagcccgccgaccccaccggcaucgagcccgacgaccaccugaaggagcgguccagccuccgcuacgggaacgugcuggacgucaacgccaucgacaucgaggagcccuccggccagacggccgacugguacaccaucgggguguacgugaucggcuucacccugccgaucauccucaaggcgcuguacaugcugagcacccgggggcgccagacggucaaggagaacaagggcacccggauccgcuucaaggacgacaccuccuucgaggacaucaacggcauccggcgccccaagcaccucuacgugagcaugcccaccgcccaguccacgaugaaggccgaggagcugacccccgggcgguuccgcaccaucgugugcggccuguucccgacccagauccagguccggaacaucaugagccccgugaugggggugaucggcuucuccuucuucgucaaggacugggccgaccgcauccgggaguucauggagaaggagugccccuucaucaagcccgacgugaagccggggacgcccgcccaggaggcggaguuccucaagcgcaacaagaucuacuucaugcagcggcaggaggugcuggacaagaaccacgucgccgacaucgacaagcugaucgacuacgccgccagcggcgaccccaccucccccgacaacaucgagagcccggacucccccuggguguucgccugcgcgcccgaccgcugcccgccgaccugcaucuacguggccggcauggccgagcucggggccuucuucagcauccugcaggacaugcggaacaccaucauggccuccaagacggucggcaccgcggaggagaagcugaagaagaaguccagcuucuaccagagcuaccuccgccgcacccagagcauggggauccagcuggaccagcggaucauccugcucuacaugcuggaguggggcaaggagaugguggaccacuuccaccugggcgacgacauggaccccgagcuccgcgggcuggcccaggcccugaucgaccagaaggugaaggagaucuccaaccaggagccccucaagaucuga

SEQ ID NO: 6532 - RNA, 1302 nt, Artificial Sequence
  derived and/or modified CDS sequence (opt1) from PUUV(PUUV/NL/Mg591/2008)__KU314905.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcagauggccgacgcggugagccgcaagaagauggacaccaagcccaccgaccccacgggcaucgagcccgacgaccaccugaaggagcgguccagccuccgcuacgggaacgugcuggacgucaacgccaucgacaucgaggagcccuccggccagaccgccgacugguacaccaucgggguguacgugaucggcuucacccugccgaucauccucaaggcccuguacaugcugagcacgcgggggcgccagaccgucaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgugugcggccuguucccgacgcagauccagguccggaacaucaugagccccgugaugggggugaucggcuucuccuucuucgucaaggacugggccgaccgcauccgggaguucauggagaaggagugccccuucaucaagcccgacgugaagccggggacccccgcccaggaggccgaguuccucaagcgcaacaagaucuacuucaugcagcggcaggaggugcuggacaagaaccacgucgcggacaucgacaagcugaucgacuacgccgccagcggcgaccccaccucccccgacaacaucgagagcccgaacucccccuggguguucgccugcgcccccgaccgcugcccgccgaccugcaucuacguggcgggcauggccgagcucggggccuucuucagcauccugcaggacaugcggaacacgaucauggccuccaagaccgucggcaccgccgaggagaagcugaagaagaaguccagcuucuaccagagcuaccuccgccgcacccagagcauggggauccagcuggaccagcggaucauccugcucuacaugcuggaguggggcaaggagaugguggaccacuuccaccugggcgacgacauggaccccgagcuccgcucccuggcgcaggcccugaucgaccagaaggugaaggagaucagcaaccaggagccccucaagaucuga

SEQ ID NO: 6533 - RNA, 1302 nt, Artificial Sequence
  derived and/or modified CDS sequence (opt1) from PUUV(Samara_49/CG/2005)__AB433843.2__N
augagcgaccugaccgacauccaggaggagaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgccggauggccgacgcggugagccgcaagaagauggacaccaagccgaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucaccaucccgaucauccugaaggcccucuacaugcugagcacgcgggggcgccagaccgugaaggagaacaagggcacccggauccgcuucaaggacgacaccuccuucgaggacaucaacggcauccggcgccccaagcaccuguacgugagcaugcccacggcgcaguccaccaugaaggccgaggagcucacccccgggcgguuccgcaccaucgucugcggccuguucccgacgcagauccaggugcggaacaucaugagccccgugaugggggucaucggcuucuccuucuucgugaaggacuggcccgagcgcauccgggaguucauggagcgcgagugccccuucaucaagccggaggugaagcccgggacccccgcccaggaggucgaguuccugaagcggaaccgcguguacuucaugacccgccaggacgugcucgacaagaaccacgucgccgacaucgacaagcugaucgacuacgccgcgagcggcgaccccaccuccccggacgacaucgagagccccaacgcccccuggguguucgccugcgcccccgaccggugcccgcccacgugcaucuacguggccggcauggcggagcugggggccuucuucuccauccuccaggacaugcgcaacaccaucauggccagcaagaccgucggcaccgccgaggagaagcugaagaagaaguccagcuucuaccaguccuaccugcggcgcacgcagagcauggggauccagcucgaccagcggaucauccugcuguacaugcucgaguggggcaaggagaugguggaccacuuccaccugggcgacgacauggaccccgagcugcgcgggcucgcccagagccugaucgaccagaaggucaaggagaucuccaaccaggagccccugaagaucuga

SEQ ID NO: 6534 - RNA, 1302 nt, Artificial Sequence
  derived and/or modified CDS sequence (opt1) from PUUV(Thuin/33Cg/96)__AJ277030.1__N
augagcgaccugaccgacauccaggaggacaucacccgccacgagcagcagcucguggucgcccggcagaagcugaaggacgccgagaaggcgguggagauggaccccgacgacgugaacaagaacacgcugcaggcccgccagcagaccgucuccgcccucgaggacaagcuggccgacuucaagcggcagauggccgacgcggugagccgcaagaagauggacaccaagcccaccgaccccacgggcaucgagcccgacgaccaccugaaggagcgguccagccuccgcuacgggaacgugcuggacgucaacgccaucgacaucgaggagcccuccggccagaccgccgacugguacaccaucgggguguacgugaucggcuucacccugccgaucauccucaaggcccuguacaugcugagcacgcgggggcgccagaccgucaaggagaacaagggcacccggauccgcuucaaggacgacaccuccuucgaggacaucaacggcauccggcgccccaagcaccucuacgugagcaugcccacggcgcaguccaccaugaaggccgaggagcugacccccgggcgguuccgcaccaucgugugcggccuguucccgacgcagauccagguccggaacaucaugagccccgugaugggggugaucggcuucuccuucuucgucaaggacugggccgaccgcauccgggaguucauggagaaggagugccccuucaucaagcccgaggugaagccggggacccccgugcaggaggccgaguuccucaagcgcaacaagaucuacuucaugcagcggcaggagguccuggacaagaaccacguggccgacaucgacaagcugaucgacuacgcggccagcggcgaccccaccucccccgacaacaucgaggccccgaacgcccccuggguguucgccugcgcgcccgaccgcugcccgccgaccugcaucuacgucgccggcauggccgagcucggggccuucuucagcauccugcaggacaugcggaacacgaucauggccuccaagaccgugggcaccgcggaggagaagcugaagaagaaguccagcuucuaccagagcuaccuccgccgcacccaguccauggggauccagcuggaccagcggaucauccugcucuacaugcuggaguggggcaaggagaugguggaccacuuccaccugggcgacgacauggaccccgagcuccgcgggcuggcccaggcccugaucgaccagaaggucaaggagaucagcaaccaggagccccucaagaucuga

SEQ ID NO: 6535 - RNA, 1302 nt, Artificial Sequence
  derived and/or modified CDS sequence (opt1) from PUUV(Udmurtia/338Cg/92)__Z30708.1__N
augagcgaccugaccgacauccaggaggagaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgccggauggccgacagcgugucccgcaagaagauggacaccaagccgaccgaccccacgggcaucgagcccgacgaccaccugaaggagcggagcagcccccgcuacgggaacguccucgacgugaacgcgaucgacaucgaggagccgagcggccagaccgccgacugguacaccaucgggguguacgucaucggcuucaccauccccaucauccugaaggcccuguacaugcucuccacgcgggggcgccagaccaucaaggagaacaagggcacccggauccgcuucaaggacgacaccagcuucgaggacaucaacggcauccggcgccccaagcaccuguacguguccaugcccacggcccagagcaccaugaaggcggaggagcugaccccggggcgguuccgcaccaucgugugcggccucuuccccacgcagauccagguccggaacaucaugucccccgugaugggggugaucggcuucagcuucuucgucaaggacuggcccgagcgcauccgggacuucauggagaaggagugcccguucaucaagcccgaggugaagcccgggacccccgcccaggagaucgaguuccugaagcgcaaccggguguacuucaugacccgccaggacguccuggacaagaaccacguggccgacaucgacaagcucaucgacuacgccgccuccggcgacccgaccagccccgacgacaucgagucccccaacgcgcccuggguguucgccugcgccccggaccgcugcccgcccacgugcaucuacgucgccggcauggccgagcugggggcguucuucagcauccugcaggacaugcggaacaccaucauggccuccaagaccgugggcaccgccgaggagaagcucaagaagaaguccuccuucuaccagagcuaccugcgccggacgcagagcauggggauccagcuggaccagcgcaucauccuccuguacaugcuggaguggggcaaggagaugguggaccacuuccaccucggcgacgacauggaccccgagcugcgggggcuggcccagucccucaucgaccagaaggucaaggagaucagcaaccaggagccccugaagaucuga

SEQ ID NO: 6536 - RNA, 1302 nt, Artificial Sequence
  derived and/or modified CDS sequence (opt1) from PUUV(Udmurtia/444Cg/88)__Z30706.1__N
augagcgaccugaccgacauccaggaggagaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgccggauggccgacgcggugagccgcaagaagauggacaccaagccgaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucaccaucccgaucauccugaaggcccucuacaugcugagcacgcgggggcgccagaccgugaaggagaacaagggcacccggauccgcuucaaggacgacaccuccuucgaggacaucaacggcauccggcgccccaagcaccuguacgugagcaugcccacggcgcaguccaccaugaaggccgaggagcucacccccgggcgguuccgcaccaucgucugcggccuguucccgacgcagauccaggugcggaacaucaugagccccgugaugggggucaucggcuucuccuucuucgugaaggacuggcccgagcgcauccgggacuucauggagaaggagugccccuucaucaagccggaggugaagcccgggacccccgcccaggagaucgaguuccugaagcgcaaccgggucuacuucaugacccgccaggacgugcucgacaagaaccacguggccgacaucgacaagcugaucgacuacgccgcgagcggcgaccccaccuccccggacgacaucgagagccccaacgcccccugggucuucgccugcgcccccgaccgcugcccgcccacgugcaucuacguggccggcauggcggagcugggggccuucuucuccauccuccaggacaugcggaacaccaucauggccagcaagaccgugggcaccgccgaggagaagcugaagaagaaguccagcuucuaccaguccuaccugcgccggacgcagagcauggggauccagcucgaccagcgcaucauccugcuguacaugcucgaguggggcaaggagauggucgaccacuuccaccugggcgacgacauggaccccgagcugcgggggcucgcccagagccugaucgaccagaaggugaaggagaucuccaaccaggagccccugaagaucuga

SEQ ID NO: 6537 - RNA, 1302 nt, Artificial Sequence
  derived and/or modified CDS sequence (opt1) from PUUV(Udmurtia/894Cg/91)__Z21497.1__N
augagcgaccugaccgacauccaggaggagaucacccgccacgagcagcagcucguggucgcccggcagaagcugaaggacgccgagcgcgcgguggagguggaccccgacgacgucaacaagaacacgcugcaggcccggcagcagaccguguccgcccucgaggacaagcuggccgacuacaagcgccggauggccgacgcggugagccgcaagaagauggacaccaagccgaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucaccaucccgaucauccugaaggcccucuacaugcugagcacgcgggggcgccagaccgugaaggagaacaagggcacccggauccgcuucaaggacgacaccuccuucgaggacaucaacggcauccggcgccccaagcaccuguacgugagcaugcccacggcgcaguccaccaugaaggccgaggagcucacccccgggcgguuccgcaccaucgucugcggccuguucccgacgcagauccaggugcggaacaucaugagccccgugaugggggucaucggcuucuccuucuucgugaaggacuggcccgagcgcauccgggacuucauggagaaggagugccccuucaucaagccggaggugaagcccgggacccccgcccaggagaucgaguuccugaagcgcaaccgggucuacuucaugacccgccaggacgugcucgacaagaaccacguggccgacaucgacaagcugaucgacuacgccgcgagcggcgaccccaccuccccggacgacaucgagagccccaacgcccccugggucuucgccugcgcccccgaccgcugcccgcccacgugcaucuacguggugggcauggccgagcugggggcguucuucuccauccuccaggacaugcggaacaccaucauggccagcaagaccgucggcaccgccgaggagaagcugaagaagaaguccagcuucuaccaguccuaccugcgccggacgcagagcauggggauccagcucgaccagcgcaucauccugcuguacaugcucgaguggggcaaggagaugguggaccacuuccaccugggcgacgacauggaccccgagcugcgggggcucgcccagagccugaucgaccagaaggucaaggagaucuccaaccaggagccccugaagaucuga

SEQ ID NO: 6538 - RNA, 1302 nt, Artificial Sequence
  derived and/or modified CDS sequence (opt1) from PUUV(Fusong-Cr-247)__EF442087.1__N
augagcgaccugaaggacauccaggaggacaucgcccgccacgagcagcagcucguggucgcccggcagaagcugcgcgacgcggagaaggccguggagauggaccccgacgacgugaacaacaacacccugcaggcccggcagcagaccgucuccgcccucgaggacaagaucgccgacuucaagcgccggauggcggacaucgugagccgcaagaagauggacacgaagcccgccgaccccaccggcaucgagcccgacgaccaccugaaggagcgguccagccugcgcuacgggaacgugcucgacgucaacgccaucgacaucgaggagcccuccggccagaccgccgacugguacaccaucgggguguacaucaucggcuucacgcugccgaucauccugaaggcgcucuacaugcugagcacccgggggcgccagaccgugaaggagaacaagggcacccggauccgcuucaaggacgacacguccuucgaggacgucaacggcauccggcgccccaagcaccuguacgugagcaugcccaccgcccaguccaccaugaaggccgaggagcucacccccgggcgguuccgcacgaucgugugcggccuguucccgacccagauccagguccggaacaccaugagccccgugaugggggugaucggcuucuccuucuucgccaaggacuggcccgaccgcaucaaggaguucauggagaaggagugccccuucaucaagccggaggucaagcccgggacccccgccaaggagguggagauccugaagcggaacaagaucuacuucaugcagcgccaggacgugcucgacaagaaccacguccccgacaucgacaagcugaucgacuacgcggccagcggcgacccgacgucccccgagaacaucgacagccccaacgcccccuggguguucgccugcgccccggaccggugcccgccgaccugcaucuacguggcgggcauggccgagcugggggccuucuucuccauccuccaggacaugcgcaacaccaucauggccagcaagaccgucggcacggccgaggagaagcugaagaagaaguccagcuucuaccaguccuaccugcgccggacccagagcauggggauccagcucgaccagcgcaucauccugcuguacaugcucgaguggggcaaggagaugguggaccacuuccaccugggcgacgacauggaccccgagcugcggagccucgcgcaggcccugaucgaccagaaggugaaggagaucuccaaccaggagccccugaagaucuga

SEQ ID NO: 6539 - RNA, 1302 nt, Artificial Sequence
  derived and/or modified CDS sequence (opt1) from MUV(11-4)__JX046484.1__N
augagcgaccugaaggagauccaggaggacaucgcccgccacgagcagcagcucguggucgcccggcagaagcugcgcgacgcggagaaggccguggagguggaccccgacgacgucaacaagaacacccugcaggcccggcagcagaccguguccgcccucgaggacaagcuggccgacuucaagcgccagauggcggacuucgugagccggaagaagauggacacgaagcccaccgaccccaccggcaucgagcccgacgaccaccugaaggagcgcuccagccuccgguacgggaacguccuggacgugaacgccaucgacaucgaggagcccuccggccagaccgccgacugguacacgaucgggguguacaucaucggcuucacccugccgaucguccucaaggcccuguacaugcugagcacccgcgggcggcagaccgugaaggagaacaagggcacgcgcauccgguucaaggacgacaccuccuucgaggacaucaacggcauccgccggcccaagcaccucuacgugagcaugcccaccgcgcaguccaccaugaaggccgaggagcugacgcccgggcgcuuccggaccaucgucugcggccuguucccgacccagauccaggugcgcaacaucaugagccccgugaugggggucaucggcuucuccuucuucgugaaggacugggccgaccggaucaaggaguucauggagaaggagugccccuucaucaagcccgagccgaagcccgggacccccgccagcgagguggaguuccucaagcgcaacaagaucuacuucaugucccggcaggacguccuggacaagaaccacgugcccgacaucgacaagcugaucgacuacgccgcgagcggcgacccgacgucccccgacaacaucgaggaccccaacgcccccuggguguucagcugcgccccggaccgcugcccgccgaccugccucuacgucgccggcauggccgagcugggggcguucuucuccauccugcaggacaugcggaacaccaucauggccagcaagaccgugggcacggccgaggagaagcucaagaagaaguccagcuucuaccagagcuaccugcgccgcacccaguccauggggauccagcuggaccagcggaucauccuccuguacaugcuggaguggggcaaggagaugguggaccacuuccaccucggcgacgacauggaccccgagcugcgcacccuggcccaggcccucaucgaccagaaggucaaggagaucagcaaccaggagccccugaagaucuga

SEQ ID NO: 6540 - RNA, 1302 nt, Artificial Sequence
  derived and/or modified CDS sequence (opt1) from MUV(00-18)__DQ138128.1__N
augagcgaccugaaggagauccaggaggacaucgcccgccacgagcagcagcucguggucgcccggcagaagcugcgcgacgcggagaaggccguggagguggaccccgacgacgucaacaagaacacccugcaggcccggcagcagaccguguccgcccucgaggacaagcuggccgacuucaagcgccagauggcggacuucgugagccggaagaagauggacacgaagcccaccgaccccaccggcaucgagcccgacgaccaccugaaggagcgcuccagccuccgguacgggaacguccuggacgugaacgccaucgacaucgaggagcccuccggccagaccgccgacugguacacgaucgggguguacgucaucggcuucacccugccgaucgugcucaaggcccuguacaugcugagcacccgcgggcggcagaccgugaaggagaacaagggcacgcgcauccgguucaaggacgacaccuccuucgaggacaucaacggcauccgccggcccaagcaccucuacgucagcaugcccaccgcgcaguccaccaugaaggccgaggagcugacgcccgggcgcuuccggaccaucgugugcggccuguucccgacccagauccaggugcgcaacaucaugagccccgucaugggggugaucggcuucuccuucuucgugaaggacugggucgagcggaucaaggaguucauggagaaggagugccccuucaucaagcccgagccgaagcccgggacccccgccagcgagguggaguuccucaagcgcaacaagaucuacuucaugaaccggcaggacgugcuggacaagaaccacguccccgacaucgacaagcugaucgacuacgccgccuccggcgacccgacgagccccgacaacaucgaggaccccaacgcgcccuggguguucuccugcgccccggaccgcugcccgccgaccugccucuacguggccggcauggccgagcugggggccuucuucagcauccugcaggacaugcggaacaccaucauggcguccaagaccgucggcacggccgaggagaagcucaagaagaaguccagcuucuaccagagcuaccugcgccgcacccagagcauggggauccagcuggaccagcggaucauccuccuguacaugcuggaguggggcaaggagaugguggaccacuuccaccucggcgacgacauggaccccgagcugcgcacccuggcccaggcccucaucgaccagaaggucaaggagaucuccaaccaggagccccugaagaucuga

SEQ ID NO: 6541 - RNA, 1302 nt, Artificial Sequence
  derived and/or modified CDS sequence (opt1) from MUV(11-1)__JX028273.1__N
augagcgaccugaaggagauccaggaggacaucgcccgccacgagcagcagcucguggucgcccggcagaagcugcgcgacgcggagaaggccguggagguggaccccgacgacgucaacaagaacacccugcaggcccggcagcagaccguguccgcccucgaggacaagcuggccgacuucaagcgccagauggcggacuucgugagccggaagaagauggacacgaagcccaccgaccccaccggcaucgagcccgacgaccaccugaaggagcgcuccagccuccgguacgggaacguccuggacgugaacgccaucgacaucgaggagcccuccggccagaccgccgacugguacacgaucgggguguacaucaucggcuucacccugccgaucguccucaaggcccuguacaugcugagcacccgcgggcggcagaccgugaaggagaacaagggcacgcgcauccgguucaaggacgacaccuccuucgaggacaucaacggcauccgccggcccaagcaccucuacgugagcaugcccaccgcgcaguccaccaugaaggccgaggagcugacgcccgggcgcuuccggaccaucgucugcggccuguucccgacccagauccaggugcgcaacaucaugagccccgugaugggggucaucggcuucuccuucuucgugaaggacugggccgaccggaucaaggaguucauggagaaggagugccccuucaucaagcccgagccgaagcccgggacccccgccagcgagaucgaguuccucaagcgcaacaagaucuacuucaugucccggcaggacgugcuggacaagaaccacguccccgacaucgacaagcugaucgacuacgccgcgagcggcgacccgacgucccccgacaacaucgaggaccccaacgcccccuggguguucagcugcgccccggaccgcugcccgccgaccugccucuacguggccggcauggccgagcugggggcguucuucuccauccugcaggacaugcggaacaccaucauggccagcaagaccgucggcacggccgaggagaagcucaagaagaaguccagcuucuaccagagcuaccugcgccgcacccaguccauggggauccagcuggaccagcggaucauccuccuguacaugcuggaguggggcaaggagaugguggaccacuuccaccucggcgacgacauggaccccgagcugcgcacccuggcccaggcccucaucgaccagaaggugaaggagaucagcaaccaggagccccugaagaucuga

SEQ ID NO: 6542 - RNA, 1302 nt, Artificial Sequence
  derived and/or modified CDS sequence (opt1) from MUV(96-1)__DQ138133.1__N
augagcgaccugaaggagauccaggaggacaucgcccgccacgagcagcagcucguggucgcccggcagaagcugcgcgacgcggagaaggccguggagguggaccccgacgacgucaacaagaacacccugcaggcccggcagcagaccguguccgcccucgaggacaagcuggccgacuucaagcgccagauggcggacuucgugagccggaagaagauggacacgaagcccaccgaccccaccggcaucgagcccgacgaccaccugaaggagcgcuccagccuccgguacgggaacguccuggacgugaacgccaucgacaucgaggagcccuccggccagaccgccgacugguacacgaucgggguguacgucaucggcuucacccugccgaucgugcucaaggcccuguacaugcugagcacccgcgggcggcagaccgugaaggagaacaagggcacgcgcauccgguucaaggacgacaccuccuucgaggacaucaacggcauccgccggcccaagcaccucuacgucagcaugcccaccgcgcaguccaccaugaaggccgaggagcugacgcccgggcgcuuccggaccaucgugugcggccuguucccgacccagauccaggugcgcaacaucaugagccccgucaugggggugauccgguucuccuuccucgugaaggacuggagcgagaagaucaaggaguucauggagaaggagugccccuucaucaagcccgagccgaagcccggcacccccgccuccgagaucgaguuccugaagcgcaacaagaucuacuucaugaaccggcaggacguccuggacaagaaccacgugcccgacaucgacaagcucaucgacuacgccgccagcggggacccgacgucccccgacaacaucgaggcgcccaacgcccccuggguguucagcugcgccccggaccgcugcccgccgaccugccuguacgucgccggcauggccgagcugggcgcguucuucuccauccuccaggacaugcggaacaccaucauggccagcaagaccguggggacggccgaggagaagcugaagaagaaguccagcuucuaccagagcuaccugcgccgcacccaguccaugggcauccagcucgaccagcggaucauccugcuguacaugcucgagugggggaaggagaugguggaccacuuccaccugggcgacgacauggaccccgagcugcgcacccucgcccaggcccugaucgaccagaaggucaaggagaucagcaaccaggagccccugaagaucuga

SEQ ID NO: 6543 - RNA, 1302 nt, Artificial Sequence
  derived and/or modified CDS sequence (opt1) from MUV(99-28)__DQ138142.1__N
augagcgaccugaaggagauccaggaggacaucgcccgccacgagcagcagcucguggucgcccggcagaagcugcgcgacgcggagaaggccguggagguggaccccgacgacgucaacaagaacacccugcaggcccggcagcagaccguguccgcccucgaggacaagcuggccgacuucaagcgccagauggcggacuucgugagccggaagaagauggacacgaagcccaccgaccccaccggcaucgagcccgacgaccaccugaaggagcgcuccagccuccgguacgggaacguccuggacgugaacgccaucgacaucgaggagcccuccggccagaccgccgacugguacacgaucgggguguacgucaucggcuucacccugccgaucgugcucaaggcccuguacaugcugagcacccgcgggcggcagaccgugaaggagaacaagggcacgcgcauccgguucaaggacgacaccuccuucgaggacaucaacggcauccgcagccccaagcaccucuacgucuccaugcccaccgcgcagagcaccaugaaggccgaggagcugacgcccgggcgguuccgcaccaucgugugcggccuguucccgacccagauccaggugcggaacaucaugucccccgucaugggggugaucggcuucagcuucuucgugaaggacugggucgagcgcaucaaggaguucauggagaaggagugccccuucaucaagcccgagccgaagcccgggacccccgccuccgagguggaguuccucaagcggaacaagaucuacuucaugaaccgccaggacgugcuggacaagaaccacguccccgacaucgacaagcugaucgacuacgccgccagcggcgacccgacgucccccgacaacaucgaggaccccaacgcgcccuggguguucagcugcgccccggaccggugcccgccgaccugccucuacguggccggcauggccgagcugggggccuucuucuccauccugcaggacaugcgcaacaccaucauggcgagcaagaccgucggcacggccgaggagaagcucaagaagaaguccagcuucuaccagagcuaccugcggcgcacccaguccauggggauccagcuggaccagcgcaucauccuccuguacaugcuggaguggggcaaggagaugguggaccacuuccaccucggcgacgacauggaccccgagcugcggacccuggcccaggcccucaucgaccagaaggucaaggagaucagcaaccaggagccccugaagaucuga

SEQ ID NO: 6544 - RNA, 1290 nt, Artificial Sequence
  derived and/or modified CDS sequence (opt1) from SANGV(SA14)__NC_034526.1__N
auggccacccuggaggagauccagaaggagaucaacauccacgagggccagcucaucaucgccaagcagaaggugaaggacgcggagaagcaguacgagaaggaccccgacgaccugaacaagcgcgcccugagcgaccgggaggggaucgcccacuccauccagagcaagaucgacgagcuccgccggcagcuggccgaccgcgucgccgcgggccggaaccuggggcaggagcgcgaccccaccggcguggagcccggggaccaccuccgggagaaguccaugcugagcuacggcaacgugaucgaccugaaccaccucgacaucgacgagcccacgggccagaccgccgacuggcuguccaucgucaucuaccugaccagcuucguggugcccauccuccugaaggcccuguacaugcucaccacgcgcgggcggcagaccaccaaggacaacaagggcaugcgcauccgguucaaggacgacuccagcuucgaggacgucaacgggauccgcaagccgaagcaccuguuccuguccaugcccaacgcccagagcuccaugaaggcggaggagaucacccccggccgguuccgcacggccgugugcgggcucuaccccgcccagaucaaggcccggaacauggugagcccggucauguccgugaucggcuucaucacccuggcccgcgacuggaccgagcggaucgagaacuggcuggaccagcccugcaaguucaugagcgagcccucccagaccagccuccagaagggccccgcgacgaaccgcgacuaccugaaccagcggcaggccucccuggcccagauggagaccaaggaggcccaggccgugcgccagcaggcggucgacgccgggugcaaccucguggaccacaucgacagcccguccagcaucuggguguucgccggcgcccccgaccggugcccgccgaccugccuguucaucagcgggauggccgagcugggcgcguucuucuccauccuccaggacaugcgcaacaccaucauggccagcaagacggucggcaccuccgaggagaagcugcgcaagaaguccagcuucuaccagagcuaccugcggcgcacccaguccauggggauccagcucgaccagcggaucaucaucauguucaugguggaguggggcaaggaggccguggacggguuccaccugggcgacgacauggaccccgagcugcgcagcuucgcccaggcccucaucgaccagaaggucaaggagaucuccaaccaggagccccugaagaucuga

SEQ ID NO: 6545 - RNA, 1290 nt, Artificial Sequence
  derived and/or modified CDS sequence (opt1) from SANGV(SA22)__JQ082303.1__N
auggccacccuggaggagauccagaaggagaucaacauccacgagggccagcucaucaucgccaagcagaaggugaaggacgcggagaagcaguacgagaaggaccccgacgaccugaacaagcgcgcccugagcgaccgggaggggaucgcccacuccauccagagcaagaucgacgagcuccgccggcagcuggccgaccgcgucgccgcgggccggaaccuggggcaggagcgcgaccccaccggcguggagcccggggaccaccuccgggagaaguccaugcugagcuacggcaacgugaucgaccugaaccaccucgacaucgacgagcccacgggccagaccgccgacuggcuguccaucgucaucuaccugaccagcuucguggugcccauccuccugaaggcccuguacaugcucaccacgcgcgggcggcagaccaccaaggacaacaagggcaugcgcauccgguucaaggacgacuccagcuucgaggacgucaacgggauccgcaagccgaagcaccuguuccuguccaugcccaacgcccagagcuccaugaaggcggaggagaucacccccggccgguuccgcacggccgugugcgggcucuaccccgcccagaucaaggcccggaacauggugagcccggucauguccgugaucggcuucaucacccuggcccgcgacuggaccgagcggaucgagaacuggcuggaccagcccugcaaguucaugagcgagcccucccagaccagccuccagaagggccccgcgacgaaccgcgacuaccugaaccagcggcaggccucccuggcccagauggagaccaaggaggcccaggccgugcgccagcaggcggucgacgccgggugcaaccucguggaccacaucgacagcccguccagcaucuggguguucgccggcgcccccgaccggugcccgccgaccugccuguucaucagcgggauggccgagcugggcgcguucuucuccauccuccaggacaugcgcaacaccaucauggccagcaagacggucggcaccuccgaggagaagcugcgcaagaaguccagcuucuaccagagcuaccugcggcgcacccaguccauggggauccagcucgaccagcggaucaucaucauguucaugguggaguggggcaaggagguggucgacggguuccaccugggcgacgacauggaccccgagcugcgcagcuucgcccaggcccucaucgaccagaaggugaaggagaucuccaaccaggagccccugaagaucuga

SEQ ID NO: 6546 - RNA, 1290 nt, Artificial Sequence
  derived and/or modified CDS sequence (opt1) from SEOV(L99)__AF288299.1__N
auggccaccauggaggagauccagcgcgagaucagcgcccacgagggccagcuggugaucgcgcggcagaaggucaaggacgccgagaagcaguacgagaaggaccccgacgaccucaacaagcgcacccugcacgaccgggaguccguggccgccagcauccaguccaagaucgacgagcugaagcgccagcucgccgaccggaucgcggccgggaagaacaucggccaggaccgcgaccccacggggguggagcccggcgaccaccugaaggagcggagcgcccuguccuacgggaacacccucgaccugaacagccuggacaucgacgagcccaccggccagaccgccgacuggcucacgaucaucgucuaccugaccuccuucguggugcccaucauccugaaggcgcucuacaugcugaccacccgcggccggcagacgagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacccccgggcgguuccgcaccgccgugugcggccucuaccccgcccagaucaaggcgcggaacauggucagcccggugauguccguggucggguuccuggcccuggccaaggacuggaccagccgcaucgaggaguggcucggcgcccccugcaaguucauggccgagucccccaucgcgggcagccuguccgggaaccccgugaaccgggacuacauccgccagcggcagggcgcccuggccgggauggagccgaaggaguuccaggcccuccgccagcacgccaaggacgcgggcugcacgcugguggagcacaucgagagccccagcuccaucugggucuucgccggcgcccccgaccggugcccgccgaccugccuguucgucgggggcauggccgagcucggggccuucuucagcauccugcaggacaugcgcaacaccaucauggcguccaagaccgugggcacggccgacgagaagcugcgcaagaaguccagcuucuaccagagcuaccuccggcgcacccaguccauggggauccagcuggaccagcggaucaucgugauguucaugguggccuggggcaaggaggccguguacaacuuccaccugggcgacgacauggaccccgagcuccgcagccuggcgcagauccugaucgaccagaaggucaaggagaucuccaaccaggagcccaugaagcucuga

SEQ ID NO: 6547 - RNA, 1290 nt, Artificial Sequence
  derived and/or modified CDS sequence (opt1) from SEOV(SG42/2011)__KY807171.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgaccccaccgggguggagcccggcgaccaccugaaggagcggagcgcccuguccuacgggaacacgcucgaccugaacagccuggacaucgacgagcccaccggccagaccgcggacugguccaccaucaucgucuaccucacgagcuucguggugcccaucauccugaaggcccuguacaugcucaccacccgcggccggcagaccuccaaggacaacaaggggaugcgcauccgguucaaggacgacagcuccuacgaggacgucaacggcauccgcaagccgaagcaccuguacgugagcaugcccaacgcccaguccagcaugaaggccgaggagaucacgcccgggcgguuccgcaccgccgugugcggccuguaccccgcgcagaucaaggcccggaacauggucuccccggugaugagcguggucggguuccucgcccuggccaaggacugguccagccgcaucgaggaguggcugggcgcccccugcaaguucauggcggagucccccaucgccggcagccucagcgggaaccccgugaaccgggacuacauccgccagcggcagggcgcccuggccgggauggagccgaaggaguuccaggcccugcgccagcacuccaaggacgcgggcugcacccucguggagcacaucgagagccccuccagcaucugggucuucgccggcgcccccgaccggugcccgccgaccugccuguucgucgggggcauggccgagcugggggccuucuucuccauccuccaggacaugcgcaacacgaucauggcgagcaagaccgugggcaccgccgacgagaagcugcgcaagaaguccagcuucuaccaguccuaccugcggcgcacccagagcauggggauccagcucgaccagcggaucaucgugauguucaugguggccuggggcaaggaggccguggacaacuuccaccugggcgacgacauggaccccgagcugcgcucccucgcgcagauccugaucgaccagaaggucaaggagaucagcaaccaggagcccaugaagcuguga

SEQ ID NO: 6548 - RNA, 1290 nt, Artificial Sequence
  derived and/or modified CDS sequence (opt1) from SEOV(XJ2/2011)__KY807169.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcagccggcagaccuccaaggacaacaagggcaugcgcauccgguucaaggacgacagcuccuacgaggacgucaacgggauccgcaagccgaagcaccuguacgugagcaugcccaacgcccaguccagcaugcgggccgaggagaucacgcccggccgcuuccggaccgccgugugcgggcucuaccccgcgcagaucaaggcccgcaacauggucuccccggugaugagcguggucggcuuccuggcccuggccaaggacuggaccucccggaucgaggaguggcucggggcccccugcaaguucauggcggagagccccaucgccggcucccugagcggcaaccccgugaaccgcgacuacauccggcagcgccagggggcccuggccggcugggagccgaaggaguuccaggcccuccggcagcacagcaaggacgcggggugcacccugguggagcacaucgagucccccagcuccaucugggucuucgccggcgcccccgaccgcugcccgcccacgugccuguucgugggcgggauggccgagcucggcgccuucuucagcauccugcaggacaugcgcaacaccaucauggcguccaagaccguggggaccgccgacgagaagcugcggaagaaguccagcuucuaccagagcuaccuccgccggacgcaguccaugggcauccagcuggaccagcgcaucaucgucauguucaugguggccugggggaaggaggccguggacaacuuccaccugggcgacgacauggaccccgagcuccggagccuggcgcagauccugaucgaccagaaggucaaggagaucuccaaccaggagcccaugaagcucuga

SEQ ID NO: 6549 - RNA, 1290 nt, Artificial Sequence
  derived and/or modified CDS sequence (opt1) from SEOV(XJ5/2011)__KY807170.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggaaccccgugaaccgggacuacauccgccagcggcagggcgcccuggccgggauggagccgaaggaguuccaggcccuccgccagcaccccaaggacgcgggcugcacccugguggagcacaucgagagccccagcuccaucugggucuucgccggcgcccccgaccggugcccgcccacgugccuguucgucgggggcauggccgagcucggggccuucuucagcauccugcaggacaugcgcaacaccaucauggcguccaagaccgugagcaccgccgacgagaagcugcgcaagaaguccagcuucuaccaguccuaccuccggcgcacgcagagcaugggcauccagcuggaccagcggaucaucgugauguucaugguggccugggggaaggaggccguggacaacuuccaccugggcgacgacauggaccccgagcuccgcucccuggcgcagauccugaucgaccagaaggucaaggagaucagcaaccaggagcccaugaagcucuga

SEQ ID NO: 6550 - RNA, 1290 nt, Artificial Sequence
  derived and/or modified CDS sequence (opt1) from SEOV(10-134)__JF693882.2__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucgugcugcccaucauccucaaggcccuguacaugcugaccacccgcggccggcagaccagcaaggacaacaaggggaugcgcauccgguucaaggacgacuccagcuacgaggacgugaacggcauccgcaagccgaagcaccucuacgucuccaugcccaacgcccagagcuccaugaaggccgaggagaucacgcccgggcgguuccgcaccgccgugugcggccuguaccccgcgcagaucaaggcccggaacauggugagcccggucauguccguggugggguuccuggcccucgccaaggacuggaccagccgcaucgaggaguggcugggcgcccccugcaaguucauggcggagucccccaucgccggcagccuguccgggaaccccgucaaccgggacuacauccgccagcggcagggcgcccucgccgggauggagccgaaggaguuccaggcccugcgccagcacagcaaggacgcgggcugcacccugguggagcacaucgagagccccuccagcaucuggguguucgccggcgcccccgaccggugcccgcccacgugccucuucgucgggggcauggccgagcugggggccuucuucuccauccugcaggacaugcgcaacaccaucauggcgagcaagaccgugggcaccgccgacgagaagcuccgcaagaaguccagcuucuaccaguccuaccugcggcgcacgcagagcauggggauccagcuggaccagcggaucaucgugauguucauggucgccuggggcaaggaggccguggacaacuuccaccucggcgacgacauggaccccgagcugcgcucccuggcgcagauccucaucgaccagaaggugaaggagaucagcaaccaggagcccaugaagcuguga

SEQ ID NO: 6551 - RNA, 1290 nt, Artificial Sequence
  derived and/or modified CDS sequence (opt1) from SEOV(DPRK08)__JX853575.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggaaccccgugaaccgggacuacauccgccagcggcagggcgcccuggccgggauggagccgaaggaguuccaggcccuccgccagcacgcgaaggacgccggcugcacccugguggagcacaucgagagccccagcuccaucugggucuucgccggcgcccccgaccggugcccgcccacgugccuguucgucgggggcauggccgagcucggggcguucuucagcauccugcaggacaugcgcaacaccaucauggccuccaagaccgugggcaccgccgacgagaagcugcgcaagaaguccagcuucuaccagagcuaccuccggcgcacgcaguccauggggauccagcuggaccagcggaucaucgugauguucaugguggccuggggcaaggaggcgguggacaacuuccaccugggcgacgacauggaccccgagcuccgcagccuggcccagauccugaucgaccagaaggucaaggagaucuccaaccaggagcccaugaagcucuga

SEQ ID NO: 6552 - RNA, 1290 nt, Artificial Sequence
  derived and/or modified CDS sequence (opt1) from SEOV(Fj372/2013)__KP645198.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggagccccgugaaccgggacuacauccgccagcggcagggcgcccuggccgggauggagccgaaggaguuccaggcccuccgccagcacgcgaaggacgccggcugcacccugguggagcacaucgagagccccuccagcaucugggucuucgccggcgcccccgaccggugcccgcccacgugccuguucgucgggggcauggccgagcucggggcguucuucuccauccugcaggacaugcgcaacaccaucauggccagcaagaccgugggcaccgccgacgagaagcugcgcaagaaguccagcuucuaccaguccuaccuccggcgcacgcagagcauggggauccagcuggaccagcggaucaucgugauguucaugguggccuggggcaaggaggcgguggacaacuuccaccugggcgacgacauggaccccgagcuccgcucccuggcccagauccugaucgaccagaaggucaaggagaucagcaaccaggagcccaugaagcucuga

SEQ ID NO: 6553 - RNA, 1290 nt, Artificial Sequence
  derived and/or modified CDS sequence (opt1) from SEOV(HeB38)__JN377553.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugaagauccgcuucaaggacgacuccagcuacgaggacgucaacggcauccggaagccgaagcaccuguacguguccaugcccaacgcccagagcuccaugaaggccgaggagaucacgcccgggcgcuuccggaccgccgugugcggccucuaccccgcgcagaucaaggcccgcaacauggucagcccggugauguccguggucggguuccuggcccuggccaaggacuggaccagccggaucgaggaguggcucggcgcccccugcaaguucauggcggagucccccaucgccggcagccuguccgggaaccccgugaaccgcgacuacauccggcagcgccagggcgcccuggccgggauggagccgaaggaguuccaggcccuccggcagcacagcaaggacgcgggcugcacccugguggagcacaucgagagccccuccagcaucugggucuucgccggcgcccccgaccgcugcccgcccacgugccuguucgucgggggcauggccgagcucggggccuucuucuccauccugcaggacaugcggaacaccaucauggcgagcaagaccgugggcaccgccgacgagaagcugcgcaagaagucccccuucuaccagagcuaccuccgccggacgcaguccauggggauccagcuggaccagcgcaucaucgugauguucaugguggccuggggcaaggaggccguggacaacuuccaccugggcgacgacauggaccccgagcuccgggggcuggcgcagauccugaucgaccagaaggucaaggagaucagcaaccaggagcccaugaagcucuga

SEQ ID NO: 6554 - RNA, 1290 nt, Artificial Sequence
  derived and/or modified CDS sequence (opt1) from SEOV(JiangxiXinjianRn-07-2011)__KP859511.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggaaccccgugaaccgggacuacauccgccagcggcagggcgcccuggccgggauggagccgaaggaguuccaggcccuccgccagcacagcaaggacgcgggcugcacccugguggagcacaucgagagccccuccagcaucugggucuucgccggcgcccccgaccggugcccgcccacgugccuguucgucgggggcauggccgagcucggggccuucuucuccauccugcaggacaugcgcaacaccaucauggcgagcaagaccgugggcaccgccgacgagaagcugcgcaagaaguccagcuucuaccaguccuaccuccggcgcacgcagagcauggggauccagcuggaccagcggaucaucgugauguucaugguggccuggggcaaggaggccguggacaacuuccaccugggcgacgacauggaccccgagcuccgcucccuggcgcagauccugaucgaccagaaggucaaggagaucagcaaccaggagcccaugaagcucuga

SEQ ID NO: 6555 - RNA, 1290 nt, Artificial Sequence
  derived and/or modified CDS sequence (opt1) from SEOV(JiangxiXinjianRn-09-2011)__KP859512.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccaguucagcaugaaggccgaggagaucacgcccgggcgguuccgcaccgccgugugcggccucuaccccgcgcagaucaaggcccggaacauggucuccccggugaugagcguggucggguuccuggcccuggccaaggacuggaccucccgcaucgaggaguggcucggcgcccccugcaaguucauggcggagagccccaucgccggcucccugagcgggaaccccgugaaccgggacuacauccgccagcggcagggcgcccuggccgggauggagccgaaggaguuccaggcccuccgccagcacuccaaggacgcgggcugcacccugguggagcacaucgagagccccagcuccaucugggucuucgccggcgcccccgaccggugcccgcccacgugccuguucgucgggggcauggccgagcucggggccuucuucagcauccugcaggacaugcgcaacaccaucauggcguccaagaccgugggcaccgccgacgagaagcugcgcaagaaguccagcuucuaccagagcuaccuccggcgcacgcaguccauggggauccagcuggaccagcggaucaucgugauguucaugguggccuggggcaaggaggccguggacaacuuccaccugggcgacgacauggaccccgagcuccgcagccuggcgcagauccugaucgaccagaaggucaaggagaucuccaaccaggagcccaugaagcucuga

SEQ ID NO: 6556 - RNA, 1290 nt, Artificial Sequence
  derived and/or modified CDS sequence (opt1) from SEOV(Singapore/06(RN41))__GQ274944.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggaaccccgugaaccgggacuacauccgccagcggcagggcgcccuggccgggauggagccgaaggaguuccaggcccuccgccagcacagcaaggacgcgggcugcacccugguggagcacaucgagagccccuccagcaucugggucuucgccggcgcccccgaccggugcccgcccacgugccuguucgucgggggcauggccgagcucggggccuucuucuccauccugcaggacaugcgcaacaccaucauggcgagcaagaccgugggcaccgccgacgagaagcugcgcaagaaguccagcuucuaccaguccuaccuccggcgcacgcagagcauggggauccagcuggaccagcggaucaucgugauguucaugguggccuggggcaaggaggccguggacaacuuccaccugggcgacgacauggaccccgagcuccgcgggcuggcgcagauccugaucgaccagaaggucaaggagaucuccaaccaggagcccaugaagcucuga

SEQ ID NO: 6557 - RNA, 1290 nt, Artificial Sequence
  derived and/or modified CDS sequence (opt1) from SEOV(YaluRiver12)__HQ611980.1__N
auggccaccauggaggagauccagcgcgagaucagcgcccacgagggccagcuggugaucgcgcggcagaaggucaaggacgccgagaagcaguacgagaaggaccccggggaccucaacaagcgcgcccugcacgaccgggaguccguggccgccagcauccaguccaagaucgacgagcugaagcgccagcucgcggaccggaucgccgccggcaagaacaucgggcaggaccgcgaccccaccggcguggagcccggggaccaccugaaggagcggagcgcccuguccuacggcaacacgcucgaccugaacagccuggacaucgacgagcccaccggccagaccgcggacuggcucaccaucaucgucuaccugacguccuucguggugcccaucauccugaaggcccucuacaugcugaccacccgcgggcggcagaccagcaaggacuccaagggcaugcgcauccgguucaaggacgacagcuccuacgaggacgucaacgggauccgcaagccgaagcaccuguacgugagcaugcccaacgcccaguccagcaugaagacggaggagaucacccccggccgguuccgcaccgccgugugcgggcucuaccccgcccagaucaaggcgcggaacauggucuccccggugaugagcguggucggcuuccuggcccuggccaaggacuggaccucccgcaucgaggaguggcucggcgcccccugcaaguucauggccgagagccccaucgcggggucccugagcgagaaccccgugaaccgggacuacauccgccagcggcagggcgcccuggccgggauggagccgaaggaguuccaggcccuccgccagcacgccaaggacgcgggcugcacgcugguggagcacaucgagagccccuccagcaucugggucuucgccggcgcccccgaccggugcccgccgaccugccuguucgucgggggcauggccgagcucggggccuucuucuccauccugcaggacaugcgcaacaccaucauggcgagcaagaccgugggcacggccgacgagaagcugcgcaagaaguccagcuucuaccaguccuaccuccggcgcacccagagcauggggauccagcuggaccagcggaucaucgugauguucaugguggccuggggcaaggaggccguggacaacuuccaccugggcgacgacauggaccccgagcuccgcucccuggcgcagauccugaucgaccagaaggucaaggagaucagcaaccaggagcccaugaagcucuga

SEQ ID NO: 6558 - RNA, 1290 nt, Artificial Sequence
  derived and/or modified CDS sequence (opt1) from SEOV(14D12)__AB618124.1__N
auggccaccauggaggagauccagaaggagaucagcgcccacgagggccagcuggugaucgcgcgccagaaggucaaggacgccgagaagcaguacgagaaggaccccgacgaccucaacaagcgggcccugcacgaccgcgaguccguggccgccagcauccaguccaagaucgacgagcugaagcggcagcucgcggaccgcaucgccgccgggaagaacaucggccaggaccgggacccgaccgggguggagcccggcgaccaccugaaggagcgcagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccggggccgccagaccagcaaggacaacaaggggaugcggauccgcuucaaggacgacuccagcuacgaggacgucaacggcauccggaagccgaagcaccuguacguguccaugcccaacgcccagagcuccaugaaggccgaggagaucacgcccgggcgcuuccggaccgccgugugcggccucuaccccgcgcagaucaaggcccgcaacauggucagcccggugauguccguggucggguuccuggcccuggccaaggacuggaccagccggaucgaggaguggcucggcgcccccugcaaguucauggcggagucccccaucgccggcagccuguccgggaaccccgugaaccgcgacuacauccggcagcgccagggcgcccuggccgggauggagccgaaggaguuccaggcccuccggcagcacagcaaggacgcgggcugcacccugguggagcacaucgagagccccuccagcaucugggucuucgccggcgcccccgaccgcugcccgcccacgugccuguucgucgggggcauggccgagcucggggccuucuucuccauccugcaggacaugcggaacaccaucauggcgagcaagaccgugggcaccgccgacgagaagcugcgcaagaaguccagcuucuaccaguccuaccuccgccggacgcagagcauggggauccagcuggaccagcgcaucaucgugauguucaugguggccuggggcaaggaggccguggacaacuuccaccugggcgacgacauggaccccgagcuccggucccuggcgcagauccugaucgaccagaaggucaaggagaucagcaaccaggagcccaugaagcucuga

SEQ ID NO: 6559 - RNA, 1281 nt, Artificial Sequence
  derived and/or modified CDS sequence (opt1) from SEOV(19CSG)__AB618114.1__N
auggaggagauccagcgcgagaucagcgcccacgagggccagcuggugaucgcccggcagaaggucaaggacgcggagaagcaguacgagaaggaccccgacgaccucaacaagcgcgcccugcacgaccgggaguccguggccgccagcauccaguccaagaucgacgagcugaagcgccagcucgccgaccggaucgcggccgggaagaacaucggccaggaccgcgaccccaccgggguggagcccggcgaccaccugaaggagcggagcgcccuguccuacgggaacacccucgaccugaacagccuggacaucgacgagcccacgggccagaccgccgacuggcucaccaucaucgucuaccugaccuccuucguggugcccaucauccugaaggcgcucuacaugcugacgacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacccccgggcgguuccgcacggccgugugcggccucuaccccgcccagaucaaggcgcggaacauggucagcccggugauguccguggucggguuccuggcccuggccaaggacuggaccagccgcaucgaggaguggcucggcgcccccugcaaguucauggccgagucccccaucgcgggcagccuguccgggaaccccgugaaccgggacuacauccgccagcggcagggcgcccuggccgggauggagccgaaggaguuccaggcccuccgccagcacagcaaggacgccggcugcacccugguggagcacaucgagagccccuccagcaucugggucuucgcgggcgcccccgaccggugcccgccgaccugccuguucgucgggggcauggccgagcucggggccuucuucuccauccugcaggacaugcgcaacacgaucauggccagcaagaccgugggcaccgcggacgagaagcugcgcaagaaguccagcuucuaccaguccuaccuccggcgcacccagagcauggggauccagcuggaccagcggaucaucgugauguucaugguggccuggggcaaggaggccguggacaacuuccaccugggcgacgacauggaccccgagcuccgcucccuggcccagauccugaucgaccagaaggucaaggagaucagcaaccaggagcccaugaagcucuga

SEQ ID NO: 6560 - RNA, 1290 nt, Artificial Sequence
  derived and/or modified CDS sequence (opt1) from SEOV(93HBX12)__EF192308.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcaucgggaagccgaagcaccuguacguguccaugcccaacgcccagagcuccaugaaggccgaggagaucacgcccggccgcuuccggaccgccgugugcgggcucuaccccgcgcagaucaaggcccgcaacauggucagcccggugauguccguggucggcuuccuggcccuggccaaggacuggaccagccggaucgaggaguggcucggcgcccccugcaaguucauggcggagucccccaucgccgggagccuguccggcaaccccgugaaccgcgacuacauccggcagcgccagggggcccuggccggcauggagccgaaggaguuccaggcccuccggcagcacagcaaggacgcgggcugcacccugguggagcacaucgagagccccuccagcaucugggucuucgccggggcccccgaccgcugcccgcccacgugccuguucgugggcgggauggccgagcucggcgccuucuucuccauccugcaggacaugcggaacaccaucauggcgagcaagaccguggggaccgccgacgagaagcugcgcaagaaguccagcuucuaccaguccuaccuccgccggacgcagagcaugggcauccagcuggaccagcgcaucaucgucauguucaugguggccuggggcaaggaggccguggacaacuuccaccugggggacgacauggaccccgagcuccggggccuggcgcagauccugaucgaccagaaggucaaggagaucuccaaccaggagcccaugaagcucuga

SEQ ID NO: 6561 - RNA, 1290 nt, Artificial Sequence
  derived and/or modified CDS sequence (opt1) from SEOV(Cherwell)__KC626089.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucaucgcggagucccccaucgccggcagccuguccgggaaccccgugaaccgggacuacauccgccagcggcagggcgcccuggccgggauggagccgaaggaguuccaggcccuccgccagcacagcaaggacgcgggcugcacccugguggagcacaucgagagccccuccagcaucugggucuucgccggcgcccccgaccggugcccgcccacgugccuguucgucgggggcauggccgagcucggggccuucuucuccauccugcaggacaugcgcaacaccaucauggcgagcaagaccgugggcaccgccgacgagaagcugcgcaagaaguccagcuucuaccaguccuaccuccggcgcacgcagagcauggggauccagcuggaccagcggaucaucgugauguucaugguggccuggggcaaggaggccguggacaacuuccaccugggcgacgacauggaccccgagcuccgcucccuggcgcagauccugaucgaccagaaggucaaggagaucagcaaccaggagcccaugaagcucuga

SEQ ID NO: 6562 - RNA, 1290 nt, Artificial Sequence
  derived and/or modified CDS sequence (opt1) from SEOV(CixiRf23)__FJ803201.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggaaccccgugaaccgggacuacauccgccagcggcagggcgcccuggccgggauggagccgaaggaguuccaggcccuccgccagcacgcgaaggacgccggccggacccugguggagcacaucgagagccccagcuccaucugggucuucgccggcgcccccgaccgcugcccgcccacgugccuguucgucgggggcauggccgagcucggggcguucuucagcauccugcaggacaugcgcaacaccaucauggccuccaagaccgugggcaccgccgacgagaagcugcggaagaaguccagcuucuaccagagcuaccuccgccggacgcaguccauggggauccagcuggaccagcgcaucaucgugauguucaugguggccuggggcaaggaggcgguggacaacuuccaccugggcgacgacauggaccccgagcuccggagccuggcccagauccugaucgaccagaaggucaaggagaucuccaaccaggagcccaugaagcucuga

SEQ ID NO: 6563 - RNA, 1290 nt, Artificial Sequence
  derived and/or modified CDS sequence (opt1) from SEOV(CixiRf56)__FJ803202.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggaaccccgugaaccgggacuacauccgccagggccagggggcccuggccggcauggagccgaaggaguuccaggcccuccggcagcacgcgaaggacgccggcugcacccugguggagcacaucgagagccccagcuccaucugggucuucgccggggcccccgaccgcugcccgcccacgugccuguucgugggcgggauggccgagcucggcgcguucuucagcauccugcaggacaugcggaacaccaucauggccuccaagaccguggggaccgccgacgagaagcugcgcaagaaguccagcuucuaccagagcuaccuccgccggacgcaguccaugggcauccagcuggaccagcgcaucaucgucauguucaugguggccuggggcaaggaggcgguggacaacuucccccugguccacgacauggaccccaagcuccggagccugucccagauccugaucgaccagaaggugaacgagaucagcaaccaggagcccaugaagcucuga

SEQ ID NO: 6564 - RNA, 1290 nt, Artificial Sequence
  derived and/or modified CDS sequence (opt1) from SEOV(CixiRn21)__FJ803205.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggaaccccgugaaccgggacuacauccgccagcggcagggcgcccuggccgggauggagccgaaggaguuccaggcccuccgccagcacagcaaggacgcgggcugcacccugguggagcacaucgagagccccuccagcaucugggucuucgccggcgcccccgaccggugcccgcccacgugccuguucgucgggggcauggacgagcucggggccuucuucuccauccugcaggacaugcgcaacaccaucauggccagcaagaccgugggcaccgcggacgagaagcugcgcaagaaguccagcuucuaccaguccuaccuccggcgcacgcagagcauggggauccagcuggaccaccggaucaucgugauguucaugguggccuggggcaaggaggccguggacaacuuccaccugggcgacgacauggaccccgagcuccgcacccuggcccagauccugaucgaccagaaggucaaggagaucuccaaccaggagcccaugaagcucuga

SEQ ID NO: 6565 - RNA, 1290 nt, Artificial Sequence
  derived and/or modified CDS sequence (opt1) from SEOV(CixiRn76)__FJ803206.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccagccagaacgcccaguccagcaugaaggccgaggagaucacgcccgggcgguuccgcaccgccgugugcggccucuaccccgcgcagaucaaggcccggaacauggucucccccgugaugagcguggucggguuccuggcccuggccaaggacuggaccucccgcaucgaggaguggcucggcgccccgugcaaguucauggcggagagccccaucgccggcucccugagcgggaaccccgugaaccgggacuacauccgccagggccagggggcccuggccggcauggagcccaaggaguuccaggcccuccggcagcacgcgaaggacgccggcugcacccugguggagcacaucgagagcccguccagcaucugggucuucgccggggcccgcgaccggugcccgcccacgugccuguucgugggcgggauggccgagcucggcgcguucuucuccauccugcaggacaugcgcaacaccaucauggccagcaagaccguggggaccgccgacgagaagcugcgcaagaaguccagcuucuaccaguccuaccuccggcgcacgcagagcaugggcauccagcuggaccagcggaucaucgucauguucaugguggccuggggcaaggaggcgguggacaacuuccaccugggggacgacauggaccccgagcuccgcucccuggcccagauccugaucgaccagaaggucaaggagaucagcaaccaggagcccaugaagcucuga

SEQ ID NO: 6566 - RNA, 1290 nt, Artificial Sequence
  derived and/or modified CDS sequence (opt1) from SEOV(CUI)__GQ279395.1__N
auggccaccauggaggagcugcagcgcgagaucagcgcccacgagggccagcucgugaucgcgcggcagaaggucaaggacgccgagaagcaguacgagaaggaccccgacgaccugaacaagcgcgcccugcacgaccgggaguccguggccgccagcauccaguccaagaucgacgagcucaagcgccagcuggcggaccggaucgccgccgggaagaacaucggccaggaccgcgacccgaccgggguggagcccggcgaccaccugaaggagcggagcgcccucuccuacgggaacacgcuggaccugaacagccucgacaucgacgagcccaccggccagaccgcggacuggcugaccaucaucgucuaccugacguccuucguggugcccaucauccucaaggcccuguacaugcugaccacccgcggccggcagaccagcaaggacaacaaggggaugcgcauccgguucaaggacgacuccagcuacgaggacgucaacggcauccgcaagccgaagcaccucuacguguccaugcccaacgcccagagcuccaugaaggccgaggagaucacgcccgggcgguuccgcaccgccgugugcggccuguaccccgcgcagaucaaggcccggaacaugcugagcccggucauguccguggugggguuccucgcccuggccaaggacuggaccagccgcaucgaggaguggcugggcgcccccugcaaguucauggcggagucccccaucgccggcagccucuccgggaaccccgucaaccgggacuacauccgccagcggcagggcgcccuggccgggauggagccgaaggaguuccaggcccugcgccagcacagcaaggacgcgggcugcacccucguggagcacaucgagagccccuccagcaucuggguguucgccggcgcccccgaccggugcccgcccacgugccuguucgucgggggcauggccgagcugggggccuucuucuccauccuccaggacaugcgcaacaccaucauggcgagcaagaccgugggcaccgccgacaagaagcugcgcaagaaguccagcuucuaccaguccuaccugcggcgcacgcagagcauggggauccagcucgaccagcggaucaucgugauguucauguucgccuggggcaaggaggccgucgacaacuuccaccugggcgacgacauggaccccgagcugcgcgggcucgcgcagauccugaucgaccagaaggugaaggagaucuccaaccaggagcccaugaagcuguga

SEQ ID NO: 6567 - RNA, 1290 nt, Artificial Sequence
  derived and/or modified CDS sequence (opt1) from SEOV(FeixianRn1)__GU592942.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgaccccaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucaccggcagccuguccgggaaccccgugaaccgggacuacauccgccagcggcagggcgcccuggccgggauggagccgaaggaguuccaggcccuccgccagcacgccaaggacgcgggcugcacgcugguggagcacaucgagagccccagcuccaucugggucuucgccggcgcccccgaccggugcccgccgaccugccuguucgucgggggcauggccgagcucggggccuucuucagcauccugcaggacaugcgcaacaccaucauggcguccaagaccgugggcacggccgacgagaagcugcgcaagaaguccagcuucuaccagagcuaccuccggcgcacccaguccauggggauccagcuggaccagcggaucaucgugauguucaugguggccuggggcaaggaggccguggacaacuuccaccugggcgacgacauggaccccgagcuccgcagccuggcgcagauccugaucgaccagaaggucaaggagaucuccaaccaggagcccaugaagcucuga

SEQ ID NO: 6568 - RNA, 1290 nt, Artificial Sequence
  derived and/or modified CDS sequence (opt1) from SEOV(GanyuRn66)__GU592932.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgaccccaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucaccgcggagucccccaucgccggcagccuguccgggaaccccgugaaccgggacuacauccgccagcggcagggcgcccuggccgggauggagccgaaggaguuccaggcccuccgccagcacgcgaaggacgccggcugcacgcugguggagcacaucgagagccccagcuccaucugggucuucgccggcgcccccgaccggugcccgccgaccugccuguucgucgggggcauggccgagcucggggcguucuucagcauccugcaggacaugcgcaacaccaucauggccuccaagaccgugggcacggccgacgagaagcugcgcaagaaguccagcuucuaccagagcuaccuccggcgcacccaguccauggggauccagcuggaccagcggaucaucgugauguucaugguggccuggggcaaggaggcgguggacaacuuccaccugggcgacgacauggaccccgagcuccgcagccuggcccagauccugaucgaccagaaggucaaggagaucuccaaccaggagcccaugaagcucuga

SEQ ID NO: 6569 - RNA, 1290 nt, Artificial Sequence
  derived and/or modified CDS sequence (opt1) from SEOV(Gongzhuling108)__KF745947.1__N
auggccaccauggaggagauccagcgcgagaucagcgcccacgagggccagcuggugaucgcgcggcagaaggucaaggacgccgagaagcaguacgagaaggaccccgacgaccucaacaaguccgcccugcacgaccgcgagagcguggccgccuccauccagagcaagaucgacgagcugaagcggcagcucgcggaccgcaucgccgccgggaagaacaucggccaggaccgggacccgaccgggguggagcccggcgaccaccugaaggagcgcuccgcccugagcuacgggaacacgcucgaccugaacucccuggacaucgacgagcccaccggccagaccgcggacuggcucaccauccuggucuaccugacgagcuucguggugcccaucauccucaaggcccuguacaugcugaccacccggggccgccagaccuccaaggacaacaaggggaugcggauccgcuucaaggacgacggcagcuacgaggacgucaacgggauccggaagccgaagcaccucuacgugcccaugcccaacgcccaguccagcaugaaggccgaggagaucacgcccggccgcuuccggaccgccgugugcgggcuguacccggcgcagaucaagccccgcaacauggucucccccgugaugagcguggucggcuuccuggcccucgccaaggacuggaccucccggaucgaggaguggcugggcgcccccugcaaguucauggccgagagcccgaucgcggggucccugagcggcaaccccgugaaccgcgacuacauccggcagcgccagggggcccucgccggcauggagcccaaggaguuccaggcccugcggcagcacgccaaggacgcgggcugcacccugguggagcacaucgagucccccagcagcauccgcgucuucgccggggccccggcccggugcccgcccacgugccucuucgugggcgggauggccgagcugggcgcguucuucuccauccugcaggacaugcgcaacaccaucauggccagcaagaccguggggaccgccgacgagaagcuccgcaagaaguccagcuucuaccaguccuaccugcggcgcagccaguccaugggcauccagcuggaccagcggaucaucgucauguucaugguggccagcggcaaggaggcgguggacaacuuccaccucggggacgacauggaccccgagcugcgcucccugguccagauccucaucgaccagaaggugaaggagaucagcaaccaggagcccaugaagcuguga

SEQ ID NO: 6570 - RNA, 1290 nt, Artificial Sequence
  derived and/or modified CDS sequence (opt1) from SEOV(Gongzhuling147)__KF745948.1__N
auggccaccauggaggagauccagcgcgagaucagcgcccacgagggccagcuggugaucgcgcggcagaucgucaaggacgccgagaagcaguacgagaaggaccccgccgaccucaacaagcgcgcccugcacgaccgggaguccguggccgcgagcauccaguccaagaucgacgagcugaagcgccaccucgccgaccggaucgccgccgggaagaacaucggccaggaccgcgacccgaccgggguggagcccggcgaccaccugaaggagcggagcgcgcuguccuacgggaacacgcucgaccugaacagccuggacaucgacgagcccaccggccagaccgccgacuggcucaccaucaucgucuaccugacguccuucguggugcccaucauccugaaggcccucuacauccugaccaccagcggccgccagaccuccaaggacaacaaggggaugcggauccgcuucaaggacgacagcuccuacgaggacgucaacggcauccggaugccgaagcaccuguacgugcccaugcccaacgcccagagcuccaugaaggccgaggacaucacgcccgggcgcuuccggaccgcggugugcggccucuacccggcccagaucaaggcccgcaacauggucagcccccugauguccguggugggguuccuggcccuccccaaggacuggaccagccggaucgacgaguggcugggcgcccccugcaaguucauggcggaguccccgaucgccggcagccuguccgggaaccccgucaaccgcgaccacauccggcagcgccagggcgcccucgccgggauggaccccaaggaguuccaggccgugcggcagcacgcgaaggacgccggcugcacccugguggagcacaucgagagccccagcuccaucugggucuucgccggcgccccggaccgcugcccgcccacgugccuguucgucgggggcauggccgagcucggggcguucuucaccauccugcaggacaugcggaacaccaucaugcccagcaagaccgugggcacggccgacgagaagcugcgcaagaaguccagcuucuaccaguccuaccuccgccggacccagagcauggggauccagcuggaccagcgcaucaucgugaucuucaugguggccugggccaaggaggcgguggacaacuuccaccugggcgacgacauggaccccgagcuccggucccuggcccagauccugaucgaccagaaggucaaggagaucagcaaccaggugcccaugaagcucuga

SEQ ID NO: 6571 - RNA, 1290 nt, Artificial Sequence
  derived and/or modified CDS sequence (opt1) from SEOV(Gongzhuling415)__KF745949.1__N
auggccaccauggaggagauccagcgcgagaucagcgcccacgagggccagcuggugaucgcgcggcagauggucaaggacgccgagaagcaguacgagaaggaccucgccgaccugaacaagcgcgcccugcacgaccgggaguccguggccgcgagcauccaguccaagaucgacgagcucaagcgccagcuggccgaccggaucgccgccgggaagaacaucgagcaggaccgcgaccccaccggcguggagccgggggaccaccugaaggagcggagcgcgcucuccuacggcaacacgcuggaccugaacagccucgacaucgacgagcccaccgggcagaccgccgacuggcugaccaucaucgucuaccugacguccuucguggugcccaucauccucaaggcccuguacauccugaccacccgcggccggcagaccagcaaggacaacaagggcaugacgauccgcuucaaggacgacuccagcuacgaggacgucaacgggauccggaugcccaagcaccucuacgugccgaugcccaacgcccaguccagcaugaaggccgaggacaucacccccggccgcuuccggaccgcggugugcgggcuguaccccgcccagaucaaggcccgcaacauggucuccccgcugaugagcguggugggcuuccucgcccugcccaaggacuggaccucccggaucgacgaguggcugggggcccccugcaaguucauggcggagagccccaucgccggcucccucagcggcaacccggucaaccgcgaccacauccggcagcgccagggggcccuggccggcauggaccccaaggaguuccaggccgugcggcagcacgcgaaggacgccgggugcacgcugguggagcacaucgagucccccagcagcaucugggucuucgccggcgcccccgaccgcugccucccgaccugccuguucgugggcgggauggccgagcugggcgcguucuucaccauccuccaggacaugcggaacaccaucauggccuccaagacgguggggaccgccgacgagaagcugggcaagaaguccagcuucuaccagagcuaccugcgccgcacccaguccauggggauccagcucgaccagcggaucaucgucauguucaugguggccugggcgaaggaggccguggacaacauccaccugggcgacgacauggaccccgagcugcgcagccucgcccagauccugaucgaccagaaggucaaggagaucuccaaccaggugcccaugaagcuguga

SEQ ID NO: 6572 - RNA, 1290 nt, Artificial Sequence
  derived and/or modified CDS sequence (opt1) from SEOV(Gongzhuling42)__KF745942.1__N
auggccaccauggaggagauccagcgcgagaucagcgcccacgagggccagcuggugaucgcgcggcagaaggucaaggacgcccagaagcaguacgagaaggaccccgacgaccucaacaagcgcgcccugcacgaccgggaguccguggccgccagcauccagcugaagaucgacgagcucaagcgccagcuggcggaccggaucgccgccgggaagaacaucggccaggaccgcgaccccaccgggguggagcccggcgaccaccugaaggagcgguccgcccucagcuacgggaacacgcuggaccugaacucccucgacaucgacgagcccaccggccagaccgcggacuggcugaccaucaucgucuaccugacgagcuucguggugcccaucauccucaaggcccuguacaugcugaccacccgcggccggcagaccuccaaggacaacaaggggaugcgcauccgguucaaggacgacagcuccuacgaggacgucaagggcauccgcaagccgaagcaccucuacgugcccaugcccaacgcccagagcuccaugaaggccgaggagaucacgcccgggcggugccgcaccgccgugugcggccuguacccggcgcagaucaaggcccggaacauggucagccccgugauguccgccguggggauccuggcccucgccaaggacuggaccagccgcaucgaggaguggcugggcacccccugcaaguucauggcggagucccccaucgccggcagccuguccgggaacccggucaaccgggaccacauccgccagcggcagggcgcccucgccgggauggagcccaaggaguuccagggccugcgccagcacgccaaggacgcgggcugcacgcugguggagcacaucgagagccccuccagcaucuggguguucgccggggcccccgaccggugcccgccgaccugccucuucgucggcgggauggccgagcugggcgccuucuucgcgauccugcaggacaugcgcaacaccaucauggccagcaagaccguggggacggccgacgagaagcuccgcaagaaguccagcuucuaccaguccuaccugcggcgcacccagagcaugggcauccagcuggaccagcggaucaucgugauguucauggucgccugggcgaaggaggccguggacaacuuccaccucggcgacgacauggaccccgagcugcgcucccuggcccagauccucauggaccagaaggugaaggagaucagcaaccaggagcccaugaagcuguga

SEQ ID NO: 6573 - RNA, 1290 nt, Artificial Sequence
  derived and/or modified CDS sequence (opt1) from SEOV(Gongzhuling45)__KF745943.1__N
auggccaccauggaggagauccagcgcgagaucagcgcccacgagggccagcuggugaucgcgcggcagauggucaaggacgccgagaagcaguacgagaaggaccccgccgaccucaacaagcgcgcccugcacgaccgggaguccguggccgcgagcauccaguccaagaucgacgagcugaagcgccagcucgccgaccggaucgccgccgggaagaacaucggccaggaccgcgacccgaccgggguggagcccggcgaccaccugaaggagcggagcgcgcuguccuaccgcaacacgcucgaccugaacagccuggacaucgacgagcccaccgggcagaccgccgacuggcucaccaucaucgucuaccugacguccuucguggugcccaucauccugaaggcccucuacauccugaccacccggggccgccagaccagcaaggacaacaagggcaugcggauccgcuucaaggacgacuccagcuacgaggacgucaacgggauccggaugccgaagcaccuguaccuccccaugcccaacgcccaguccagcaugaaggccgaggacaucacgcccggccgcuuccggaccgcggugugcgggcuguacccggcccagaucaaggcccgcaacauggugagcccccugaugagcgucgugggcuuccucgcccugcccaaggacuggaccucccggaucgacgaguggcugggggcccccugcaaguucauggcggagagcccgaucgccggcucccucagcggcaaccccgugaaccgcgaccacauccggcagcgccagggggcccuggccggcauggaccccaaggaguuccaggccguccggcagcacgcgaaggacgccgggugcacccugguggagcacaucgagucccccagcagcaucuggguguucgccggcgccccggaccgcugcccgcccacgugccucuucgucggcgggauggccgagcugggcgcguucuucaccauccugcaggacaugcgcaacaccaucauggccuccaagaccguggggacggccgacgagaagcuccggaagaaguccuccuucuaccagagcuaccugcgccggacccaguccaugggcauccagcuggaccagcgcaucaucgugauguucauggucgccugggcgaaggaggccguggacaacuuccaccucggggacgacauggaccccgagcugcggagccuggcccagauccucaucgaccacaaggugaaggagaucuccaaccagguccccaugaagcuguga

SEQ ID NO: 6574 - RNA, 1290 nt, Artificial Sequence
  derived and/or modified CDS sequence (opt1) from SEOV(Gongzhuling58)__KF745944.1__N
auggccaccauggaggagauccagcgcgagaucagcgcccacgagggccagcuggugaucgcgcggcagauggucaaggacgccgagaagcaguacgagaaggaccccgccgaccucaacaagcgcgcccugcacgaccgggaguccguggccgcgagcauccaguccaagaucgacgagcugaagcgccagcucgccgaccggaucgccgccgggaagaacaucggccaggaccgcgacccgaccgggguggagcccggcgaccaccugaaggagcggagcgcgcuguccuacgggaacacgcucgaccugaacagccuggacaucgacgagcccaccggccagaccgccgacuggcucaccaucaucgucuaccugacguccuucguggugcccaucauccugaaggcccucuacauccugaccacccgcggccggcagaccagcaaggacaacaaggggaugcgcauccgguucaaggacgacuccagcuacgaggacgucaacggcauccgcaugccgaagcaccuguacgugcccaugcccaacgcccaguccagcaugaaggccgaggacaucacgcccgggcgguuccgcaccgcggugugcggccucuacccggcccagaucaaggcccggaacauggucagcccccugaugagcguggugggguuccuggcccuccccaaggacuggaccucccgcaucgacgaguggcugggcgcccccugcaaguucauggcggagagcccgaucgccggcucccugagcgggaaccccgucaaccgggaccacauccgccagcggcagggcgcccucgccgggauggaccccaaggaguuccaggccgugcgccagcacgcgaaggacgccggcugcacccugguggagcacaucgagucccccagcagcaucugggucuucgccggcgccccggaccggugcccgcccacgugccuguucgucgggggcauggccgagcucggggcguucuucaccauccugcaggacaugcgcaacaccaucauggccuccaagaccgugggcacggccgacgagaagcugcgcaagaaguccuccuucuaccagagcuaccuccggcgcacccaguccauggggauccagcuggaccagcggaucaucgugauguucaugguggccugggcgaaggaggccguggacaacuuccaccugggcgacgacauggaccccgagcuccgcagccuggcccagauccugaucgaccagaaggucaaggagaucuccaaccaggugcccaugaagcucuga

SEQ ID NO: 6575 - RNA, 1290 nt, Artificial Sequence
  derived and/or modified CDS sequence (opt1) from SEOV(Gongzhuling85)__KF745945.1__N
auggccaccauggaggagauccagcgcgagaucagcgcccacgagggccagcuggugaucgcgcggcagauggucaaggacgccgagaagcaguacgagaaggaccccgccgaccucaucaagcgcgcccugcacgaccgggaguccguggccgcgagcauccaguccaagaucgacgagcugaagcgccagcucgccgaccggaucgccgccgggaagaacaucggccaggaccgcgacccgaccgggcuggagcccggcgaccaccugaaggagcggagcgcgcucuccuacgggaacacgcuggaccugaacagccucgacaucgacgagcccaccggccagaccgccgacuggcugaccgugaucgucuaccugacguccuucguggugcccaucauccucaaggcccuguacauccugaccacccgcggccggcagaccagcaaggacaacaaggggaugcgcauccgguucaaggacgucuccagcuacgaggacgugaacggcauccgcaugccgaagcaccucuacgugcccaugcccaacgcccaguccagcaugaaggccgaggacaucacgcccgggcgguuccgcaccgcggucugcggccuguacccggcccagaucaaggcccggaacauggugagcccccugaugagcguggucggguuccucgcccugcccaaggacuggaccucccgcaucgacgaguggcugggcgcccccugcaaguucauggcggagagcccgaucgccggcucccucagcgggaaccccgugaaccgggaccacauccgccagcggcagggcgcccuggccgggauggaccccaaggaguuccaggccgugcgccagcacgcgaaggacgccggcugcacccuggucgagcacaucgagucccccagcagcaucuggguguucgccggcgccccggaccggugcccgcccacgugccucuucgugcgcgggauggccgagcugggcgcguucuucaccauccugcaggacaugcgcaacaccaucauggccuccaagaccgucgggacggccgacgagaagcuccggaagaaguccuccuucuaccagagcuaccugcgccggacccaguccaugggcauccagcuggaccagcgcaucaucgugauguucaugguggccugggcgaaggaggccgucgacaacuuccaccucggggacgacaugcaccccgagcugcggagccuggcccagauccucaucgaccagaaggugaaggagaucuccaaccaggugcccaugaagcuguga

SEQ ID NO: 6576 - RNA, 1290 nt, Artificial Sequence
  derived and/or modified CDS sequence (opt1) from SEOV(Gongzhuling97)__KF745946.1__N
auggccaccauggaggagauccagcgcgagaucagcgcccacgagggccagcuggugaucgcgcggcagauggucaaggacgccgagaagcaguacgagaaggaccccgccgaccucaacaagcgcgcccugcacgaccgggaguccguggccgcgagcauccaguccaagaucgacgaccugaagcgccagcucgccgaccggaucgccgccgggaagaacaucggccaggaccgcgacccgaccgggguggagcccggcgaccaccugaaggagcggagcgcgcuguccuacgggaacacgcucgaccugaacagccuggacaucgacgagcccaccggccagaccgccgacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaugccgaagcaccuguacgugcggaugcccaacgcccaguccagcaugaaggccgaggacaucacgcccgggcgcuuccggaccgcggugugcggccucuaccccgcccagaucaaggcccgcaacauggucuccccgcugaugagcguggugggguuccuggcccuccccaaggacuggaccucccggaucgacgaguggcugggcgcccccugcaaguucauggcggagagccccaucgccggcucccugagcgggaacccggucaaccgcgaccacauccggcagcgccagggcgcccucgccgggauggaccccaaggaguuccaggccgugcggcagcacgcgaaggacgccggcugcacccugguggagcacaucgagucccccagcagcaucugggucuucgccggcgcccccgaccgcugcccgcccacgugccuguucgucgggggcauggccgagcucggggcguucuucaccauccugcaggacaugcgcaucaccaucauggccuccaagaccgugggcacggccgacgagaagcugcggaagaaguccagcuucuaccagagcuaccuccgccggacccaguccauggggauccagcuggaccagcgccugaucgugauguucaugguggccugggcgaaggaggccguggacaacuuccaccucggcgacgacauggaccccgagcugcggagccuggcccagauccucaucgaccagaaggucaagcagaucuccaaccaggugcccaugaagcuguga

SEQ ID NO: 6577 - RNA, 1290 nt, Artificial Sequence
  derived and/or modified CDS sequence (opt1) from SEOV(Gou3)__AB027522.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgaccccaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggagcuuccggaccgccgugugcggccucuaccccgcgaccaucaaggcccgcaacauggucuccccggugaugagcguggucggguuccuggcccuggccaaggacuggaccucccggaucgaggacuggcucggcgcccccugcaaguucauggcggagagccccaucgccggcucccugagcgggaaccccgugaaccgcgacuacauccggcagcgccagggcgcccuggccgggauggagccgaaggaguuccaggcccuccggcagcacagcaaggacgcgggcugcacgaugguggagcagaucgagucccccagcuccaucugggucuucgccggcgcccccgaccgcugcccgccgaccugccuguucgucgggggcauggccgagcugggggccuucuucagcauccuccaggacaugcggaacaccaucauggcguccaagaccgugggcacggccgacgagaagcugcgcaagaaguccagcuucuaccagagcuaccugcgccggacccaguccauggggauccagcucgaccagcgcaucaucgugauguucaugguggccuggggcaaggaggccguggacaacuuccaccugggcgacgacauggaccccgagcugcggagccucgcgcagauccugaucgaccagaaggucaaggagaucuccaaccaggagcccaugaagcuguga

SEQ ID NO: 6578 - RNA, 1290 nt, Artificial Sequence
  derived and/or modified CDS sequence (opt1) from SEOV(Hb8610)__AF288643.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccggcaagagcaucgggcaggaccgcgacccgaccgggguggagcccggcgaccaccugaaggagcgguccgcccugagcuacgggaacacgcucgaccugaacucccuggacaucgacgagcccaccggccagaccgcggacuggcucaccaucaucgucuaccugacgagcuucguggugcccaucauccugaaggcccucuacaugcugaccacccgcggccggcagaccuccaaggacaacaaggggaugcgcauccgguucaaggacgacagcuccuacgaggacgucaacggcauccgcaagccgaagcaccuguacgugagcaugcccaacgcccaguccagcaugaaggccgaggagaucacgcccgggcgguuccgcaccgccgugugcggccucuaccccgcgcagaucaaggcccggaacauggucuccccggugaugagcguggucggguuccuggcccuggccaaggacuggaccucccgcaucgaggaguggcucggcgcccccugcaaguucauggcggagagccccaucgccggcucccugagcgggaaccccgugaaccgggacuacauccgccagcggcagggcgcccuggccgggauggagccgaaggaguuccaggcccuccgccagcacgcgaaggacgccggcugcacccugguggagcacaucgagagccccuccagcaucugggucuucgccggcgcccccgaccggugcccgcccacgugccuguucgucgggggcauggccgagcucggggcguucuucuccauccugcaggacaugcgcaacaccaucauggccagcaagaccgugggcaccgccgacgagaagcugcgcaagaaguccagcuucuaccaguccuaccuccggcgcacgcagagcauggggauccagcuggaccagcggaucaucgugauguucaugguggccuggggcaagaaggcgguggacaacuuccaccugggcgacgacauggaccccgagcuccgcucccuggcccagauccugaucgaccagaaggucaaggagaucagcaaccaggagcccaugaagcucuga

SEQ ID NO: 6579 - RNA, 1290 nt, Artificial Sequence
  derived and/or modified CDS sequence (opt1) from SEOV(HuBJ16)__GQ279380.1__N
auggccaccauggaggagauccagcgcgagaucagcgcccacgagggccagcuggugaucgcgcggcagaaggucaagaacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgaccccaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggacccccgugaaccgggacuacauccgccagcggcagggcgcccuggccgggauggagccgaaggaguuccaggcccuccgccagcacgcgaaggacgccggcugcacgcugguggagcacaucgagagccccagcuccaucugggucuucgccggcgcccccgaccggugcccgccgaccugccuguucgucgggggcauggccgagcucggggcguucuucagcauccugcaggacaugcgcaacaccaucauggccuccaagaccgugggcacggccgacgagaagcugcgcaagaaguccagcuucuaccagagcuaccuccggcgcacccaguccauggggauccagcuggaccagcggaucaucgugauguucaugguggccuggggcaaggaggcgguggacaacuuccaccugggcgacgacauggaccccgagcuccgcagccuggcccagauccugaucgaccagaaggucaaggagaucuccaaccaggagcccaugaagcucuga

SEQ ID NO: 6580 - RNA, 1290 nt, Artificial Sequence
  derived and/or modified CDS sequence (opt1) from SEOV(HuBJ22)__GQ279379.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgaccccaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggacccccgugaaccgggacuacauccgccagcggcagggcgcccuggccgggauggagccgaaggaguuccaggcccuccgccagcacgcgaaggacgccggcugcacgcugguggagcacaucgagagccccagcuccaucugggucuucgccggcgcccccgaccggugcccgccgaccugccuguucgucgggggcauggccgagcucggggcguucuucagcauccugcaggacaugcgcaacaccaucauggccuccaagaccgugggcacggccgacgagaagcugcgcaagaaguccagcuucuaccagagcuaccuccggcgcacccaguccauggggauccagcuggaccagcggaucaucgugauguucaugguggccuggggcaaggaggcgguggacaacuuccaccugggcgacgacauggaccccgagcuccgcagccuggcccagauccugaucgaccagaaggucaaggagaucuccaaccaggagcccaugaagcucuga

SEQ ID NO: 6581 - RNA, 1290 nt, Artificial Sequence
  derived and/or modified CDS sequence (opt1) from SEOV(HuBJ3)__GQ279391.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggucaacaaggggaugcgcauccgguucaaggacgacuccagcuacgaggacgugaacggcauccgcaagccgaagcaccuguacguguccaugcccaacgcccagagcuccaugaaggccgaggagaucacgcccgggcgguuccgcaccgccgucugcggccucuaccccgcgcagaucaaggcccggaacauggugagcccggugauguccgucgugggguuccuggcccuggccaaggacuggaccagccgcaucgaggaguggcucggcgcccccugccgguucauggcggagucccccaucgccggcagccuguccgggaaccccgugaaccgcgacuacauccggcagcgccagggcgcccuggccgggauggagccgaaggaguuccaggcccuccggcagcacgcgaaggacgccggcugcacccuggucgagcacaucgagagccccagcuccaucuggguguucgccggcgcccccgaggggugcccgcccacgugccuguucgugggcgggauggccgagcucggcgcguucuucagcauccugcaggacaugcgcaacaccaucauggccuccaagaccgucgggaccgccgacgagaagcugcgcaagaaguccagcuucuaccagagcuaccuccggcgcacgcaguccaugggcauccagcuggaccagcggaucaucgugauguucaugguggccuggggcaaggaggcggucgacaacuuccaccugggggacgacauggaccccgagcuccgcagccuggcccagauccugaucgaccagaaggugaaggagaucuccaaccaggagcccaugaagcucuga

SEQ ID NO: 6582 - RNA, 1290 nt, Artificial Sequence
  derived and/or modified CDS sequence (opt1) from SEOV(K24-e7)__AF288653.1__N
auggccaccauggaggagauccagcgcgagaucagcgcccacgagggccagcuggugaucgcgcggcagaaggucaaggacgccgagaagcaguacgagaaggaccccgacgacuucaacaagcgcgcccuccacgaccgggaguccguggccgccagcauccaguccaagaucgacgagcugaagcgccagcuggcggaccggaucgccgccgggaagaacaucggccaggaccgcgacccgaccgggguggagcccggcgaccaccucaaggagcggagcgcccuguccuacgggaacacgcuggaccucaacagccuggacaucgacgagcccaccggccagaccgcggacuggcugaccaucaucgucuaccucacguccuucguggugcccaucauccugaaggcccuguacaugcucaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccuguaccccgcgcagaucaaggcccggaacauggucagcccggugauguccguggucggguuccucgcccuggccaaggacuggaccagccgcaucgaggaguggcugggcgcccccugcaaguucauggcggagucccccaucgccggcagccucuccgggaaccccgugaaccgggacuacauccgccagcggcagggcgcccuggccgggauggagccgaaggaguuccaggcccugcgccagcacgcgaaggacgccggcugcacccucguggagcacaucgagagccccagcuccaucugggucuucgccggcgcccccgaccggugcccgcccacgugccuguucgucgggggcauggccgagcugggggcguucuucagcauccuccaggacaugcgcaacaccaucauggccuccaagaccgugggcaccgccgacgagaagcugcgcaagaaguccagcuucuaccagagcuaccugcggcgcacgcaguccauggggauccagcucgaccagcggaucaucgugauguucaugguggccuggggcaaggaggcgguggacaacuuccaccugggcgacgacauggaccccgagcugcgcagccucgcccagauccugaucgaccagaaggucaaggagaucuccaaccaggagcccaugaagcuguga

SEQ ID NO: 6583 - RNA, 1290 nt, Artificial Sequence
  derived and/or modified CDS sequence (opt1) from SEOV(K24-v2)__AF288655.1__N
auggccaccauggaggagauccagcgcgagaucagcgcccacgagggccagcuggugaucgcgcggcagaaggucaaggacgccgagaagcaguacgagaaggaccccgacgacuucaacaagcgcgcccuccacgaccgggaguccguggccgccagcauccaguccaagaucgacgagcugaagcgccagcuggcggaccggaucgccgccgggaagaacaucggccaggaccgcgacccgaccgggguggagcccggcgaccaccucaaggagcggagcgcccuguccuacgggaacacgcuggaccucaacagccuggacaucgacgagcccaccggccagaccgcggacuggcugaccaucaucgucuaccucacguccuucguggugcccaucauccugaaggcccuguacaugcucaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccuguaccccgcgcagaucaaggcccggaacauggucagcccggugauguccguggucggguuccucgcccuggccaaggacuggaccagccgcaucgaggaguggcugggcgcccccugcaaguucauggcggagucccccaucgccggcagccucuccgggaaccccgugaaccgggacuacauccgccagcggcagggcgcccuggccgggauggagccgaaggaguuccaggcccugcgccagcacgcgaaggacgccggcugcacccucguggagcacaucgagagccccagcuccaucugggucuucgccggcgcccccgaccggugcccgcccacgugccuguucgucgggggcauggccgagcugggggcguucuucagcauccuccaggacaugcgcaacaccaucauggccuccaagaccgugggcaccgccgacgagaagcugcgcaagaaguccagcuucuaccagagcuaccugcggcacacgcaguccauggggauccagcucgaccagcgcaucaucgugauguucaugguggccuggggcaaggaggcgguggacaacuuccaccugggcgacgacauggaccccgagcugcggagccucgcccagauccugaucgaccagaaggucaaggagaucuccaaccaggagcccaugaagcuguga

SEQ ID NO: 6584 - RNA, 1290 nt, Artificial Sequence
  derived and/or modified CDS sequence (opt1) from SEOV(OuhaiRf35)__FJ803208.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggaaccccgugaaccgggacuacauccgccagcggcagggcgcccuggccgggauggagccgaaggaguuccaggcccuccgccagcacgcgaaggacgccggcugcacccugguggagcacaucgagagccccagcuccaucugggucuucgccggcgcccgggaccgcugcccgcccacgugccuguucgucgggggcauggccgagcucggggcguucuucagcauccugcaggacaugcgcaacaccaucauggccuccaagaccgugggcaccgccgacgagaagcugcggaagaaguccagcuucuaccagagcuaccuccgccggacgcaguccauggggauccagcuggaccagcgcaucaucgugauguucaugguggccuggggcaaggaggcgguggacaacuuccaccugggcgacgacauggaccccgagcuccggagccuggcccagauccugaucgaccagaaggucaaggagaucuccaaccaggagcccaugaagcucuga

SEQ ID NO: 6585 - RNA, 1290 nt, Artificial Sequence
  derived and/or modified CDS sequence (opt1) from SEOV(OuhaiRn146)__FJ803210.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggaaccccgugaaccgggacuacauccgccagggccagggggcccuggccggcauggagccgaaggaguuccaggcccuccggcagcacgcgaaggacgccggcugcacccugguggagcacaucgagagccccagcuccaucugggucuucgccggggcccgcgaccggugcccgcccacgugccuguucgugggcgggauggccgagcucggcgcguucuucagcauccugcaggacaugcgcaacaccaucauggccuccaagaccguggggaccgccgacgagaagcugcgcaagaaguccagcuucuaccagagcuaccuccggcgcacgcaguccaugggcauccagcuggaccagcggaucaucgucauguucaugguggccuggggcaaggaggcgguggacaacuuccaccugggggacgacauggaccccgagcuccgcagccuggcccagauccugaucgaccagaaggucaaggagaucuccaaccaggagcccaugaagcucuga

SEQ ID NO: 6586 - RNA, 1290 nt, Artificial Sequence
  derived and/or modified CDS sequence (opt1) from SEOV(Pf26)__AY006465.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcgugcaguccaagaucgacgagcugaagcgccagcucgcggaccggaucgccgccgggaagaacaucggccaggaccgcgacccgaccggggucgagcccggcgaccaccugaaggagcggagcgcccuguccuacgggaacacgcucgaccugaacagccuggacaucgacgagcccaccggccagaccgcggacuggcucaccaucaucguguaccugacguccuucgugguccccaucauccugaaggcccucuacaugcugaccacccgcggccggcagaccagcaaggacaacaaggggaugcgcauccgguucaaggacgacuccagcuacgaggacgugaacggcauccgcaagccgaagcaccuguacguguccaugcccaacgcccagagcuccaugaaggccgaggagaucacgcccgggcgguuccgcaccgccgucugcggccucuaccccgcgcagaucaagccgcggaacauggugagccccgugaucuccgucgugggguuccuggcccuggccaaggacuggaccagccgcaucgaggaguggcucggcgcccccugcaaguucauggccgagucccccaucgcgggcagccuguccgggaacccggugaaccgggacuacauccgccagcggcagggcgcccuggccgggauggagcccaaggaguuccaggcccuccgccagcacgccaaggacgcgggcugcacccuggucgagcacaucgagagccccagcuccaucuggguguucgccggcgcccccgaccggugcccgcccacgugccuguucgucgggggcauggccgagcucggggccuucuucagcauccugcaggacaugcgcaacaccaucauggcguccaagaccgugggcaccgccgacgagaagcugcgcaagaaguccagcuucuaccagagcuaccuccggcgcacgcaguccauggggauccagcuggaccagcggaucaucgugauguucaugguggccuggggcaaggaggccgucgacaacuuccaccugggcgacgacauggaccccgagcuccgcagccuggcgcagauccugaucgaccagaaggugaaggagaucuccaaccaggagcccaugaagcucuga

SEQ ID NO: 6587 - RNA, 1290 nt, Artificial Sequence
  derived and/or modified CDS sequence (opt1) from SEOV(Rn-CP7)__GQ279382.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggagcauggucuccccggugaugagcguggucggguuccuggcccuggccaaggacuggaccucccgcaucgaggaguggcucggcgcccccugcaaguucauggcggagagccccaucgccggcucccugagcgggaaccccgugaaccgggacuacauccgccagcggcagggcgcccuggccgggauggagccgaaggaguuccaggcccuccgccagcacgcgaaggacgccggcugcacccugguggagcacaucgagagccccuccagcaucugggucuucgccggcgcccccgaccggugcccgcccacgugccuguucgucgggggcauggccgagcucggggcguucuucuccauccugcaggacaugcgcaacaccaucauggccagcaagaccgugggcaccgccgacgagaagcugcgcaagaaguccagcuucuaccaguccuaccuccggcgcacgcagagcauggggauccagcuggaccagcggaucaucgugauguucaugguggccuggggcaaggaggcgguggacaacuuccaccugggcgacgacauggaccccgagcuccgcucccuggcccagauccugaucgaccagaaggucaaggagaucagcaaccaggagcccaugaagcucuga

SEQ ID NO: 6588 - RNA, 1290 nt, Artificial Sequence
  derived and/or modified CDS sequence (opt1) from SEOV(Rn-DC8)__GQ279386.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgaccccaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccgcccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacccccgggcgguuccgcacggcggugugcggccucuaccccgcccagaucaaggcccggagcauggucuccccggugaugagcguggucggguuccuggcccuggccaaggacuggaccucccgcaucgaggaguggcucggcgcgcccugcaaguucauggccgagagccccaucgccggcucccugagcgggaaccccgugaaccgggacuacauccgccagcggcagggcgcccuggccgggauggagccgaaggaguuccaggcgcuccgccagcacgccaaggacgccggcugcacccugguggagcacaucgagagccccuccagcaucugggucuucgccggcgcccccgaccggugcccgccgaccugccuguucgucgggggcauggcggagcucggggccuucuucuccauccugcaggacaugcgcaacacgaucauggccagcaagaccgugggcaccgccgacgagaagcugcgcaagaaguccagcuucuaccaguccuaccuccggcgcacccagagcauggggauccagcuggaccagcggaucaucgugauguucaugguggcguggggcaaggaggccguggacaacuuccaccugggcgacgacauggaccccgagcuccgcucccuggcccagauccugaucgaccagaaggucaaggagaucagcaaccaggagcccaugaagcucuga

SEQ ID NO: 6589 - RNA, 1290 nt, Artificial Sequence
  derived and/or modified CDS sequence (opt1) from SEOV(Rn-M11)__GQ279383.1__N
auggccaccauggaggagauccagcgcgagaucagcgcccacgagggccagcuggugaucgcgcggcagaaggucaagaacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggagcauggucuccccggugaugagcguggucggguuccuggcccuggccaaggacuggaccucccgcaucgaggaguggcucggcgcccccugcaaguucauggcggagagccccaucgccggcucccugagcgggaaccccgugaaccgggacuacauccgccagcggcgcggcgcccuggccgggauggagccgaaggaguuccaggcccuccggcagcacgcgaaggacgccggcugcacccugguggagcacaucgagagccccuccagcaucugggucuucgccggcgcccccgaccgcugcccgcccacgugccuguucgucgggggcauggccgagcucggggcguucuucuccauccugcaggacaugcgcaacaccaucauggccagcaagaccgugggcaccgccgacgagaagcugcggaagaaguccagcuucuaccaguccuaccuccgccggacgcagagcauggggauccagcuggaccagcgcaucaucgugauguucaugguggccuggggcaaggaggcgguggacaacuuccaccugggcgacgacauggaccccgagcuccggucccuggcccagauccugaucgaccagaaggucaaggagaucagcaaccaggagcccaugaagcucuga

SEQ ID NO: 6590 - RNA, 1290 nt, Artificial Sequence
  derived and/or modified CDS sequence (opt1) from SEOV(RuianRf74)__FJ803213.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgaccccaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcauggccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggaaccccgugaaccgggacuacauccgccagcggcagggcgcccuggccgggauggagccgaaggaguuccaggcccuccgccagcacgcgaaggacgccggcugcacccugguggagcacaucgagagccccagcuccaucugggucuucgccggcgcccccgaccggugcccgccgaccugccuguucgucgggggcauggccgagcucggggcguucuucagcauccugcaggacaugcgcaacacgaucauggccuccaagaccgugggcaccgccgacgagaagcugcgcaagaaguccagcuucuaccagagcuaccuccggcgcacccaguccauggggauccagcuggaccagcggaucaucgugauguucaugguggccuggggcaaggaggcgguggacaacuuccaccugggcgacgacaucgaccccgagcuccgcagccuggcccagauccugaucgaccagaaggucaaggagaucuccaaccaggagcccaugaagcucuga

SEQ ID NO: 6591 - RNA, 1290 nt, Artificial Sequence
  derived and/or modified CDS sequence (opt1) from SEOV(RuianRn23)__FJ803214.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggaaccccgugaaccgggacuacauccgccagcggcagggcgcccuggccgggauggagccgaaggaguuccaggcccuccgccagcacgcgaaggacgccggcugcacccugguggagcacaucgagagccccagcuccaucugggucuucgccggcgcccccgaccggugcccgcccacgugccuguucgucgggggcauggccgagcucggggcguucuucagcauccugcaggacaugcgcaacaccaucaaggccuccaagaccgugggcaccgccgacgagaagcugcgcaagaaguccagcuucuaccagagcuaccuccggcgcacgcaguccauggggauccagcuggaccagcggaucaucgugauguucaugguggccuggggcaaggaggcgguggacaacuuccaccugggcgacgacauggaccccgagcuccgcagccuggcccagauccugaucgaccagaaggucaaggagaucuccaaccaggagcccaugaagcucuga

SEQ ID NO: 6592 - RNA, 1290 nt, Artificial Sequence
  derived and/or modified CDS sequence (opt1) from SEOV(RuianRn33)__FJ803215.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacccucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggaaccccgugaaccgggacuacauccgccagcggcagggcgcccuggccgggauggagccgaaggaguuccaggcccuccgccagcacgcgaaggacgccggcugcacccugguggagcacaucgagagccccagcuccaucugggucuucgccggcgcccccgaccggugcccgcccacgugccuguucgucgggggcauggccgagcucggggcguucuucagcauccugcaggacaugcgcaacaccaucauggccuccaagaccgugggcaccgccgacgagaagcugcgcaagaaguccagcuucuaccagagcuaccuccggcgcacgcaguccauggggauccagcuggaccagcggaucaucgugauguucaugguggcccgcggcaaggaggcgauguacaaccugcaccuccgggacgacaugacgccccagcugcugcuccuggugcagauccugcucgaccaccaggucaaggagaucagcaaccaggagcugaugaagcuguga

SEQ ID NO: 6593 - RNA, 1290 nt, Artificial Sequence
  derived and/or modified CDS sequence (opt1) from SEOV(SC106)__GU361893.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacgugcccaugcccaacgcccaguccagcaugaaggccgaggagaucacgcccgggcgguuccgcaccgccgugugcggccucuacccggcgcagaucaaggcccggaacauggucucccccgugaugagcguggucggguuccuggcccuggccaaggacuggaccucccgcaucgaggaguggcucggcgcccccugcaaguucauggcggagagccccaucgccggcucccugagcgggaacccggugaaccgggacuacauccgccagcggcagggcgcccuggccgggauggagcccaaggaguuccaggcccuccgccagcacgcgaaggacgccggcugcacccugguggagcacaucgagucccccagcagcaucugggucuucgccggcgcccccgaccggugcccgcccacgugccuguucgucgggggcauggccgagcucggggcguucuucuccauccugcaggacaugcgcaacaccaucauggccagcaagaccgugggcaccgccgacgagaagcugcgcaagaaguccagcuucuaccaguccuaccuccggcgcacgcagagcauggggauccagcuggaccagcggaucaucgugauguucaugguggccuggggcaaggaggcgguggacaacuuccaccugggcgacgacauggaccccgagcuccgcucccuggcccagauccugaucgaccagaaggucaaggagaucagcaaccaggagcccaugaagcucuga

SEQ ID NO: 6594 - RNA, 1290 nt, Artificial Sequence
  derived and/or modified CDS sequence (opt1) from SEOV(SEO/Belgium/Rn895/2005)__JQ898106.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggacucccccaucgccggcagccuguccgggaaccccgugaaccgggacuacauccgccagcggcagggcgcccuggccgggauggagccgaaggaguuccaggcccuccgccagcacagcaaggacgcgggcugcacccugguggagcacaucgagagccccuccagcaucugggucuucgccggcgcccccgaccggugcccgcccacgugccuguucgucgggggcauggccgagcucggggccuucuucuccauccugcaggacaugcgcaacaccaucauggcgagcaagaccgugggcaccgccgacgagaagcugcgcaagaaguccagcuucuaccaguccuaccuccggcgcacgcagagcauggggauccagcuggaccagcggaucaucgugauguucaugguggccuggggcaaggaggccguggacaacuuccaccugggcgacgacauggaccccgagcuccgcucccuggcgcagauccugaucgaccagaaggucaaggagaucagcaaccaggagcccaugaagcucuga

SEQ ID NO: 6595 - RNA, 1290 nt, Artificial Sequence
  derived and/or modified CDS sequence (opt1) from SEOV(Taonan420)__KF745951.1__N
auggccaccauggaggagauccagcgcgagaucagcgcccacgagggccagcuggugaucgcgcggcagaacgucaaggacgccgagaagcaguacgagaaggaccccgacgaccucaacaagcgcgcccugcacgaccgggaguccguggccgccagcauccaguccaagaucgacgagcugaagcgccagcccgcggaccggaucgccgccgggaagaacaucggccaggaccgcgaccccaccgggguggagcccggcgaccaccucaaggagcggagcgcccuguccuacgggaacacgcuggaccucaaccgccuggacaucgacgagcccaccggccagcgggcggacuggcugaccaucaucgucuaccucaccagcuucguggugcgcaucauccugaaggcccuguacauguucuccacgcggggccgccagaccagcaaggacaacaaggggcuccggauccgcuucaaggacgacuccagcuacgaggacuucaacggcauccggaagccgaagcaccuguacguccccaugcccaacgcccaguccagcaugaaggccgaggagaucacccccgggcgcuuccggaccgccgugugcggccuguacccggcgcagaucaaggcccgcaacauggugucccccgucaugagcguggugggguuccucgcccuggccaaggacuggacgucccggaucgaggaguggcugggcgcccccugcaaguucauggcggagagccccaucgccggcucccucagcgggaacccggucaaccgcgacuacauccggcagcgccagggcgcccuggccgccauggagcccaaggaguuccaggcgcugcgccagcacgccaaggaccccgggugcacccucguggagcacaucgagucccccagcagcaucuggguguccgccggcgccccggaccggugcccgccgaccugccuguucgucggcgggauggccgagcugggcgcguucuucagcaucuuccaggacaugcgcaacaccaucaugcccuccaagacgguggggaccgccgacgagaagcuccggaagaagucccuguucuaccagagcuaccugcgccggacccagagcaugggcauccagcucgaccagcgcaucaucgugauguucauggucgccugggggaaggaggccguggacaacuuccaccuccccgacgacauggaccccgagcugcggucccuggcgcagauccugaucgugcagaaggucaaggagaucagcaaccaggagcccaugaagcuguga

SEQ ID NO: 6596 - RNA, 1290 nt, Artificial Sequence
  derived and/or modified CDS sequence (opt1) from SEOV(Taonan52)__KF745950.1__N
auggccaccauggaggagauccagcgcgagaucagcgcccacgagggccagcuggugaccgcgcggcagaaggucaaggacgccgagaagcaguacgagaaggaccccgacgaccucaacaagcgcgcccugcacgaccgggaguccguggccgccagcauccaguccaagaucgacgaggugaagcgccagcuggcggaccggaucgccgccgggaagaacaucggccaggaccgcgacccgacgggggucgagcccggcgaccaccccaaggagcggagcgcccucuccuacgggaacacccuggaccugaacagccucgacaucgacgagcccaccggccagaccgcggacuggcugacgaucaucguguaccugaccuccuucguggucccgaucauccucaaggcccuguacaugagcaccacccgcggccggcagacguccaaggacaaccgcgggaugcggauccgcuuccaggacgacagcuccuacgaggacgugaacggcauccggaagcccaagcaccuguacgugcccaugcccaacgcccagagcuccaugaaggccgaggaggucaccccggggcgcuuccggaccgccgugugcggccucuaccccgcgcagaucaaggcccgcaacauggugcggcccgucaugagcguggugggguuccuggcccuggccaaggccuggaccucccgcaucgaggaguggcucggcgcgcccugcaaguucauggccgagagcccgaucgccggcucccugagcgggaaccccgucuaccgggacuacauccgccagcggcagggcgcccuggccgggauggagcccaaggaguuccaggcgcuccgccagcacgccaaggacgccggcugcacgcugguggagcugaucgagucccccagcagcaucuccguguucgccggcgccccggaccgcugcccccggaccugccucuucgucgggggcauggcggagcugggggccaacuucagcaugcugcaggacauguccaacaccaucauggccagcaagaccgugggcacggccgacgagaagcuccgcaagaaguccagcuucuaccaguccuaccugcggcgcacccagagcauggggauccagcuggaccagcggaucaucgugauguucauggucgcguccggcaaggaggccguggacuacuuccaccucggcgacgacauggaccccgagcugcgcagccuggcccccauccucaucgaccagaaggugaaggagaucuccaaccaggagccgaugaagcuguga

SEQ ID NO: 6597 - RNA, 1290 nt, Artificial Sequence
  derived and/or modified CDS sequence (opt1) from SEOV(WuhanMm24)__JQ665911.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccgccgccgcgagcauccaguccaagaucgacgagcugaagcgccagcucgccgaccggaucgccgccgggaagaacaucggccaggaccgcgacccgaccgggguggagcccggcgaccaccugaaggagcggagcgcgcuguccuacgggaacacgcucgaccugaacagccuggacaucgacgagcccaccggccagaccgccgacuggcucaccaucaucguguaccugacguccuucgucgugcccaucauccugaaggcccucuacaugcugaccacccgcggccggcagaccagcaaggacaacaaggggaugcgcauccgguucaaggacgacuccagcuacgaggacgugaacggcauccgcaagccgaagcaccuguacgucuccaugcccaacgcccagagcuccaugaaggccgaggagaucacgcccgggcgguuccgcaccgcggugugcggccucuaccccgcccagaucaaggcccggaacauggugagcccggucauguccguggugggguuccuggcccuggccaaggacuggaccagccgcaucgaggaguggcucggcgcgcccugcaaguucauggccgagucccccaucgccggcagccuguccgggaaccccgucaaccgggacuacauccgccagcggcagggcgcccuggccgggauggagccgaaggaguuccaggcgcuccgccagcacagcaaggacgccggcugcacccugguggagcacaucgagagccccuccagcaucuggguguucgccggcgcccccgaccggugcccgcccacgugccuguucgucgggggcauggccgggcucggcgcguucuucuccauccugcaggacaugcgcaacaccaucauggccagcaagaccguggggaccgccgacgagaagcugcgcaagaaguccagcuucuaccaguccuaccuccggcgcacgcagagcaugggcauccagcuggaccagcggaucaucgugauguucauggucgccuggggcaaggaggcgguggacaacuuccaccugggggacgacauggaccccgagcuccgcucccuggcccagauccugaucgaccagaaggugaaggagaucagcaaccaggagcccaugaagcucuga

SEQ ID NO: 6598 - RNA, 1290 nt, Artificial Sequence
  derived and/or modified CDS sequence (opt1) from SEOV(WuhanRf02)__JQ665912.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccuggaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccgggacauggucagcccggugauguccguggucggguuccuggcccuggccaaggacuggaccagccgcaucgaggaguggcucggcgcccccugcaaguucauggcggagucccccaucgccggcagccuguccgggaaccccgugaaccgggacuacauccgccagcggcagggcgcccuggccgggauggagccgaaggaguuccaggcccuccgccagcacagcaaggacgcgggcugcacccugguggagcacaucgagagccccuccagcaucugggucuucgccggcgcccgggaccgcugcccgcccacgugccuguucgucgggggcauggccgagcucggggccuucuucuccauccugcaggacaugcgcaacaccaucauggcgagcaagaccgugggcaccgccgacgagaagcugcggaagaaguccagcuucuaccaguccuaccuccgccggacgcagagcauggggauccagcuggaccagcgcaucaucgugauguucaugguggccuggggcaaggaggccguggacaacuuccaccugggcgacgacauggaccccgagcuccggucccuggcgcagauccugaucgaccagaaggucaaggagaucagcaaccaggagcccaugaagcucuga

SEQ ID NO: 6599 - RNA, 1290 nt, Artificial Sequence
  derived and/or modified CDS sequence (opt1) from SEOV(WuhanRf07)__JQ665913.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggaaccccgugaaccgggacuacauccgccagcggcagggcgcccuggccgggauggagccgaaggaguuccaggcccuccgccagcacagcaaggacgcgggcugcacccugguggagcacaucgagagccccuccagcaucugggucuucgccggcgcccgggaccgcugcccgcccacgugccuguucgucgggggcauggccgagcucggggccuucuucuccauccugcaggacaugcgcaacaccaucauggcgagcaagaccgugggcaccgccgacgagaagcugcggaagaaguccagcuucuaccaguccuaccuccgccggacgcagagcauggggauccagcuggaccagcgcaucaucgugauguucaugguggccuggggcaaggaggccguggacaacuuccaccugggcgacgacauggaccccgagcuccggucccuggcgcagauccugaucgaccagaaggucaaggagaucagcaaccaggagcccaugaagcucuga

SEQ ID NO: 6600 - RNA, 1290 nt, Artificial Sequence
  derived and/or modified CDS sequence (opt1) from SEOV(ZJ5)__FJ753400.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggaaccuggugaaccgggacuacauccgccagcggcagggcgcccucgccgggauggagcccaaggaguuccaggcccugcgccagcacagcaaggacgcgggcugcacccugguggagcacaucgagagcccguccagcaucugggucuucgccggcgcccccgaccggugcccgcccacgugccucuucgucgggggcauggccgagcugggggccuucuucuccauccugcaggacaugcgcaacaccaucauggcgagcaagaccgugggcaccgccgacgagaagcuccgcaagaaguccagcuucuaccaguccuaccugcggcgcacgcagagcauggggauccagcuggaccagcggaucaucgugauguucaucguggccuggggcaaggaggccguggacaacuuccaccucggcgacgaccuggaccccgagcugcgcucccucgcgcagauccugaucgaccagaaggucaaggagaucagcaaccaggagcccaugaagcuguga

SEQ ID NO: 6601 - RNA, 1290 nt, Artificial Sequence
  derived and/or modified CDS sequence (opt1) from SEOV(ZT10)__AY766368.1__N
auggcccugugcgaggagauccagcgcgagaucagcgcccacgagggccagcucgugaucgcgcggcagaaggucaaggacgccgagaagcaguacgagaaggaccccgacgacuucaacaagcgcgcccugcacgaccgggaguccguggccgccagcauccaguccaagaucgacgagcugaagcgccagcucgcggaccggaucgccgccgggaagaacaucggccaggaccgcgaccccaccgggguggagcccggcgaccaccugaaggagcggagcgcccuguccuacgggaacacccucgaccugaacagccuggacaucgacgagcccacgggccagaccgcggacuggcucaccaucaucgucuaccugaccuccuucguggugcccaucauccugaaggcccucuacaugcugacgacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacccccgggcgguuccgcacggccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggaaccccgugaaccgggacuacauccgccagcggcagggcgcccuggccgggauggagccgaaggaguuccaggcccuccgccagcacgcgaaggacgccggcugcacccugguggagcacaucgagagccccagcuccaucugggucuucgccggcgcccccgaccggugcccgccgaccugccuguucgucgggggcauggccgagcucggggcguucuucagcggccuggccgacaugcgcaacacgaucauggccuccaagaccgaggggaccgccgacgagaagcugcgcaagaaguccagcuucuaccagagcuaccuccggcgccagcaguccaugggcauccagcuggaccagcggaucaucgugauguucaugguggcguggggcaaggaggccguggacaacuuccaccugggggacgacauggaccccgagcuccgcagccuggcccagauccugaucgaccagaaggugaaggagaucuccaaccaggagcccaugaagcucuga

SEQ ID NO: 6602 - RNA, 1290 nt, Artificial Sequence
  derived and/or modified CDS sequence (opt1) from SEOV(ZT71)__AY750171.1__N
auggccaccauggaggagauccagcgcgagaucagcgcccacgagggccagcuggugaucgcgcggcagaaggucaaggacgccgagaagcaguacgagaaggaccccgacgacuucaacaagcgcgcccuccacgaccgggaguccguggccgccagcauccaguccaagaucgacgagcugaagcgccagcuggcggaccggaucgccgccgggaagaacaucggccaggaccgcgacccgaccgggguggagcccggcgaccaccucaaggagcggagcgcccuguccuacgggaacacgcuggaccucaacagccuggacaucgacgagcccaccggccagaccgcggacuggcugaccaucaucgucuaccucacguccuucguggugcccaucauccugaaggcccuguacaugcucaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccuguaccccgcgcagaucaaggcccggaacauggucagcccggugauguccguggucggguuccucgcccuggccaaggacuggaccagccgcaucgaggaguggcugggcgcccccugcaaguucauggcggagucccccaucgccggcagccucuccgggaaccccgugaaccgggacuacauccgccagcggcagggcgcccuggccgggauggagccgaaggaguuccaggcccugcgccagcacgcgaaggacgccggcugcacccucguggagcacaucgagagccccagcuccaucugggucuucgccggcgcccccgaccggugcccgcccacgugccuguucgucgggggcauggccgagcugggggcguucuucagcauccuccaggacaugcgcaacaccaucauggccuccaagaccgagggcaccgccgacgagaagcugcgcaagaaguccagcuucuaccagagcuaccugcggcgccagcaguccauggggauccagcucgaccagcggaucaucgugauguucaugguggccuggggcaaggaggcgguggacaacuuccaccugggcgacgacauggaccccgagcugcgcagccucgcccagauccugaucgaccagaaggugaaggagaucuccaaccaggagcccaugaagcuguga

SEQ ID NO: 6603 - RNA, 1290 nt, Artificial Sequence
  derived and/or modified CDS sequence (opt1) from SEOV(zy27)__AF406965.1__N
auggccaccauggaggagauccagcgcgagaucagcgcccacgagggccagcuggugaucgcgcggcagaaggucaaggacgccgagaagcaguacgagaaggaccccgacgacuccaacaagcgcgcccuccacgaccgggagagcguggccgccuccauccagagcaagaucgacgagcugaagcgccagcuggcggaccggaucgccgccgggaagaacaucggccaggaccgcgacccgaccgggguggagcccggcgaccaccucaaggagcgguccgcccccagcuacgggaacacgcuggaccugaacucccucgacaucgacgagcccaccggccagaccgcggacuggcugaccaucaucgucuaccugacgagcuucguggugccgaucauccucaaggcccuguacaugcugaccacccgcggccggcagaccuccaaggacaacaaggggaugcgcauccgguucaaggacgacagcuccuacgaggacgucaacggcauccgcaagcccaagcaccucuacgugagcaugcccaacgcccaguccagcaugaaggccgaggagaucacgcccgagcgguuccgcaccgccgugugcgggcuguacccggcgcagaucaaggcccggaacauggucucccccgugaugagcguggucggcuuccuggcccucgccaaggacuggaccucccgcaucgaggaguggcugggggcccccugcaaguucauggcggagagccccaucgccggcucccugagcggcaacccggugaaccgggaccacauccgccagcggcagggggcccucgccggcauggagcccaaggaguuccaggcccugcgccagcacgcgaaggacgccgggugcacccugguggagcacaucgagagccccuccagcaucugggucuucgccggcgcccccgaccggugcccgcccacgugccucuucgugggcgggauggccgagcugggcgcguucuucuccauccugcaggacaugcgcaacaccaucauggccagcaagaccguggggaccgccgacgagaagcuccgcaagaaguccagcuucuaccaguccuaccugcggcgcacgcagagcaugggcauccagcuggaccagcggaucaucgucauguucaugguggccugggggaaggaggcgguggacaacuuccaccucggcgacgacauggaccccgagcugcgcucccuggcccagauccucaucgaccagaaggucaaggagaucagcaaccaggagcccaugaagcuguga

SEQ ID NO: 6604 - RNA, 1290 nt, Artificial Sequence
  derived and/or modified CDS sequence (opt1) from SEOV(DN2)__KX289954.1__N
auggccaccauggaggagauccagcgcgagaucagcgcccacgagggccagcuggugaucgcgcggcagaaggccaaggacgccgagaagcaguacgagaaggaccccgacgaccucaacaagcgcgcccugcacgaccggggguccgucgccgcgagcauccaguccaagaucgacgagcugaagcgccagcucgccgaccggaucgccgccggcaagaacaucgggcaggaccgcgacccgaccggcguggagcccggggaccaccugaaggagcggagcgcgcuguccuacggcaacacgcucgaccugaacagccuggacaucgacgagcccaccggccagaccgccgacuggcucaccaucaucguguaccugacguccuucgucgugcccaucauccugaaggcccucuacaugcugaccacccgcgggcggcagaccagcaaggacaacaagggcaugcgcauccgguucaaggacgacuccagcuacgaggacgugaacgggauccgcaagccgaagcaccuguacgucuccaugcccaacgcccagagcuccaugaaggccgaggagaucacgcccggccgguuccgcaccgcggugugcgggcucuaccccgcccagaucaaggcccggaacauggugagcccggucauguccguggugggcuuccuggcccuggccaaggacuggaccagccgcaucgaggaguggcucggcgagcccugcaaguucauggcggagucccccaucgccgggagccuguccggcaaccccgucaaccgggacuacauccgccagcggcagggggcccuggccggcauggagccgaaggaguuccaggcccuccgccagcacagcaaggacgcgggcugcacccugguggagcacaucgagagccccuccagcaucuggguguucgccggggcccccgaccggugcccgcccacgugccuguucgucggcgggauggccgagcucggcguguucuucuccauccugcaggacaugcgcaacaccaucauggccagcaagaccguggggaccgcggacgagaagcugcgcaagaaguccagcuucuaccaguccuaccuccggcgcacgcagagcaugggcauccagcuggaccagcggaucaucgucauguucaugguggccuggggcaaggaggccguggacaacuuccaccugggggacgacauggaccccgagcuccgcucccuggcccagauccugaucgaccagaaggucaaggagaucagcaaccaggagcccaugaagcucuga

SEQ ID NO: 6605 - RNA, 1290 nt, Artificial Sequence
  derived and/or modified CDS sequence (opt1) from SEOV(IR162)__KX079476.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgaccccaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucgacacccccugcaaguucaugguggagucccccaucgccggcagccuguccggcaaccccgugaaccgggacuacauccgccagcggcagggggcgcuggccggcauggagccgaaggaguuccaggcccuccgccagcacagcaaggacgccgggugcacgcuggucgagcacaucgagagccccuccagcaucuggguguucgccggcgcgcccgaccggugcccgccgaccugccuguucgugggcgggauggccgagcucggcgccuucuucuccauccugcaggacaugcgcaacaccaucauggccagcaagaccgucgggacggccgacgagaagcugcgcaagaaguccagcuucuaccaguccuaccuccggcgcacccagagcaugggcauccagcuggaccagcggaucaucgugauguucaugguggcgugggggaaggaggccgucgacaacuuccaccugggcgacgacauggaccccgagcuccgcucccuggcccagauccugaucgaccagaaggugaaggagaucagcaaccaggagcccaugaagcucuga

SEQ ID NO: 6606 - RNA, 1290 nt, Artificial Sequence
  derived and/or modified CDS sequence (opt1) from SEOV(Gou3)__AF184988.1__N
auggccaccauggaggagauccagcgcgagaucagcgcccacgagggccagcuggugaucgcgcggcgcaaggucaaggacgccgagaagcaguacgagaaggaccccgacgaccucaacaagcgggcccugcacgaccgcgaguccguggccgccagcauccaguccaagaucgacgagcugaagcggcagcucgcggaccgcaucgccgccgggaagaacaucggccaggaccgggacccgaccgggguggagcccggcgaccaccugaaggagcgcagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccggggccgccagaccagcaaggacaacaaggggaugcggauccgcuucaaggacgacuccagcuacgaggacgucaacggcauccggaagccgaagcaccuguacguguccaugcccaacgcccagagcuccaugaaggccgaggagaucacgcccgggcgcuuccggaccgccgugugcggccucuaccccgcgcagaucaaggcccgcaacauggucagcccggugauguccguggucggguuccuggcccuggccaaggacuggaccagccggaucgaggacuggcucggcgcccccugcaaguucauggcggagucccccaucgccggcagccuguccgggaaccccgugaaccgcgacuacauccggcagcgccagggcgcccuggccgggauggagccgaaggaguuccaggcccuccggcagcacagcaaggacgcgggcugcacccugguggagcacaucgagagccccuccagcaucugggucuucgccggcgcccccgaccgcugcccgcccacgugccuguucgucgggggcauggccgagcucggggccuucuucuucauccugcaggacaugcgcaacaccaucauggcguccaagaccgugggcaccgccgacgagaagcugcggaagaaguccagcuucuaccagagcuaccuccgccggacgcaguccauggggauccagcuggaccagcgcaucaucgugauguucaugguggccuggggcaaggaggccguggacaacuuccaccugggcgacgacauggaccccgagcuccggagccuggcgcagauccugaucgaccagaaggucaaggagaucuccaaccaggagcccaugaagcucuga

SEQ ID NO: 6607 - RNA, 1290 nt, Artificial Sequence
  derived and/or modified CDS sequence (opt1) from SEOV(Gou3-v9)__AF288651.1__N
auggccaccaaggaggagauccagcgcgagaucagcgcccacgagggccagcuggugaucgcgcggcagaaggucaaggacgccgagaagcaguacgagaaggaccccgacgugcucaacaagcgcgcccugcacgaccgggaguccguggccgccagcauccaguccaagaucgacgagcugaagcgccagcucgcggaccggaucgccgccggcaagagcaucgggcaggaccgcgacccgaccggggucgagcccggcgaccaccugaaggagcgguccgcccugagcuacgggaacacgcucgaccugaacucccuggacaucgacgagcccaccggccagaccgcggacuggcucaccaucaucguguaccugacgagcuucgugguccccaucauccugaaggcccucuacaugcugaccacccgcggccggcagaccuccaaggacaaccgcgggaugcggauccgcuucaaggacgacagcuccuacgaggacgugaacggcauccggaagccgaagcaccuguacgugagcaugcccaacgcccaguccagcaugaaggccgaggagaucacgcccgggcgcuuccggaccgccgucugcggccucuaccccgcgcagaucaaggcccgcaacaugguguccccggugaugagcgucgugggguuccuggcccuggccaaggacuggaccucccggaucgaggacuggcucggcgcccccugcaaguucauggcggagagccccaucgccggcucccugagcgggaaccccgugaaccgcgacuacauccggcagcgccagggcgcccuggccgggauggagccgaaggaguuccaggcccuccggcagcacagcaaggacgcgggcugcacccuggucgagcacaucgagucccccagcuccaucuggguguucgccggcgcccccgaccgcugcccgcccacgugccuguucgucgggggcauggccgagcucggggccuucuucagcauccugcaggacaugcgcaacaccaucauggcguccaagaccgugggcaccgccgacgagaagcugcggaagaaguccagcuucuaccagagcuaccuccgccggacgcaguccauggggauccagcuggaccagcgcaucaucgugauguucaugguggccuggggcaaggaggccgucgacaacuuccaccugggcgacgacauggaccccgagcuccggagccuggcgcagauccugaucgaccagaaggugaaggagaucuccaaccaggagcccaugaagcucuga

SEQ ID NO: 6608 - RNA, 1290 nt, Artificial Sequence
  derived and/or modified CDS sequence (opt1) from SEOV(IR461)__AF329388.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgaccccaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggauccgcauccgguucaaggacgacuccagcuacgagaacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggccgggaacauggucagcccggugauguccguggucggcuuccuggcccuggccaaggacuggaccagccggaucgaggaguggcucgacacccccugcaaguucaugguggagucccccaucgccggcagccuguccgggaaccccgugaaccgcgacuacauccggcagcgccagggcgcgcuggccgggauggagccgaaggaguuccaggcccuccggcagcacagcaaggacgccggcugcacgcuggucgagcacaucgagagccccuccagcaucuggguguucgccggcgcgcccgaccgcugcccgccgaccugccuguucgucgggggcauggccgagcucggggccuucuucuccauccugcaggacaugcggaacaccaucauggccagcaagaccgugggcacggccgacgagaagcugcgcaagaaguccagcuucuaccaguccuaccuccgccggacccagagcauggggauccagcuggaccagcgcaucaucgugauguucaugguggcguggggcaaggaggccgucgacaacuuccaccugggcgacgacauggaccccgagcuccggucccuggcccagauccugaucgaccagaaggugaaggagaucagcaaccaggagcccaugaagcucuga

SEQ ID NO: 6609 - RNA, 1290 nt, Artificial Sequence
  derived and/or modified CDS sequence (opt1) from SEOV(JUN5-14)__DQ217791.1__N
auggccaccauggaggaguuccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggaaccccgugaaccgggacuacauccgccagcggcagggcgcccuggccgggauggagccgaaggaguuccaggcccuccgccagcacgcgaaggacgccggcugcacccugguggagcacaucgagagccccagcuccaucugggucuucgccggcgcccccgaccggugcccgcccacgugccuguucgucgggggcauggccgagcucggggcguucuucagcauccugcaggacaugcgcaacaccaucauggccuccaagaccgugggcaccgccgacgagaagcugcgcaagaaguccagcuucuaccagagcuaccuccggcgcacgcaguccauggggauccagcuggaccagcggaucaucgugauguucaugguggccuggggcaaggaggcgguggacaacuuccaccugggcgacgacauggaccccgagcuccgcagccuggcccagauccugaucgaccagaaggucaaggagaucuccaaccaggagcccaugaagcucuga

SEQ ID NO: 6610 - RNA, 1290 nt, Artificial Sequence
  derived and/or modified CDS sequence (opt1) from SEOV(L99)__AF488708.1__N
auggccaccauggaggagauccagcgcgagaucagcgcccacgagggccagcuggugaucgcgcggcagaaggucaaggacgccgagaagcaguacgagaaggaccccgacgaccucaacaagcgcacccugcacgaccgggaguccguggccgccagcauccaguccaagaucgacgagcugaagcgccagcucgccgaccggaucgcggccgggaagaacaucggccaggaccgcgaccccacggggguggagcccggcgaccaccugaaggagcggagcgcccuguccuacgggaacacccucgaccugaacagccuggacaucgacgagcccaccggccagaccgccgacuggcucacgaucaucgucuaccugaccuccuucguggugcccaucauccugaaggcgcucuacaugcugaccacccgcggccggcagacgagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacccccgggcgguuccgcaccgccgugugcggccucuaccccgcccagaucaaggcgcggaacauggucagcccggugauguccguggucggguuccuggcccuggccaaggacuggaccagccgcaucgaggaguggcucggcgcccccugcaaguucauggccgagucccccaucgcgggcagccuguccgggaaccccgugaaccgggacuacauccgccagcggcagggcgcccuggccgggauggagccgaaggaguuccaggcccuccgccagcacgccaaggacgcgggcugcacgcugguggagcacaucgagagccccagcuccaucugggucuucgccggcgcccccgaccggugcccgccgaccugccuguucgucgggggcauggccgagcucggggccuucuucagcauccugcaggacaugcgcaacaccaucauggcguccaagaccgugggcacggccgacgagaagcugcgcaagaaguccagcuucuaccagagcuaccuccggcgcacccaguccauggggauccagcuggaccagcggaucaucgugauguucaugguggccuggggcaaggaggccguggacaacuuccaccugggcgacgacauggaccccgagcuccgcagccuggcgcagauccugaucgaccagaaggucaaggagaucuccaaccaggagcccaugaagcucuga

SEQ ID NO: 6611 - RNA, 1290 nt, Artificial Sequence
  derived and/or modified CDS sequence (opt1) from SEOV(R22)__AF488707.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucggcgcccccugcaaguucauggcggagucccccaucgccggcagccuguccgggaaccccgugaaccgggacuacauccgccagcggcagggcgcccuggccgggauggagccgaaggaguuccaggcccuccgccagcacgcgaaggacgccggcugcacccugguggagcacaucgagagccccagcuccaucugggucuucgccggcgcccccgaccggugcccgcccacgugccuguucguggggcgcauggccgagcucggcgcguucuucagcauccugcaggacaugaagaacaccaucauggccuccaagaccguggggaccgccgacgagaagcugcgcaagaaguccagcuucuaccagagcuaccuccggcgcacgcaguccaugggcauccagcuggaccagcggaucaucgucauguucaugguggccugggggaaggaggcgguggacaacuuccaccugggcgacgacauggaccccgagcuccgcagccuggcccagauccugaucgaccagaaggucaaggagaucuccaaccaggagcccaugaagcucuga

SEQ ID NO: 6612 - RNA, 1290 nt, Artificial Sequence
  derived and/or modified CDS sequence (opt1) from SEOV(TURCKHEIM/Hu/FRA/2016/2016.00044)__KX064270.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggaucgccgccgggaagaacaucggccaggaccgcgacccgaccgggguggagcccggcgaccaccugaaggagcggagcgcccuguccuacgggaacacgcucgaccugaacagccuggacaucgacgagcccaccggccagaccgcggacuggcucaccaucaucgucuaccugacguccuucguggugcccaucauccugaaggcccucuacaugcugaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccucuaccccgcgcagaucaaggcccggaacauggucagcccggugauguccguggucggguuccuggcccuggccaaggacuggaccagccgcaucgaggaguggcucgacgcccccugcaaguucaucgcggagucccccaucgccggcagccuguccggcaaccccgugaaccgggacuacauccgccagcggcagggggcccuggccggcauggagccgaaggaguuccaggcccuccgccagcacagcaaggacgcggggugcacccugguggagcacaucgagagccccuccagcaucugggucuucgccggcgcccccgaccggugcccgcccacgugccuguucgugggcgggauggccgagcucggcgccuucuucuccauccugcaggacaugcgcaacaccaucauggcgagcaagaccguggggaccgccgacgagaagcugcgcaagaaguccagcuucuaccaguccuaccuccggcgcacgcagagcaugggcauccagcuggaccagcggaucaucgucauguucaugguggccugggggaaggaggccguggacaacuuccaccugggcgacgacauggaccccgagcuccgcucccuggcgcagauccugaucgaccagaaggucaaggagaucagcaaccaggagcccaugaagcucuga

SEQ ID NO: 6613 - RNA, 1290 nt, Artificial Sequence
  derived and/or modified CDS sequence (opt1) from SEOV(Z37)__AF187082.1__N
auggccaccauggaggagauccagcgcgagaucagcgcccacgagggccagcuggugaucgcgcggcagaaggucaaggacgccgagaagcaguacgagaaggaccccgacgacuucaacaagcgcgcccuccacgaccgggaguccguggccgccagcauccaguccaagaucgacgagcugaagcgccagcuggcggaccggaucgccgccgggaagaacaucggccaggaccgcgacccgaccgggguggagcccggcgaccaccucaaggagcggagcgcccuguccuacgggaacacgcuggaccucaacagccuggacaucgacgagcccaccggccagaccgcggacuggcugaccaucaucgucuaccucacguccuucguggugcccaucauccugaaggcccuguacaugcucaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccuguaccccgcgcagaucaaggcccggaacauggucagcccggugauguccguggucggguuccucgcccuggccaaggacuggaccagccgcaucgaggaguggcugggcgcccccugcaaguucauggcggagucccccaucgccggcagccucuccgggaaccccgugaaccgggacuacauccgccagcggcagggcgcccuggccgggauggagccgaaggaguuccaggcccugcgccagcacgcgaaggacgccggcugcacccucguggagcacaucgagagccccagcuccaucugggucuucgccggcgcccccgaccggugcccgcccacgugccuguucgucgggggcauggccgagcugggggcguucuucagcauccuccaggacaugcgcaacaccaucauggccuccaagaccgugggcaccgccgacgagaagcugcgcaagaaguccagcuucuaccagagcuaccugcggcgcacgcaguccauggggauccagcucgaccagcggaucaucggcauguucaugguggccuggggcaaggaggcgguggacaacuuccaccugggggacgacauggaccccgagcugcgcagccucgcccagauccugaucgaccagaaggugaaggagaucuccaaccaggagcccaugaagcuguga

SEQ ID NO: 6614 - RNA, 1290 nt, Artificial Sequence
  derived and/or modified CDS sequence (opt1) from SEOV(Tchoupitoulas (TCH))__AF329389.1__N
auggccaccauggaggagauccagcgcgagaucagcgcccacgagggccagcuggugaucgcgcggcagaaggucaaggacgccgagaagcaguacgagaaggaccccgacgacuucuacaagcgcgcccuccacgaccgggaguccguggccgccagcauccaguccaagaucgacgagcugaagcgccagcuggcggaccggaucgccgccgggaagaacaucggccaggaccgcgacccgaccgggguggagcccggcgaccaccucaaggagcggagcgcccuguccuacgggaacacgcuggaccucaacagccuggacaucgacgagcccaccggccagaccgcggacuggcugaccaucaucgucuaccucacguccuucguggugcccaucauccugaaggcccuguacaugcucaccacccgcggccggcagaccagcaaggacaacaaggggaugcgcauccgguucaaggacgacuccagcuacgaggacgucaacggcauccgcaagccgaagcaccuguacguguccaugcccaacgcccagagcuccaugaaggccgaggagaucacgcccgggcgguuccgcaccgccgugugcggccuguaccccgcgcagaucaaggcccggaacauggucagcccggugauguccguggucggguuccucgcccuggccaaggacuggaccagccgcaucgaggaguggcugggcgcccccugcaaguucauggcggagucccccaucgccggcagccucuccgggaaccccgugaaccgggacuacauccgccagcggcagggcgcccuggccgggauggagccgaaggaguuccaggcccugcgccagcacagcaaggacgcgggcugcacccucguggagcacaucgagagccccuccagcaucugggucuucgccggcgcccccgaccggugcccgcccacgugccuguucgucgggggcauggccgagcugggggccuucuucuccauccuccaggacaugcgcaacaccaucauggcgagcaagaccgugggcaccgccgacgagaagcugcgcaagaaguccagcuucuaccaguccuaccugcggcgcacgcagagcauggggauccagcucgaccagcggaucaucgugauguucaugguggccuggggcaaggaggccguggacaacuuccaccugggcgacgacauggaccccgagcugcgcucccucgcgcagauccugaucgaccagaaggucaaggagaucagcaaccaggagcccaugaagcuguga

SEQ ID NO: 6615 - RNA, 1290 nt, Artificial Sequence
  derived and/or modified CDS sequence (opt1) from SEOV__M34881.1__N
auggccaccauggaggagauccagcgcgagaucagcgcccacgagggccagcuggugaucgcgcggcagaaggucaaggacgccgagaagcaguacgagaaggaccccgacgaccucaacaagcgcgcccugcacgaccgggaguccguggccgccagcauccaguccaagaucgacgagcugaagcgccagcucgcggaccggcugcagcaggggcgcaccagcggccaggaccgggaccccacggggguggagcccggcgaccaccugaaggagcgcuccgcccucagcuacgggaacacccuggaccugaacucccucgacaucgacgagcccaccggccagaccgccgacuggcugacgaucaucgucuaccugaccagcuucguggugcccaucauccucaaggcccuguacaugcugaccacccggggccgccagacguccaaggacaacaaggggaugcggauccgcuucaaggacgacagcuccuacgaggacgucaacggcauccggaagccgaagcaccucuacgugagcaugcccaacgcgcaguccagcaugaaggccgaggagaucacccccgggcgcuuccggaccgccgugugcggccuguaccccgcccagaucaaggcccgcaacauggucuccccggugaugagcguggucggguuccuggcgcucgccaaggacuggaccucccggaucgaggaguggcugggcgcccccugcaaguucauggccgagagccugaucgccggcucccucagcgggaaccccgugaaccgcgacuacauccggcagcgccagggcgcgcuggccgggauggagcccaaggaguuccaggcccugcggcagcacagcaaggacgccggcugcacgcucguggagcacaucgaguccccgagcuccaucugggucuucgccggcgcgcccgaccgcugcccgccgaccugccuguucgucgggggcauggccgagcugggggccuucuucagcauccuccaggacaugcgcaacaccaucauggccuccaagaccgugggcacggccgacgagaagcugcggaagaaguccagcuucuaccagagcuaccugcgccggacccaguccauggggauccagcucgaccagcgcaucaucgugauguucaugguggcguggggcaaggaggccguggacaacuuccaccugggcgacgacauggaccccgagcugcggagccucgcccagauccugaucgaccagaaggucaaggagaucuccaaccaggagcccaugaagcuguga

SEQ ID NO: 6616 - RNA, 1287 nt, Artificial Sequence
  derived and/or modified CDS sequence (opt1) from SNV(H10)__NC_005216.1__N
augagcacccugaaggaggugcaggacaacaucacccuccacgagcagcagcuggucacggcccgccagaagcugaaggacgccgagcgggcgguggagcucgaccccgacgacgugaacaaguccacccugcagagccgccgggccgccgucuccgcccuggagaccaagcucggcgagcugaagcgcgagcuggccgaccucaucgcggcccagaagcuggccagcaagccgguggaccccaccgggaucgagcccgacgaccaccugaaggagaaguccagccuccgguacggcaacgugcuggacgucaacuccaucgaccuggaggagcccagcgggcagacggccgacuggaaguccaucggccucuacauccugagcuucgcgcugccgaucauccucaaggcccuguacaugcuguccacccgcgggcggcagaccaucaaggagaacaagggcacccgcauccgguucaaggacgacagcuccuacgaggaggugaacggcauccgcaagccccggcaccucuacgugagcaugcccacggcccaguccaccaugaaggccgacgagaucacccccgggcgcuuccggaccaucgccugcggccuguucccggcgcaggucaaggcccgcaacaucaucagccccgugaugggggugaucggcuucuccuucuucgucaaggacuggauggagcggaucgacgacuuccuggccgcccgcugccccuuccuccccgagcagaaggacccgcgggacgccgcgcuggccacgaaccgcgccuacuucaucacccggcagcuccagguggacgagagcaagguguccgacaucgaggaccugaucgccgacgcccgcgcggagagcgccaccaucuucgccgacaucgccacgccccacagcgucuggguguucgccugcgcgcccgaccggugcccgcccaccgcccuguacguggccgggaugcccgagcugggcgccuucuucgcgauccuccaggacaugcgcaacaccaucauggccuccaagagcgucggcaccuccgaggagaagcugaagaagaaguccgccuucuaccagagcuaccugcgccggacccagagcauggggauccagcucgaccagaagaucaucauccuguacaugucccacuggggccgcgaggccgugaaccacuuccaccugggggacgacauggaccccgagcuccgggagcuggcccagacgcugguggacaucaagguccgcgagaucagcaaccaggagccccucaagcuguga

SEQ ID NO: 6617 - RNA, 1287 nt, Artificial Sequence
  derived and/or modified CDS sequence (opt1) from SNV(2)__JQ690282.1__N
augagcacccugaaggaggugcaggacaacaucacccuccacgagcagcagcuggucacggcccgccagaagcugaaggacgccgagcgggcgguggagcucgaccccgacgacgugaacaaguccacccugcagagccgccgggccgccgucuccgcccuggagaccaagcucggcgagcugaagcgcgagcuggccgaccucaucgcggcccagaagcuggccagcaagccgguggaccccaccgggaucgagcccgacgaccaccugaaggagaaguccagccuccgguacggcaacgugcuggacgucaacuccaucgaccuggaggagcccagcgggcagacggccgacuggaaguccaucggccucuacauccugagcuucgcgcugccgaucauccucaaggcccuguacaugcuguccacccgcgggcggcagaccaucaaggagaacaagggcacccgcauccgguucaaggacgacagcuccuacgaggaggugaacggcauccgcaagccccggcaccucuacgugagcaugcccacggcccaguccaccaugaaggccgacgagaucacccccgggcgcuuccggaccaucgccugcggccuguucccggcgcaggucaaggcccgcaacaucaucagccccgugaugggggugaucggcuucuccuucuucgucaaggacuggauggagcggaucgacgacuuccuggccgcccgcugccccuuccuccccgagcagaaggacccgcgggacgccgcgcuggccacgaaccgcgccuacuucaucacccggcagaugcaggucgacgagagcaagguguccgacaucgaggaccugaucgccgacgcccgcgcggagagcgccaccaucuucgccgacaucgccacgccccacagcguguggguguucgccugcgcgcccgaccggugcccgcccaccgcccucuacguggccgggaugcccgagcugggcgccuucuucgcgauccugcaggacaugcgcaacaccaucauggccuccaagagcgucggcaccuccgaggagaagcucaagaagaaguccgccuucuaccagagcuaccugcgccggacccagagcauggggauccagcuggaccagaagaucaucauccucuacaugucccacuggggccgcgaggccgugaaccacuuccaccugggggacgacauggaccccgagcugcgggagcucgcccagacgcugguggacaucaagguccgcgagaucagcaaccaggagccccugaagcucuga

SEQ ID NO: 6618 - RNA, 1287 nt, Artificial Sequence
  derived and/or modified CDS sequence (opt1) from SNV(3)__JQ690278.1__N
augagcacccugaaggaggugcaggacaacaucacccuccacgagcagcagcuggucacggcccgccagaagcugaaggacgccgagcgggcgguggagcucgaccccgacgacgugaacaaguccacccugcagagccgccgggccgccgucuccgcccuggagaccaagcucggcgagcugaagcgcgagcuggccgaccucaucgcggcccagaagcuggccagcaagccgguggaccccaccgggaucgagcccgacgaccaccugaaggagaaguccagccuccgguacggcaacgugcuggacgucaacuccaucgaccuggaggagcccagcgggcagacggccgacuggaaguccaucggccucuacauccugagcuucgcgcugccgaucauccucaaggcccuguacaugcuguccacccgcgggcggcagaccaucaaggagaacaagggcacccgcauccgguucaaggacgacagcuccuacgaggaggugaacggcauccgcaagccccggcaccucuacgugagcaugcccacggcccaguccaccaugaaggccgacgagaucacccccgggcgcuuccggaccaucgccugcggccuguucccggcgcaggucaaggcccgcaacaucaucagccccgugaugggggugaucggcuucuccuucuucgucaaggacuggauggagcggaucgacgacuuccuggccgcccgcugccccuuccuccccgagcagaaggacccgcgggacgccgcgcuggccacgaaccgcgccuacuucaucacccggcagcuccagguggacgagagcaagguguccgacaucgaggaccugaucgccgacgcccgcgcggagagcgccaccaucuucgccgacaucgccacgccccacagcgucuggguguucgccugcgcgcccgaccggugcccgcccaccgcccuguacguggccgggaugcccgagcugggcgccuucuucgcgauccuccaggacaugcgcaacaccaucauggccuccaagagcgucggcaccuccgaggagaagcugaagaagaaguccgccuucuaccagagcuaccugcgccggacccagagcauggggauccagcccgaccagaagaucaucauccucuacaugucccacuggggccgcgaggccgugaaccacuuccaccugggggacgacauggaccccgagcugcgggagcucgcccagacgcugguggacaucaagguccgcgagaucagcaaccaggagccgcugaagcucuga

SEQ ID NO: 6619 - RNA, 1287 nt, Artificial Sequence
  derived and/or modified CDS sequence (opt1) from SNV(CC107/POR)__KT885046.1__N
augagcacccugaaggaggugcaggacaacaucacccuccacgagcagcagcuggucacgacccgccagaagcugaaggacgccgagcgggccguggagcucgaccccgacgacgugaacaaguccacccugcagagccgccgggcggccgucuccgcccuggagaccaagcucggcgagcugaagcgcgagcuggccgaccucaucgccgcgcagaagcuggccagcaagccgguggaccccacggggaucgagcccgacgaccaccugaaggagaaguccagccuccgguacggcaacgugcuggacgucaacuccaucgaccuggaggagcccagcgggcagaccgccgacuggaaguccaucggccucuacauccugagcuucgcccugccgaucauccucaaggcgcuguacaugcuguccacccgcgggcggcagaccaucaaggagaacaagggcacgcgcauccgguucaaggacgacagcuccuacgaggaggugaacggcauccgcaagccccggcaccucuacgugagcaugcccaccgcccaguccaccaugaaggccgacgagaucacccccgggcgcuuccggacgaucgccugcggccuguucccggcccaggucaaggcgcgcaacaucaucagccccgugaugggggugaucggcuucuccuucuucgucaaggacuggauggagcggaucgacgaguuccuggccgcccgcugccccuuccuccccgagcagaaggacccgcgggacgccgcccuggcgaccaaccgcgccuacuucaucacccggcagaugcaggucgacgagagcaagguguccgacaucgaggaccugaucgccgacgcccgcgccgagagcgcgaccaucuucgccgacaucgccacgccccacagcguguggguguucgccugcgcccccgaccggugcccgcccaccgcgcucuacguggccgggaugcccgagcugggcgccuucuucgccauccugcaggacaugcgcaacaccaucauggcguccaagagcgucggcaccuccgaggagaagcucaagaagaaguccgccuucuaccagagcuaccugcgccggacgcagagcauggggauccagcuggaccagaagaucaucauccucuacaugucccacuggggccgcgaggccgugaaccacuuccaccugggggacgacauggaccccgagcugcgggagcucgcccagacccugguggacaucaagguccgcgagaucagcaaccaggagccccugaagcucuga

SEQ ID NO: 6620 - RNA, 1287 nt, Artificial Sequence
  derived and/or modified CDS sequence (opt1) from HPS(Convict Creek 107)__L33683.1__N
augagcacccugaaggaggugcaggacaacaucacccuccacgagcagcagcuggucacgacccgccagaagcugaaggacgccgagcgggccguggagcucgaccccgacgacgugaacaaguccacccugcagagccgccgggcggccgucuccgcccuggagaccaagcucggcgagcugaagcgcgagcuggccgaccucaucgccgcgcagaagcuggccagcaagccgguggaccccacggggaucgagcccgacgaccaccugaaggagaaguccagccuccgguacggcaacgugcuggacgucaacuccaucgaccuggaggagcccagcgggcagaccgccgacuggaaguccaucggccucuacauccugagcuucgcccugccgaucauccucaaggcgcuguacaugcuguccacccgcgggcggcagaccaucaaggagaacaagggcacgcgcauccgguucaaggacgacagcuccuacgaggaggugaacggcauccgcaagccccggcaccucuacgugagcaugcccaccgcccaguccaccaugaaggccgacgagaucacccccgggcgcuuccggacgaucgccugcggccuguucccggcccaggucaaggcgcgcaacaucaucagccccgugaugggggugaucggcuucuccuucuucgucaaggacuggauggagcggaucgacgaguuccuggccgcccgcugccccuuccuccccgagcagaaggacccgcgggacgccgcccuggcgaccaaccgcgccuacuucaucacccggcagaugcaggucgacgagagcaagguguccgacaucgaggaccugaucgccgacgcccgcgccgagagcgcgaccaucuucgccgacaucgccacgccccacagcguguggguguucgccugcgcccccgaccggugcccgcccaccgcgcucuacguggccgggaugcccgagcugggcgccuucuucggcauccugcaggacaugcgcaacaccaucauggccuccaagagcgucgggaccuccgaggagaagcucaagaagaaguccgcguucuaccagagcuaccugcgccggacgcagagcaugggcauccagcuggaccagaagaucaucauccucuacaugucccacugggggcgcgaggccgugaaccacuuccaccugggcgacgacauggaccccgagcugcgggagcucgcccagacccugguggacaucaagguccgcgagaucagcaaccaggagccccugaagcucuga

SEQ ID NO: 6621 - RNA, 1287 nt, Artificial Sequence
  derived and/or modified CDS sequence (opt1) from HPS(Convict Creek 74)__L33816.1__N
augagcacccugaaggaggugcaggacaacaucacccuccacgagcagcagcuggucacgucccgccagaagcugaaggacgccgagcgggccguggagcucgaccccgacgacgugaacaagagcacccugcagucccgccgggcggccgucagcgcccuggagaccaagcucggcgagcugaagcgcgagcuggccgaccacaucgccgcgcagaagcucgccuccaagccgguggaccccaccgggaucgagcccgacgaccaccugaaggagaaguccagccugcgguacggcaacgugcucgacgucaacagcaucgaccuggaggagcccaacgggcagacggccgacuggaaguccaucggccuguacauccucagcuucgcccugccgaucauccugaaggcgcucuacaugcuguccacccgcgggcggcagaccaucaaggagaacaagggcacccgcauccgguucaaggacgacagcuccuacgaggaggugaacggcauccgcaagccccggcaccuguacgugagcaugcccacggcccaguccaccaugaaggccgacgagaucacccccgggcgcuuccggaccaucgccugcggccucuucccggcccaggucaaggcgcgcaacaucaucagccccgugaugggggugaucggcuucuccuucuucgucaaggacuggauggagcggaucgacgaguuccuggccgcccgcugccccuuccugcccgagcagaaggacccgcgggacgccgcccucgcgacgaaccgcgccuacuucaucacccggcagcuccagguggacgagagcaagguguccgacaucgaggaccugaucgccgacgcccgcgccgagagcgcgaccaucuucgccgacaucgccacgccccacagcgucuggguguucgccugcgcccccgaccggugcccgcccaccgcgcuguacguggccgggaugcccgagcugggcgccuucuucggcauccugcaggacaugcgcaacaccaucauggccuccaagagcgucgggaccuccgaggagaagcucaagaagaaguccgcguucuaccagagcuaccugcgccggacccagagcaugggcauccagcuggaccagaagaucaucauccucuacaugucccacugggggcgcgaggccgugaaccacuuccaccugggcgacgacauggaccccgagcugcgggagcucgcccagacgcugguggacaucaagguccgcgagaucagcaaccaggagccccugaagcucuga

SEQ ID NO: 6622 - RNA, 1287 nt, Artificial Sequence
  derived and/or modified CDS sequence (opt1) from HPS(H-NY1)__U47135.1__N
augagcacccugaaggaggugcaggacaacaucacccuccacgagcagcagcuggucacggcccgccagaagcugaaggacgccgagaaggcgguggagguggaccccgacgacgucaacaaguccacccuccagggccggcgcgccgccgugagcgcccuggagaccaagcugggggagcucaagcggcagcuggccgaccugaucgcggcccagaagcucgccuccaagccgaucgaccccaccggcaucgagcccgacgaccaccugaaggagaaguccagccugcgcuacgggaacgugcucgacgucaacagcaucgaccuggaggagcccuccggccagacggccgacuggaaggcgaucgggauguacauccugagcuucgccaucccgaucauccucaaggcccuguacaugcuguccacccggggccgccagaccgugaaggagaacaagggcacccggauccgcuucaaggacgacagcuccuacgaggaggugaacgggauccggaagccccgccaccucuacgucagcaugcccacggcccaguccaccaugaaggccgacgagaucacccccggccgguuccgcaccaucgcgugcgggcuguucccggcccaggugaaggcccggaacaucaucagccccgugaugggcgucaucggguucaacuucuucgugaaggacuggauggaccgcaucgacgacuuccuggccgagcggugccccuuccuccccgagccgcgcgaccccaaggacgccgcgcugggcacgaaccgggccuacuucaucacccgccaggcccagguggacgaguccaaggucguggacaucgaggagcugaucguggacgcccgggccgagagcgcgacccucuucaccgacaucgccacgccccacuccgucuggguguucgccugcgcccccgaccgcugcccgcccaccgcccuguacguggcgggcaugcccgagcugggggccuucuucgccauccuccaggacaugcggaacaccaucauggccagcaaguccgucggcaccgcggaggagaagcugaagaagaaguccgccuucuaccagagcuaccugcgccgcacgcagagcauggggauccagcucgaccagaagaucaucauccuguacaugauccacuggggcaaggaggccgugaaccacuuccaccugggcgacgacauggaccccgagcuccgggagcuggcccaggcccugguggacgcgaaggucaaggagaucagcaaccaggagccgcucaagcuguga

SEQ ID NO: 6623 - RNA, 1290 nt, Artificial Sequence
  derived and/or modified CDS sequence (opt1) from THAIV(Nakhon Ratchasima/Bi0017/2004)__AM397664.1__N
auggccaccauggaggagcugcagcgcgagaucaacgcccacgagggccagcucguggucgcgcggcagaaggugaaggacgccgagaagcaguacgagaaggaccccgacgaccugaaccgccgggcccugcacgaccgcgagagcguggccgccuccauccagagcaagaucgacgagcucaagcggcagcuggcggaccgcaucgccuccgggcggaccaucggccaggaccgcgacccgacgggggucgagcccggcgaccaccuccgggagcgcagcaugcuguccuacgggaacgugcuggaccugaacaaccucgacaucgaggagcccaccggccagaccgccgacuggcugaccaucaucguguaccugacgagcuucgucauccccaucauccucaaggcccuguacaugcugaccacccggggccgccagaccacgaaggacaacaaggggaugcggauccgcuucaaggacgacuccagcuacgaggacgugaacggcauccggaagccgaagcaccucuacaucuccaugcccaacgcgcagagcuccaugaaggccgaggagaucacccccgggcgcuuccggaccgccgugugcggccuguaccccgcccaggucaaggcccgcaacauggugagcccggugauguccgucaucggguucauggcgcuggccaaggacuggaccgaccggauccaggacuggcucggcgcccccugcaaguuccugcccgaccugagcacgcagucccuccacgccagcccgcccaccaacgccgacuacaucgcgcagcgccagggccugcuggccgggauggagaccaaggaguccaagggcauccgggaccacgcccgcgacgccgggugcacccucguggaccaccuggacagccccuccagcaucuggguguucgccggcgcgcccgaccgcugcccgcccacgugccuguucaucgccggcauggccgagcucggggccuucuucagcauccugcaggacaugcggaacaccaucauggccuccaagaccgucggcaccagcgaggagaagcugaagaagaaguccagcuucuaccaguccuaccuccgccggacgcagagcauggggauccagcuggaccagcgcaucaucgugauguucaugguggcguggggcaaggaggccgucgacaacuuccaccugggggacgacauggaccccgagcuccggaaccuggcccagcugcucaucgaccagaaggugaaggagaucuccaaccaggagccccugaagcuguga

SEQ ID NO: 6624 - RNA, 1290 nt, Artificial Sequence
  derived and/or modified CDS sequence (opt1) from TULV(Tula/Moravia/5302Ma/94)__NC_005227.2__N
augagccagcugaaggagauccaggaggagaucacccgccacgagcagcagaucgugaucgcccggcagaagcucaaggacgccgagaagaccgucgaggcggaccccgacgacgugaacaaguccacgcugcagagccgccgggccgccguguccgcccuggaggacaagcucgccgacuucaagcgccagcuggcggaccuggucagcucccagaagaugggcgagaagccgguggaccccaccgggcucgagcccgacgaccaccugaaggagcggagcucccugcgcuacggcaacgugcucgacgucaacgccaucgacaucgacgagcccagcgggcagaccgccgacugguucuccaucggccaguacaucaccggguucgcccuggcgaucauccugaaggcccucuacaugcugagcacgcggggccgccagaccaucaaggagaacaagggcacccggauccgcuucaaggacgacuccagcuacgaggagaucaacgggauccggcgcccgaagcaccuguacguguccaugcccaccgcccagagcacgaugaaggccgacgagcucacccccggccgguuccgcaccaucgugugcgggcuguuccccgcccagaucaugcaccggaacaucaucuccccggucaugggcgugaucggguucagcuucuucgugaaggacuggcccgagaagaucgaggaguuccugaucaagcccugccccuuccucaagaaguccggcccgagcaaggaggaggacuuccuggucuccaacgacgcguaccugcucggccgcgagaaggcccugcgggagagccaccuggccgagaucgacgaccucaucgaccuggccgccagcggggaccccaccccgcccgacuccaucaagagcccccaggcgcccuggguguucgccugccgccccgaccggugcccgcccacgugcaucuacaucgccggcauggccgagcugggggccuucuucuccauccuccaggacaugcgcaacaccaucauggcgagcaagaccgugggcaccgccgaggagaagcugaagaagaaguccagcuucuaccaguccuaccugcggcgcacgcagagcaugggcauccagcucgaccagcgcaucauccugcuguucaugaccgaguggggguccgacaucgucaaccacuuccaccucggcgacgacauggaccccgagcugcggacccuggcccagagccucaucgaccagaaggugaaggagaucuccaaccaggagccccugaagaucuga

SEQ ID NO: 6625 - RNA, 1293 nt, Artificial Sequence
  derived and/or modified CDS sequence (opt1) from TULV(D17-98)__AF289820.1__N
augagccagcugaaggagauccaggaggagaucacccgccacgagcagcagaucgugaucgcccggcagaagcucaaggacgccgagaagaccgucgaggcggaccccgacgacgugaacaaguccacgcugcagagccgccgggccgccguguccgcccuggaggacaagcucgccgacuucaagcgccagcuggcggaccuggucagcucccagaagaugggcgagaagcccguggaccccaccgggcucgagcccgacgaccaccugaaggagcggagcucccugcgcuacggcaacgugcucgacgucaacgccaucgacaucgacgagcccagcgggcagaccgccgacugguucuccaucggccaguacaucaucggguucgcccuggcgaucgugcugaaggcccucuacaugcugagcacccggggccgccagacgaucaaggagaacaagggcacccggauccgcuucaaggacgacuccagcuacgaggagaucaacgggauccggcgcccgaagcaccuguacguguccaugcccaccgcccagagcaccaugaaggccgacgagcucacgcccggccgguuccgcaccaucgucugcgggcuguuccccgcccagaucaugcaccggaacaucaucuccccggugaugggcgugaucggguucagcuucuucgucaaggacuggcccgacaagaucgaggaguuccugaucaagcccugccccuuccucaagaagcagggcggcccgaacaaggacgaggaguuccugguguccuacgacgcguaccugcucgggcgcgagaaggcccugcgggagagccaccuggccgagaucgacgaccucaucgaccuggccgccuccggcgaccccaccccgcccgacagcaucaagagcccccaggggcccuggguguucgcgugcgcccccgaccgcugcccgccgaccugcaucuacgucgccggcauggccgagcugggcgccuucuucuccauccuccaggacaugcggaacacgaucauggcgagcaagaccguggggaccgccgaggagaagcugaagaagaaguccagcuucuaccaguccuaccugcgccggacccagagcaugggcauccagcucgaccagcgcaucauccugcuguucaugauggaguggggguccgacaucgugaaccacuuccaccucggcgacgacauggaccccgagcugcgcacgcuggcccagagccucaucgaccagaaggucaaggagaucuccaaccaggagccccugaagaucuga

SEQ ID NO: 6626 - RNA, 1293 nt, Artificial Sequence
  derived and/or modified CDS sequence (opt1) from TULV(D5-98)__AF289819.1__N
augagccagcugaaggagauccaggaggagaucacccgccacgagcagcagaucgugaucgcccggcagaagcucaaggacgccgagaagaccgucgaggcggaccccgacgacgugaacaaguccacgcugcagagccgccgggccgccguguccgcccuggaggacaagcucgccgacuucaagcgccagcuggcggaccuggucagcucccagaagaugggcgagaagcccguggaccccaccgggcucgagcccgacgaccaccugaaggagcggagcucccugcgcuacggcaacgugcucgacgucaacgccaucgacaucgacgagcccagcgggcagaccgccgacugguucuccaucggccaguacaucaucggguucgcccuggcgaucgugcugaaggcccucuacaugcugagcacccggggccgccagacgaucaaggagaacaagggcacccggauccgcuucaaggacgacuccagcuacgaggagaucaacgggauccggcgcccgaagcaccuguacguguccaugcccaccgcccagagcaccaugaaggccgacgagcucacgcccggccgguuccgcaccaucgucugcgggcuguuccccgcccagaucaugcaccggaacaucaucuccccggugaugggcgugaucggguucagcuucuucgucaaggacuggcccgacaagaucgaggaguuccugaucaagcccugccccuuccucaagaagcagggcggcccgaacaaggacgaggaguuccugguguccuacgacgcguaccugcucgggcgcgagaaggcccugcgggagagccaccuggccgagaucgacgaccucaucgaccuggccgccuccggcgaccccaccccgcccgacagcaucaagagcccccaggcgcccuggguguucgccugcgcccccgaccgcugcccgccgaccugcaucuacgucgccgggauggccgagcugggcgcguucuucuccauccuccaggacaugcggaacacgaucauggccagcaagaccgugggcaccgccgaggagaagcugaagaagaaguccagcuucuaccaguccuaccugcgccggacccagagcauggggauccagcucgaccagcgcaucauccugcuguucaugauggaguggggcuccgacaucgugaaccacuuccaccucggggacgacauggaccccgagcugcgcacgcuggcccagagccucaucgaccagaaggucaaggagaucuccaaccaggagccccugaagaucuga

SEQ ID NO: 6627 - RNA, 1293 nt, Artificial Sequence
  derived and/or modified CDS sequence (opt1) from TULV(D63-98)__AF289821.1__N
augagccagcugaaggagauccaggaggagaucacccgccacgagcagcagaucgugaucgcccggcagaagcucaaggacgccgagaagaccgucgaggcggaccccgacgacgugaacaaguccacgcugcagagccgccgggccgccguguccgcccuggaggacaagcucgccgacuucaagcgccagcuggcggaccuggucagcucccagaagaugggcgagaagcccguggaccccaccgggcucgagcccgacgaccaccugaaggagcggagcucccugcgcuacggcaacgugcucgacgucaacgccaucgacaucgacgagcccagcgggcagaccgccgacugguucuccaucggccaguacaucaucggguucgcccuggcgaucgugcugaaggcccucuacaugcugagcacccggggccgccagacgaucaaggagaacaagggcacccggauccgcuucaaggacgacuccagcuacgaggagaucaacgggauccggcgcccgaagcaccuguacguguccaugcccaccgcccagagcaccaugaaggccgacgagcucacgcccggccgguuccgcaccaucgucugcgggcuguuccccgcccagaucaugcaccggaacaucaucuccccggugaugggcgugaucggguucagcuucuucgucaaggacuggcccgacaagaaggaggaguuccugaucaagcccugccccuuccucaagaagcagggcggcccgaacaaggacgaggaguuccugguguccaacgacgcguaccugcucgggcgcgagaaggcccugcgggagagccaccuggccgagaucgacgaccucaucgaccuggccgccuccggcgaccccaccccgcccgacagcaucaagagcccccaggggcccuggguguucgcgugcgcccccgaccgcugcccgccgaccugcaucuacgucgccggcauggccgagcugggcgccuucuucuccauccuccaggacaugcggaacacgaucauggcgagcaagaccguggggaccgccgaggagaagcugaagaagaaguccagcuucuaccaguccuaccugcgccggacccagagcaugggcauccagcucgaccagcgcaucauccugcuguucaugauggaguggggguccgacaucgugaaccacuuccaccucggcgacgacauggaccccgagcugcgcacgcuggcccagagccucaucgaccagaaggucaaggagaucuccaaccaggagccccugaagaucuga

SEQ ID NO: 6628 - RNA, 1290 nt, Artificial Sequence
  derived and/or modified CDS sequence (opt1) from TULV(MG23/Omsk)__AF442621.1__N
augagcacccugaaggagauccaggaggagaucacccgccacgagcagcagaucgugaucgcccggcagaagcucaaggacgccgagaagacggucgaggcggaccccgacgacgugaacaagaacacccugcagucccgccgggccgccgugagcacccuggaggacaagcucgccgaguucaagcgccagcuggccgaccuggucuccagccagaagaugggcgagaagcccguggaccccaccgggcucgagcccgacgaccaccugaaggagcgguccagccugcgcuacggcaacgugcucgacgucaacgcgacggacaucgacgagcccuccgggcagaccgccgacugguucagcaucggccaguacaucaugggguucgcccuggccaucgugcugaaggcgcucuacaugcuguccacccggggccgccagaccaucaaggagaacaagggcacgcggaucaaguucaaggacgacagcuccaucgaggagaucaacgggauccgccggccgaagcaccuguacgugagcaugcccaccgcccaguccaccaugaaggccgacgagcucacccccggccgcuuccggacgaucgucugcgggcuguuccccgcccagaucaugcaccgcaacaucaucagcccggugaugggcgugaucggguucuccuucuucgucaaggacuggcccgacaagaucgaggaguuccugaucaagcccugccccuuccucaagaagcagggcagcaccaaggaggaggaguuccugguguccaacgacgccuacaugcugggccgggagaaggcgcuccgcgagagccaccuggccgagaucgacgagcugaucgaccucgccgacuccggggacccgaccccgcccgacagcaucaagagcccccaggcccccuggguguucgccugcgcgcccgaccggugcccgccgaccugcaucuacaucgccggcauggccgagcugggggccuucuucuccauccugcaggacaugcgcaacacgaucauggccagcaagaccgucggcaccgcggaggagaagcucaagaagaaguccagcuucuaccaguccuaccugcggcgcacccagagcaugggcauccagcuggaccagcggaucauccuccuguucaugauggaguggggguccgacaucgugaaccacuuccaccugggcgacgacauggaccccgagcuccgcacgcuggcccagagccugaucgaccagaaggugaaggagaucuccaaccaggagccccucaagaucuga

SEQ ID NO: 6629 - RNA, 1290 nt, Artificial Sequence
  derived and/or modified CDS sequence (opt1) from TULV(c109-s)__AF164094.1__N
augagccagcugaaggagauccaggaggagaucacccgccacgagcagcagaucgugaucgcccggcagaagcucaaggacgccgagaagaccgucgaggcggaccccgacgacgugaacaaguccacgcugcagagccgccgggccgccguguccgcccuggaggacaagcucgccgacuucaagcgccagcuggcggaccuggucagcucccagaagaugggcgagaagccgguggaccccaccgggcucgagcccgacgaccaccugaaggagcggagcucccugcgcuacggcaacgugcucgacgucaacgccaucgacaucgacgagcccagcgggcagaccgccgacugguucuccaucggccaguacaucaccggguucgcccuggcgaucauccugaaggcccucuacaugcugagcacgcggggccgccagaccaucaaggagaacaagggcacccggauccgcuucaaggacgacuccagcuacgaggagaucaacgggauccggcgcccgaagcaccuguacguguccaugcccaccgcccagagcacgaugaaggccgacgagcucacccccggccgguuccgcaccaucgugugcgggcuguuccccgcccagaucaugcaccggaacaucaucuccccggucaugggcgugaucggguucagcuucuucgugaaggacuggcccgagaagaucgaggaguuccugaucaagcccugccccuuccucaagaaguccggcccgagcaaggaggaggacuuccuggucuccaacgacgcguaccugcucggccgcgagaaggcccugcgggagagccaccuggccgagaucgacgaccucaucgaccuggccgccagcggggaccccaccccgcccgacuccaucaagagcccccaggcgcccuggguguucgccugcgcccccgaccgcugcccgcccacgugcaucuacaucgccggcauggccgagcugggggcguucuucuccauccuccaggacaugcggaacaccaucauggccagcaagaccgugggcaccuccgaggagaagcugaagaagaaguccagcuucuaccagagcuaccugcgccggacgcaguccaugggcauccagcucgaccagcgcaucauccugcuguucaugaccgagugggggagcgacaucgucaaccacuuccaccucggcgacgacauggaccccgagcugcgcacccuggcccagucccucaucgaccagaaggugaaggagaucagcaaccaggagccccugaagaucuga

SEQ ID NO: 6630 - RNA, 1290 nt, Artificial Sequence
  derived and/or modified CDS sequence (opt1) from TULV(CHEVRU/Hu/FRA/2015/15.00453)__KT946591.1__N
augagccagcugaaggagauccaggaggagaucacccgccacgagcagcagaucgugaucgcccggcagaagcucaaggacgccgagaagaccgucgaggcggaccccgacgacgugaacaaguccacgcugcagagccgccaggccgccguguccgcccuggaggacaagcucgccgacuucaagcggaagcuggcggaccuggucagcucccagaagaugggcgagaagcccguggaccccaccgggcucgagcccgacgaccaccugaaggagcgcagcucccugcgguacggcaacgugcucgacgucaacgccaucgacaucgacgagcccagcgggcagaccgccgacugguucuccaucggccaguacgugaugggguucgcccuggcgaucauccugaaggcccucuacaugcugagcacccgcggccggcagacgaucaaggagaacaagggcacccgcauccgguucaaggacgacuccagcuacgaggagaucaacgggauccgccggccgaagcaccuguacguguccaugcccaccgcccagagcaccaugaaggccgacgagcucacgcccggccgcuuccggaccaucgucugcgggcuguuccccgcccagaucaugcaccgcaacaucaucuccccggugaugggcgugaucggguucagcuucuucgucaaggacuggcccgagaagaucgaggaguuccugaucaagcccugccccuuccucaagaaguccggcccgagcaaggaggaggacuuccugguguccaacgacgcguaccugcucggccgggagaaggcccugcgcgacagccaccuggccgagaucgacgaccucaucgaccuggccgagagcggggaccccaccccgcccgacuccaucaagagcccccaggcccccuggguguucgcgugcgcccccgaccggugcccgccgaccugcaucuacaucgccggcauggccgagcugggggccuucuucuccauccuccaggacaugcgcaacacgaucauggcgagcaagaccgucggcaccgccgaggagaagcugaagaagaaguccagcuucuaccaguccuaccugcggcgcacccagagcaugggcauccagcucgaccagcggaucauccugcuguucaugaucgaguggggguccgacaucgugaaccacuuccaccucggcgacgacauggaccccgagcugcgcacgcuggcccagagccucaucgaccagaaggugaaggagaucuccaaccaggagccccugaagaucuga

SEQ ID NO: 6631 - RNA, 1290 nt, Artificial Sequence
  derived and/or modified CDS sequence (opt1) from TULV(g20-s)__AF164093.1__N
augagccagcugaaggagauccaggaggagaucacccgccacgagcagcagaucgugaucgcccggcagaagcucaaggacgccgagaagaccgucgaggcggaccccgacgacgugaacaaguccacgcugcagagccgccaggccgccguguccgcccuggaggacaagcucgccgacuucaagcggaagcuggcggaccuggucagcucccagaagaugggcgagaagcccguggaccccaccgggcucgagcccgacgaccaccugaaggagcgcagcucccugcgguacggcaacgugcucgacgucaacgccaucgacaucgacgagcccagcgggcagaccgccgacugguucuccaucggccaguacgugaugggguucgcccuggcgaucauccugaaggcccucuacaugcugagcacccgcggccggcagacgaucaaggagaacaagggcacccgcauccgguucaaggacgacuccagcuacgaggagaucaacgggauccgccggccgaagcaccuguacguguccaugcccaccgcccagagcaccaugaaggccgacgagcucacgcccggccgcuuccggaccaucgucugcgggcuguuccccgcccagaucaugcaccgcaacaucaucuccccggugaugggcgugaucggguucagcuucuucgucaaggacuggcccgagaagaucgaggaguuccugaucaagcccugccccuuccucaagaaguccggcccgagcaaggaggaggacuuccugguguccaacgacgcguaccugcucggccgggagaaggcccugcgcgacagccaccuggccgagaucgacgaccucaucgaccuggccgagagcggggaccccaccccgcccgacuccaucaagagcccccaggcccccuggguguucgcgugcgcccccgaccggugcccgccgaccugcaucuacaucgccggcauggccgagcugggggccuucuucuccauccuccaggacaugcgcaacacgaucauggcgagcaagaccgucggcaccgccgaggagaagcugaagaagaaguccagcuucuaccaguccuaccugcggcgcacccagagcaugggcauccagcucgaccagcggaucauccugcuguucaugacggaguggggguccgacaucgugaaccacuuccaccucggcgacgacauggaccccgagcugcgcacccuggcccagagccucaucgaccagaaggugaaggagaucuccaaccaggagccccugaagaucuga

SEQ ID NO: 6632 - RNA, 1293 nt, Artificial Sequence
  derived and/or modified CDS sequence (opt1) from TULV(Sennickerode Sen05/174)__EU439948.1__N
augagccagcugaaggagauccaggaggagaucacccgccacgagcagcagaucgugaucgcccggcagaagcucaaggacgccgagaagaccgucgaggcggaccccgacgacgugaacaaguccacgcugcagagccgccgggccgccguguccgcccuggaggacaagcucgccgacuucaagcgccagcuggcggaccuggucagcucccagaagaugggcgagaagcccguggaccccaccgggcucgagcccgacgaccaccugaaggagcggagcucccugcgcuacggcaacgugcucgacgucaacgccaucgacaucgacgagcccagcgggcagaccgccgacugguucuccaucggccaguacaucaucggguucgcccuggcgaucgugcugaaggcccucuacaugcugagcacccggggccgccagacgaucaaggagaacaagggcacccggauccgcuucaaggacgacuccagcuucgaggagaucaacgggauccggcgcccgaagcaccuguacguguccaugcccaccgcccagagcaccaugaaggccgacgagcucacgcccggccgguuccgcaccaucgucugcgggcuguuccccgcccagaucaugcaccggaacaucaucuccccggugaugggcgugaucggguucagcuucuucgucaaggacuggcccgacaagaucgaggaguuccugaucaagcccugccccuuccucaagaagcagggcggcccgaacaaggacgaggacuuccugguguccaacgacgcguacuuccuggggcgcgagaaggcccuccgggagagccaccugaacgagaucgacgaccugaucgagcucgccgccuccggcgaccccaccccgcccgacagcaucaagagcccccaggcccccuggguguucgcgugcgcccccgaccgcugcccgccgaccugcaucuacgucgccgggauggccgagcugggcgccuucuucuccauccugcaggacaugcggaacacgaucauggcgagcaagaccgugggcaccgccgaggagaagcucaagaagaaguccagcuucuaccaguccuaccugcgccggacccagagcauggggauccagcuggaccagcgcaucauccuccuguucaugauggaguggggcuccgacaucgugaaccacuuccaccugggggacgacauggaccccgagcuccgcacgcuggcccagagccugaucgaccagaaggucaaggagaucuccaaccaggagccccucaagaucuga

SEQ ID NO: 6633 - RNA, 1293 nt, Artificial Sequence
  derived and/or modified CDS sequence (opt1) from TULV(Sennickerode Sen05/175)__EU439949.1__N
augagccagcugaaggagauccaggaggagaucacccgccacgagcagcagaucgugaucgcccggcagaagcucaaggacgccgagaagaccgucgaggcggaccccgacgacgugaacaaguccacgcugcagagccgccgggccgccguguccgcccuggaggacaagcucgccgacuucaagcgccagcuggcggaccuggucagcucccagaagaugggcgagaagcccguggaccccaccgggcucgagcccgacgaccaccugaaggagcggagcucccugcgcuacggcaacgugcucgacgucaacgccaucgacaucgacgagcccagcgggcagaccgccgacugguucuccaucggccaguacaucaucggguucgcccuggcgaucgugcugaaggcccucuacaugcugagcacccggggccgccagacgaucaaggagaacaagggcacccggauccgcuucaaggacgacuccagcuucgaggagaucaacgggauccggcgcccgaagcaccuguacguguccaugcccaccgcccagagcaccaugaaggccgacgagcucacgcccggccgguuccgcaccaucgucugcgggcuguuccccgcccagaucaugcaccggaacaucaucuccccggugaugggcgugaucggguucagcuucuucgucaaggacuggcccgacaagaucgaggaguuccugaucaagcccugccccuuccucaagaagcagggcggcccgaacaaggacgaggacuuccugguguccaacgacgcguacuuccuggggcgcgagaaggcccuccgggagagccaccugaacgagaucgacgaccugaucgagcucgccgccuccggcgaccccaccccgcccgacagcaucaagagcccccaggcccccuggguguucgcgugcgcccccgaccgcugcccgccgaccugcaucuacgucgccgggauggccgagcugggcgccuucuucuccauccugcaggacaugcgcaagagcaucauggcguccaagacggugggcaccgccgaggagaagcucaagaagaaguccagcuucuaccagagcuaccugcggcggacccaguccauggggauccagcuggaccagcgcaucauccuccuguucaugauggaguggggcagcgacaucgugaaccacuuccaccugggggacgacauggaccccgagcuccgcacccuggcccagucccugaucgaccagaaggucaaggagaucagcaaccaggagccccucaagaucuga

SEQ ID NO: 6634 - RNA, 1293 nt, Artificial Sequence
  derived and/or modified CDS sequence (opt1) from TULV(TUL/Karatal/Ma322/2003)__AM945877.1__N
augagccagcugaaggagauccaggaggagaucacccgccacgagcagcagaucgugaucgcccggcagaagcucaaggacgccgagaagaccgucgaggcggaccccgacgacgugaacaagaacacgcugcagucccgccgggccgccgugagcgcccuggaggacaagcucgccgaguucaagcgccagcuggcggaccuggucuccagccagaagaugggcgagaagcccguggaccccaccgggcucgagcccgacgaccaccugaaggagcgguccagccugcgcuacggcaacgugcucgacgucaacgccaucgacaucgacgagcccuccgggcagaccgccgacugguucagcaucggccaguacgugaugggguucgcccuggcgaucgugcugaaggcccucuacaugcuguccacccggggccgccagacgaucaaggagaacaagggcacccggauccgcuucaaggacgacagcuccuucgaggagaucaacgggauccggcgcccgaagcaccuguacgucagcaugcccaccgcccaguccaccaugaaggccgacgagcucacgcccggccgguuccgcaccaucgugugcgggcuguuccccgcccagaucaugcaccggaacaucaucagcccggugaugggcgucaucggguucuccuucuucgugaaggacuggcccgagaagaucgaggaguuccugaucaagcccugccccuuccucaagaagcagggcagcuccggcaaggaggaggaguuccuggugagcaacgacgcguaccugaucgggcgcgagaagacccuccaggagucccaccugaccgagaucgacgaccugaucgaccucgccgacagcggcgacccgacgccgcccgacagcaucaagagcccccaggcccccugggucuucgccugcgcccccgaccggugcccgccgaccugcaucuacaucgcggggauggccgagcugggcgccuucuucagcauccugcaggacaugcgcaacaccaucauggccuccaagaccgugggcacggccgaggagaagcucaagaagaaguccuccuucuaccagagcuaccugcggcgcacccaguccauggggauccagcuggaccagcggaucauccuccuguucaugauggaguggggcagcgacaucgugaaccacuuccaccugggggacgacauggaccccgagcuccgcacccuggcgcagucccugaucgaccagaaggucaaggagaucagcaaccaggagccccucaagaucuga

SEQ ID NO: 6635 - RNA, 1293 nt, Artificial Sequence
  derived and/or modified CDS sequence (opt1) from TULV(Tula/Kosice144/Ma/95)__Y13979.1__N
augagccagcugaaggagauccaggaggagaucacccgccacgagcagcagaucgugaucgcccggcagaagcucaaggacgccgagaagaccgucgaggcggaccccgacgacgugaacaaguccacgcugcagagccgccgggccgccguguccgcccuggaggacaagcucgccgacuucaagcgccagcuggcggaccuggucagcucccagaagaugggcgagaagcccguggaccccaccgggcucgagcccgacgaccaccugaaggagcggagcucccugcgcuacggcaacgugcucgacgucaacgccaucgacaucgacgagcccagcgggcagaccgccgacugguucuccaucggccaguacaucaucggguucgcccuggcgaucgugcugaaggcccucuacaugcugagcacccggggccgccagacgaucaaggagaacaagggcacccggauccgcuucaaggacgacuccagcuucgaggagaucaacgggauccggcgcccgaagcaccuguacguguccaugcccaccgcccagagcaccaugaaggccgacgagcucacgcccggccgguuccgcaccaucgucugcgggcuguuccccgcccagaucaugcaccggaacaucaucuccccggugaugggcgugaucggguucagcuucuucgucaaggacuggcccgagaagaucgaggaguuccugaucaagcccugccccuuccucaagaagcagggcgcgccgggcaaggaggaggacuuccugguguccaacgacgccuaccugcucgggcgcgagaaggcccugcgggagagccaccuggccgagaucgacgaccucaucgaccuggccgcguccggcgaccccaccccgcccgacagcaucaagagcccccaggcccccuggguguucgccugcgcccccgaccgcugcccgccgaccugcaucuacaucgccgggauggcggagcugggcgccuucuucuccauccuccaggacaugcggaacacgaucauggccagcaagaccgucggcaccgccgaggagaagcugaagaagaaguccagcuucuaccaguccuaccugcgccggacccagagcauggggauccagcucgaccagcgcaucauccugcuguucaugacggaguggggcuccgacaucgugaaccacuuccaccucggggacgacauggaccccgagcugcgcacccuggcccagagccucaucgaccagaaggugaaggagaucuccaaccaggagccccugaagaucuga

SEQ ID NO: 6636 - RNA, 1293 nt, Artificial Sequence
  derived and/or modified CDS sequence (opt1) from TULV(Tula/Kosice667/Ma/95)__Y13980.1__N
augagccagcugaaggagauccaggaggagaucacccgccacgagcagcagaucgugaucgcccggcagaagcucaaggacgccgagaagaccgucgaggcggaccccgacgacgugaacaaguccacgcugcagagccgccgggccgccguguccgcccuggaggacaagcucgccgacuucaagcgccagcuggcggaccuggucagcucccagaagaugggcgagaagcccguggaccccaccgggcucgagcccgacgaccaccugaaggagcggagcucccugcgcuacggcaacgugcucgacgucaacgccaucgacaucgacgagcccagcgggcagaccgccgacugguucuccaucggccaguacaucaucggguucgcccuggcgaucgugcugaaggcccucuacaugcugagcacccggggccgccagacgaucaaggagaacaagggcacccggauccgcuucaaggacgacuccagcuucgaggagaucaacgggauccggcgcccgaagcaccuguacguguccaugcccaccgcccagagcaccaugaaggccgacgagcucacgcccggccgguuccgcaccaucgucugcgggcuguuccccgcccagaucaugcaccggaacaucaucuccccggugaugggcgugaucggguucagcuucuucgucaaggacuggcccgagaagaucgaggaguuccugaucaagcccugccccuuccucaagaagcagggcgcgccgggcaaggaggaggacuuccugguguccaacgacgccuaccugcucgggcgcgagaaggcccugcgggagagccaccuggccgagaucgacgaccucaucgaccuggccgcguccggcgaccccaccccgcccgacagcaucaagagcccccaggcccccuggguguucgccugcgcccccgaccgcugcccgccgaccugcaucuacaucgccgggauggcggagcugggcgccuucuucuccauccuccaggacaugcgggacacgaucauggccagcaagaccgucggcaccgccgaggagaagcugaagaagaaguccagcuucuaccaguccuaccugcgccggacccagagcauggggauccagcucgaccagcgcaucauccugcuguucaugacggaguggggcuccgacaucgugaaccacuuccaccucggggacgacauggaccccgagcugcgcacccuggcccagagccucaucgaccagaaggugaaggagaucuccaaccaggagccccugaagaucuga

SEQ ID NO: 6637 - RNA, 1290 nt, Artificial Sequence
  derived and/or modified CDS sequence (opt1) from TULV(Tula/Koziky/5247Ma/94)__AJ223600.1__N
augagccagcugaaggagauccaggaggagaucacccgccacgagcagcagaucgugaucgcccggcagaagcucaaggacgccgagaagaccgucgaggcggaccccgacgacgugaacaaguccacgcugcagagccgccgggccgccguguccgcccuggaggacaagcucgccgacuucaagcgccagcuggcggaccuggucagcucccagaagaugggcgagaagccgguggaccccaccgggcucgagcccgacgaccaccugaaggagcggagcucccugcgcuacggcaacgugcucgacgucaacgccaucgacaucgacgagcccagcgggcagaccgccgacugguucuccaucggccaguacaucaccggguucgcccuggcgaucauccugaaggcccucuacaugcugagcacgcggggccgccagaccaucaaggagaacaagggcacccggauccgcuucaaggacgacuccagcuacgaggagaucaacgggauccggcgcccgaagcaccuguacguguccaugcccaccgcccagagcacgaugaaggccgacgagcucacccccggccgguuccgcaccaucgugugcgggcuguuccccgcccagaucaugcaccggaacaucaucuccccggucaugggcgugaucggguucagcuucuucgugaaggacuggcccgagaagaucgaggaguuccugaucaagcccugccccuuccucaagaagaacggcccguccaaggaggaggacuuccuggucagcaacgacgcguaccugcucggccgcgagaaggcccugcgggagucccaccuggccgagaucgacgaccucaucgaccuggccgccagcgaggaccccaccccgcccgacagcaucaagagcccccaggcgcccuggguguucgccugccgccccgaccggugcccgcccacgugcaucuacaucgccgggauggccgagcugggcgccuucuucuccauccuccaggacaugcgcaacaccaucauggcguccaagaccguggggaccgccgaggagaagcugaagaagaaguccagcuucuaccagagcuaccugcggcgcacgcaguccaugggcauccagcucgaccagcgcaucauccugcuguucaugaccgaguggggcagcgacaucgucaaccacuuccaccucggggacgacaugucccccgagcugcggacccuggcccagagccucaucgaccagaaggugaaggagaucuccaaccaggagccccugaagaucuga

SEQ ID NO: 6638 - RNA, 1290 nt, Artificial Sequence
  derived and/or modified CDS sequence (opt1) from TULV(Tula/Moravia/5302v/95)__Z69991.1__N
augagccagcugaaggagauccaggaggagaucacccgccacgagcagcagaucgugaucgcccggcagaagcucaaggacgucgagaagaccguggaggccgaccccgacgacgugaacaaguccacgcugcagagccgccgggcggccgucuccgcccuggaggacaagcucgccgacuucaagcgccagcuggccgaccuggugagcucccagaagaugggcgagaagccgguggaccccaccgggcucgagcccgacgaccaccugaaggagcggagcucccugcgcuacggcaacguccucgacgugaacgcgaucgacaucgacgagcccagcgggcagaccgccgacugguucuccaucggccaguacaucaccggguucgcccuggccaucauccugaaggcgcucuacaugcugagcacgcggggccgccagaccaucaaggagaacaagggcacccggauccgcuucaaggacgacuccagcuacgaggagaucaacgggauccggcgcccgaagcaccuguacguguccaugcccaccgcccagagcacgaugaaggccgacgagcucacccccggccgguuccgcaccaucgucugcgggcuguuccccgcccagaucauguaccggaacaucaucuccccggugaugggcgugaucggguucagcuucuucgucaaggacuggcccgagaagaucgaggaguuccugaucaagcccugccccuuccucaagaaguccggcccgagcaaggaggaggacuuccugguguccaacgacgccuaccugcucggccgcgagaaggcgcugcgggagagccaccuggccgagaucgacgaccucaucgaccuggccgccagcggggaccccaccccgcccgacuccaucaagagcccccaggcccccuggguguucgcgugccgccccgaccggugcccgcccacgugcaucuacaucgccggcauggccgagcugggggccuucuucuccauccuccaggacaugcgcaacaccaucauggccagcaagaccgucggcaccgcggaggagaagcugaagaagaaguccagcuucuaccaguccuaccugcggcgcacgcagagcaugggcauccagcucgaccagcgcaucauccugcuguucaugaccgaguggggguccgacaucgugaaccacuuccaccucggcgacgacauggaccccgagcugcggacccuggcccagagccucaucgaccagaaggugaaggagaucuccaaccaggagccccugaagaucuga

SEQ ID NO: 6639 - RNA, 1293 nt, Artificial Sequence
  derived and/or modified CDS sequence (opt1) from TULV__AF017659.1__N
augagccagcugaaggagauccaggaggagaucacccgccacgagcagcagaucgugaucgcccggcagaagcucaaggacgccgagaagaccgucgaggcggaccccgacgacgugaacaaguccacgcugcagagccgccgggccgccguguccgcccuggaggacaagcucgccgacuucaagcgccagcuggcggaccuggucagcucccagaagaugggcgagaagcccguggaccccaccgggcucgagcccgacgaccaccugaaggagcggagcucccugcgcuacggcaacgugcucgacgucaacgccaucgacaucgacgagcccagcgggcagaccgccgacugguucuccaucggccaguacaucaucggguucgcccuggcgaucgugcugaaggcccucuacaugcugagcacccggggccgccagacgaucaaggagaacaagggcacccggauccgcuucaaggacgacuccagcuucgaggagaucaacgggauccggcgcccgaagcaccuguacguguccaugcccaccgcccagagcaccaugaaggccgacgagcucacgcccggccgguuccgcaccaucgucugcgggcuguuccccgcccagaucaugcaccggaacaucaucuccccggugaugggcgugaucggguucagcuucuucgucaaggacuggcccgagaagaucgaggaguuccugaucaagcccugccccuuccucaagaagcagggcgcgccgggcaaggaggaggacuuccugguguccaacgacgccuaccugcucgggcgcgagaaggcccugcgggagagccaccuggccgagaucgacgaccucaucgaccuggccgcguccggcgaccccaccccgcccgacagcaucaagagcccccaggcccccuggguguucgccugcgcccccgaccgcugcccgccgaccugcaucuacgucgccgggauggcggagcugggcgccuucuucuccauccuccaggacaugcggaacacgaucauggccagcaagaccgugggcaccgccgaggagaagcugaagaagaaguccagcuucuaccaguccuaccugcgccggacccagagcauggggauccagcucgaccagcgcaucauccugcuguucaugacggaguggggcuccgacaucgugaaccacuuccaccucggggacgacauggaccccgagcugcgcacccuggcccagagccucaucgaccagaaggucaaggagaucuccaaccaggagccccugaagaucuga

SEQ ID NO: 6640 - RNA, 1293 nt, Artificial Sequence
  derived and/or modified CDS sequence (opt1) from TULV(Lodz-1)__AF063892.1__N
augaccgagcugaaggagauccaggaggagaucacccgccacgagcagcagaucgugaucgcccggcagaagcucaaggacgccgagaagacggucgaggcggaccccgacgacgugaacaagagcacccugcagucccgccgggccgccgugagcgcccuggaggacaagcucgccgacuucaagcgccagcuggcggaccuggucuccagccagaagaugggcgagaagccgguggaccccaccgggcucgagcccgacgaccaccugaaggagcgguccagccugcgcuacggcaacgugcucgacgucaacgccaucgacaucgacgagcccuccgggcagaccgccgacugguucagcaucggccaguacaucaugggguucgcccuggcgaucgugcugaaggcccucuacaugcuguccacgcggggccgccagaccaucaaggagaacaagggcacccggauccgcuucaaggacgacagcuccuacgaggagaucaacgggauccggcgcccgaagcaccuguacgugagcaugcccaccgcccaguccacgaugaaggccgacgagcucacccccggccgguuccgcaccaucgucugcgggcuguuccccgcccagaucaugcaccggaacaucaucagcccggugaugggcgugaucggguucuccuucuucgucaaggacuggcccgacaagaucgaggaguuccugaucaagcccugccccuuccucaagaagcagggcggcccgaacaaggacgaggaguuccuggugagcaacgacgcguaccugcucgggcgcgagaaggcccugcgggagucccaccuggccgagaucgacgaccucaucgaccuggccgccagcggcgaccccaccccgcccgacuccaucaagagcccccaggcgcccuggguguucgccugcgcccccgaccgcugcccgcccacgugcaucuacgucgccgggauggccgagcugggcgcguucuucagcauccuccaggacaugcggaacaccaucauggccuccaagaccgugggcaccgccgaggagaagcugaagaagaaguccagcuucuaccagagcuaccugcgccggacgcaguccauggggauccagcucgaccagcgcaucauccugcuguucaugauggaguggggcagcgacaucgugaaccacuuccaccucggggacgacauggaccccgagcugcgcacccuggcccagucccucaucgaccagaaggucaaggagaucagcaaccaggagccccugaagaucuga

SEQ ID NO: 6641 - RNA, 1293 nt, Artificial Sequence
  derived and/or modified CDS sequence (opt1) from TULV(Lodz-2)__AF063897.1__N
augaccgagcugaaggagauccaggaggagaucacccgccacgagcagcagaucgugaucgcccggcagaagcucaaggacgccgagaagacggucgaggcggaccccgacgacgugaacaagagcacccugcagucccgcugggccgccgugagcgcccuggaggacaagcucgccgacuucaagcggcagcuggcggaccuggucuccagccagaagaugggcgagaagccgguggaccccaccgggcucgagcccgacgaccaccugaaggagcgcuccagccugcgguacggcaacgugcucgacgucaacgccaucgacaucgacgagcccuccgggcagaccgccgacugguucagcaucggccaguacaucaugggguucgcccuggcgaucgugcugaaggcccucuacaugcuguccacgcgcggccggcagaccaucaaggagaacaagggcacccgcauccgguucaaggacgacagcuccuacgaggagaucaacgggauccgccggccgaagcaccuguacgugagcaugcccaccgcccaguccacgaugaaggccgacgagcucacccccggccgcuuccggaccaucgucugcgggcuguuccccgcccagaucaugcaccgcaacaucaucagcccggugaugggcgugaucggguucuccuucuucgucaaggacuggcccgacaagaucgaggaguuccugaucaagcccugccccuuccucaagaagcagggcggcccgaacaaggacgaggaguuccuggugagcaacgacgcguaccugcucgggcgggagaaggcccugcgcgagucccaccuggccgagaucgacgaccucaucgaccuggccgccagcggcgaccccaccccgcccgacuccaucaagagcccccaggcgcccuggguguucgccugcgcccccgaccggugcccgcccacgugcaucuacgucgccgggauggccgagcugggcgcguucuucagcauccuccaggacaugcgcaacaccaucauggccuccaagaccgugggcaccgccgaggagaagcugaagaagaaguccagcuucuaccagagcuaccugcggcgcacgcaguccauggggauccagcucgaccagcggaucauccugcuguucaugauggaguggggcagcgacaucgugaaccacuuccaccucggggacgacauggaccccgagcugcgcacccuggcccagucccucaucgaccagaaggucaaggagaucagcaaccaggagccccugaagaucuga

SEQ ID NO: 6642 - RNA, 1449 nt, Artificial Sequence
  derived and/or modified CDS sequence (opt1) from CCHFV(IbAr10200)__NC_005302.1/U88410.1__N
auggagaacaagaucgaggugaacaacaaggacgagaugaaccgcugguucgaggaguucaagaagggcaacgggcuggucgacaccuucaccaacagcuacuccuucugcgagagcgugcccaaccucgaccgguucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgacgugcccaagaucgagcagcugaccggguaccagcaggccgcccugaaguggcgcaaggacaucggcuuccgggugaacgcgaacaccgccgcccucagcaacaagguccuggccgaguacaaggugcccggcgagaucgugauguccgucaaggagaugcugagcgacaugauccgccggcgcaaccucauccugaaccgcgggggcgacgagaacccccgggggccggugucccacgagcacguggacuggugccgggaguucgucaagggcaaguacaucauggccuucaacccgcccuggggcgacaucaacaagagcgggcgcuccggcaucgcgcugguggccaccgggcucgccaagcuggccgagacggagggcaaggggaucuucgacgaggccaagaagaccguggaggcgcugaacggcuaccucgacaagcacaaggacgaggucgaccgggccagcgccgacuccaugaucaccaaccugcugaagcacaucgccaaggcccaggagcucuacaagaacagcuccgcgcugcgcgcccagagcgcccagaucgacaccgccuucagcuccuacuacuggcuguacaaggccggcgugacgcccgagaccuuccccaccgugagccaguuccucuucgagcuggggaagcagccccggggcaccaagaagaugaagaaggcgcugcucuccacgcccaugaagugggggaagaagcuguacgagcuguucgccgacgacagcuuccagcagaaccgcaucuacaugcaccccgccguccucaccgccggccggaucuccgagaugggggugugcuucggcaccaucccgguggcgaaccccgacgacgccgcccagggcagcgggcacaccaaguccauccugaaccugcgcacgaacaccgagaccaacaaccccugcgccaagaccaucgucaagcuguucgaggugcagaagacgggcuucaacauccaggacauggacaucgucgccagcgagcaccuccugcaccagucccucguggggaagcagagccccuuccagaacgcguacaacgugaagggcaacgccaccuccgccaacaucaucuga

SEQ ID NO: 6643 - RNA, 1449 nt, Artificial Sequence
  derived and/or modified CDS sequence (opt1) from CCHFV(Turkey-Kelkit06)__GQ337053.1__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaaggacagcggcaccaucaaguccugggacgagaacuacgccgagcucaagguggacguccccaagaucgagcagcuggccaacuaccagcaggccgcgcugaaguggcgcaaggacaucggguuccgggugaacgccaacacggccgcccucagcaacaaggugcuggccgaguacaagguccccggcgagaucgugauguccgugaaggagaugcugagcgacaugauccgccggcgcaaccucauccugaaccggggcggggacgagaacccccgcggcccggucucccgggagcacguggaguggugccgcgaguucgugaaggggaaguacaucauggcguucaacccgcccuggggcgacaucaacaagagcgggcgguccggcaucgcccuggucgccaccggccucgccaagcuggccgagaccgaggggaagggcguguucgacgaggcgaagaagaccguggaggcccugaacggguaccucgacaagcaccgcgacgaggucgacaaggccagcgccgacuccaugaucacgaaccugcccaagcacaucgccaaggcgcaggagcuguacaagaacagcuccgcccuccgggcccagggcgcccagaucgacacccccuucagcagcuucuacuggcuguacaaggccggcgugacccccgagaccuuccccacgaucucccaguuccuguucgagcucggggagcagccccgcggcaccaagaagaugaagaaggcgcugcugagcaccccgaugaagugggggaagaagcucuacgagcuguucgccgacgacuccuuccagcagaaccggaucuacaugcaccccgccgugcugaccgccggccgcaucagcgagaugggggucugcuucggcacgauccccguggcgaaccccgacgacgccgcccagggcuccgggcacaccaagagcauccucaaccugcggaccuccaccgagacgaacaacccgugcgccaagaccaucgugaagcuguucgagauccaggagaccggcuucaacauccaggacauggacaucgucgccagcgagcaccuccugcaccaguccaucguggggaagcagagccccuuccagaacgcguacaacgucaagggcaacgccaccuccgccaacaucaucuga

SEQ ID NO: 6644 - RNA, 1449 nt, Artificial Sequence
  derived and/or modified CDS sequence (opt1) from CCHFV(Baghdad 12)__AJ538196.1__N
auggagaacaagaucgaggugaacagcaaggacgagaugaacaagugguucgaggaguucaagaagggcaacgggcuggucgacaccuacaccaacuccuacagcuucugcgaguccgugcccaaccucgaccgcuucguguuccagauggccggcgccacggacgacgcgcagaaggacagcaucuacgccuccgcccuggucgaggccaccaaguucugcgccccgaucuacgagugcgcgugggccagcuccaccgggaucgugaagaagggccuggagugguucgagaagaacaccgggacgaucaagagcugggacgaguccuacaccgagcucaagguggagguccccaagaucgagcagcuguucaacuaccagcaggccgcccugaaguggcggaaggacaucggcuuccgcgugaacgcgaacaccgccgcccucagcaacaaggugcuggccgaguacaagguccccggcgagaucgugauguccgugaaggagaugcugagcgacaugauccggcgccggaaccucauccugaaccgcgggggcgacgagaacccccgggggccggucucccgcgagcacguggaguggugccgggaguucgugaagggcaaguacaucauggccuucaacccgcccuggggcgacaucaacaagagcgggcgcuccggcaucgcgcuggucgccaccgggcucgccaagcuggccgagacggagggcaaggggguguucgacgaggccaagaagaccguggaggcgcugaacggcuaccucgacaagcacaaggacgaggucgacaaggccagcgccgacaacauggugaccaaccugcugaagcacguggccaaggcccaggagcucuacaagaacuccagcgcgcugcgggcccagggcgcccagaucgacaccgucuucuccagcuacuacuggcuguacaaggccggggugacgcccgagaccuuccccaccgugagccaguuccucuucgagcugggcaagcacccccgcgggaccaagaagaugaagaaggcccugcucuccacgcccaugaaguggggcaagaagcuguacgagcuguucgcggacgacagcuuccagcagaaccggaucuacaugcaccccgccguccucaccgccgggcgcaucuccgagaugggcgugugcuucggcaccaucccggucgccaaccccgacgacgcggcccuggggagcggccacaccaaguccauccugaaccuccggacgaacaccgagaccaacaaccccugcgcccgcaccaucgugaagcuguucgagauccagaagacgggguucaacauccagcacauggacaucguggccagcgagcaccuccugcaccagucccuggucggcaagcagagccccuuccagaacgccuacaacgugaaggggaacgcgaccuccgccaacaucaucuga

SEQ ID NO: 6645 - RNA, 1449 nt, Artificial Sequence
  derived and/or modified CDS sequence (opt1) from CCHFV(SR3)__AJ538198.1__N
auggagaacaagaucgaggugaacagcaaggacgagaugaacaagugguucgaggaguucaagaagggcaacgggcuggucgacaccuucaccaacuccuacagcuucugcgaguccgugcccaaccucgaccgcuucguguuccagauggccagcgccacggacgacgcgcagaaggacuccaucuacgccagcgcccuggucgaggccaccaaguucugcgccccgaucuacgagugcgcgugggccuccagcaccggcaucgugaagaaggggcuggagugguucgagaagaacgccggcaccaucaaguccugggacgagagcuacacggagcucaagguggagguccccaagaucgagcagcuguccaacuaccagcaggccgcgcugaaguggcggaaggacaucggguuccgcgugaacgccaacaccgccgcccucagcaacaaggugcuggccgaguacaagguccccggcgagaucgugauguccgugaaggagaugcugagcgacaugauccggcgccggaaccucauccugaaccgcggcggggacgagaacccccggggcccggucucccgcgagcacguggaguggugccgggaguucgugaaggggaaguacaucauggcguucaacccgcccuggggcgacaucaacaagagcgggcgcuccggcaucgcccuggucgccaccggccucgccaagcuggccgagaccgaggggaagggcguguucgacgaggcgaagaagacgguggaggcccugaacggguaccucgacaagcacaaggacgaggucgacaaggccagcgccgacuccaugaucaccaaccugcugaagcacaucgccaaggcgcaggagcucuacaagaacagcagcgcccugcgggcccagggcgcccagaucgacaccguguucuccagcuacuacuggcuguacaaggccggcgugacccccgacacguuccccgcggucucccaguuccucuucgagcuggggaagcagccccgcggcaccaagaagaugaagaaggcccugcucagcacccccaugaagugggggaagaagcuguacgagcuguucgccgacgacuccuuccagcagaaccggaucuacaugcaccccgccgugcucaccgcgggccgcaucagcgagaugggggugugcuucggcacgaucccggucgccaaccccgacgacgccgcccugggcuccgggcacaccaagagcauccugaaccuccggaccaacaccgagacgaacaaccccugcgccaagaccaucgugaagcuguucgagauccagaagaccggcuucaacauccaggacauggacaucgucgcguccgagcaccuccugcaccagagccugguggggaagcagucccccuuccagaacgccuacaacgugaagggcaacgccaccagcgccaacaucaucuga

SEQ ID NO: 6646 - RNA, 1449 nt, Artificial Sequence
  derived and/or modified CDS sequence (opt1) from CCHFV(Gaib)__KX013446.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccaacuaccagcaggccgcgcugaaguggcggaaggacaucggguuccgcgugaacgccaacaccgccgcccucagccacaagguccuggccgaguacaaggugcccggcgagaucgugauguccgucaaggagaugcugagcgacaugauccggcgccggaaccucauccugaaccgcggcggggacgagaacccccggggcccggugucccgcgagcacguggaguggugccgggaguucgucaaggggaaguacaucauggcguucaacccgcccuggggcgacaucaacaagagcgggcgcuccggcaucgcccugguggccaccggccucgccaagcuggccgagaccgaggggaagggcguguucgacgaggcgaagaagacggucgaggcccugaacggguaccucgacaagcacaaggacgagguggacaaggccagcgccgacaacaugaucaccaaccugcugaagcacaucgccaaggcgcaggagcucuacaagaacuccagcgcccugcgggcccagggcgcccagaucgacaccgccuucuccagcuacuacuggcuguacaaggcgggcgugacccccgagacguuccccaccgucagccaguuccucuucgagcuggggaagcagccccgcggcaccaagaagaugaagaaggcccugcucuccacccccaugaagugggggaagaagcuguacgagcuguucgccgacgacagcuuccagcagaaccggaucuacaugcaccccgccgugcucacggcgggccgcaucuccgagaugggggugugcuucggcaccaucccggucgccaaccccgacgacgccgcccagggcagcgggcacaccaaguccauccugaaccugcggaccaacacggagaccaacaaccccugcgccaagaccaucgugaagcuguucgagauccagaagaccggcuucaacauccaggacauggacaucgucgcgagcgagcaccuccugcaccagucccucguggggaagcagagccccuuccagaacgccuacaacgugaagggcaacgccacguccgccaacaucaucuga

SEQ ID NO: 6647 - RNA, 1449 nt, Artificial Sequence
  derived and/or modified CDS sequence (opt1) from CCHFV(Hodzha)__KX013449.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccaacuaccagcaggccgcgcugaaguggcggaaggacaucggguucugcgugaacgccaacaccgccgcccucagccagaagguccuguccgaguacaaggugcccggcgagaucgugaugagcgucaaggagaugcuguccgacaugauccgccggcgcaaccucauccugaaccggggcggggacgagaacccccgcggcccggugagccgggagcacguggaguggugccgcgaguucgucaaggggaaguacaucauggccuucaacccgcccuggggcgacaucaacaaguccgggcggagcggcaucgcgcugguggccaccggccucgccaagcuggccgagaccgaggggaagggcguguucgacgaggccaagaagacggucgaggcgcugaacggguaccucgacaagcacaaggacgagguggacaaggccuccgccgacaacaugaccaccaaccugcugaagcacaucgccaaggcccaggagcucuacaagaacagcuccgcgcugcgcgcccagggcgcccagaucgacaccgccuucagcagcuacuacuggcuguacaaggccggcgugacgcccgagaccuuccccaccgucucccaguuccucuucgagcuggggaagcagccccggggcaccaagaagaugaagaaggcgcugcucagcacgcccaugaagugggggaagaagcuguacgagcuguucgccgacgacuccuuccagcagaaccgcaucuacaugcaccccgccgugcucaccaccggccggaucagcgagaugggggugugcuucggcaccgucccgguggccgaccccgacgacgcggcccagggcuccgggcacaccaagagcauccugaaccugcgcacgaacaccgagaccaacaaccccugcgccaagacgaucgucaagcuguucgagauccagaagaccggcuucaacauccaggacauggacaucguggccuccgagcaccuccugcaccagagccucguggggaagcagucccccuuccagaacgccuacaacgucaagggcaacgcgaccagcgccaacaucaucuga

SEQ ID NO: 6648 - RNA, 1449 nt, Artificial Sequence
  derived and/or modified CDS sequence (opt1) from CCHFV(IbAn7620)__KX013452.1__N
auggagaacaagaucgaggugaacaacaaggacgagaugaaccgcugguucgaggaguucaagaaggagaacggccuggucgacaccuucaccaacagccacuccuucugcgagagcgugcccaaccucgacaaguucguguuccagauggccuccgccacggacgacgcgcagaaggacagcaucuacgccgccgcccuggucgaggccaccaaguucugcgcgccgaucuacgagugcgccuggguguccagcaccgggaucgugaagaagggccuggagugguucgagaagaacgccgggaccaucaaguccugggacgagagcuacacggagcucaaggucgaggugcccaagaucgagcagcuguccaacuaccagcaggccgcgcugaaguggcggaaggacaucggcuuccgcgugaacgccaacaccgccacccucagccacaagguccuggccgaguacaaggugcccggggagaucgugauguccgucaaggagaugcugagcgacaugauccggcgccggaaccucauccugaaccgcggcggcgacgagaacccccgggggccggugucccgcgagcacguggaguggugccgggaguucgucaagggcaaguacaucauggccuucaacccgcccuggggcgacaucaacaagagcgggcgcuccgggaucgcgcugguggccaccggccucgccaagcuggccgaggccgagggcaaggggguguucgacgaggcgaagaagacggucgaggcccugaacggcuaccucgacaagcacaaggacgagguggacaagagcuccgccgacagcaugaucaccaaccugcugaagcacaucgccaaggcccaggagcucuacaagaacuccagcgcgcugcgggcccagggggcccagaucgacaccgccuucagcuccuacuacuggcuguacaaggccggcgugacccccgagacguuccccaccgucagccaguuccucuucgagcugggcaagcagccccgcgggaccaagaagaugaagaaggcgcugcucuccacccccaugaaguggggcaagaagcuguacgagcuguucgccgacgacagcuuccagcagaaccggaucuacaugcaccccgccgugcucacggccgggcgcaucuccgagaugggcgugugcuucgggaccaucccggucgcgaaccccgacgacgccgcccugggcagcggccacaccaaguccauccugaaccuccggaccagcacggaggccaacaaccccugcgccaagaccaucgugaagcuguucgagauccagaagaagggguucgucaucaaggacauggacaucguggcguccgagcaccuccugcaccagagccuggugggcaagcagucccccuuccagaacgccuacaacgucaaggggaacgccaccagcgccaacaucaucuga

SEQ ID NO: 6649 - RNA, 1449 nt, Artificial Sequence
  derived and/or modified CDS sequence (opt1) from CCHFV(K128_76)__KX013455.1__N
auggagaacaagaucgaggugaacaacaaggacgagaugaacaagugguucgaggaguucaagaagggcaacgggcuggucgacaccuucaccaacagcuacuccuucugcgagagcgugcccucccucgaccgcuucguguuccagauggccagcgccacggacgacgcgcagaaggacuccaucuacgccagcgcccuggucgaggccaccaaguucugcgccccgaucuacgagugcgcguggguguccagcaccggcaucgugaagaaggggcuggagugguucgagaagaacgccggcaccaucaaguccugggacgagagcuacacggagcucaaggucgaggugcccaagaucgagcagcuggccaacuaccagcaggccgcgcugaaguggcggaaggacaucggguuccgcgugaacgccaacaccgccgcccucucccacaagguccuggccgaguacaaggugcccggcgagaucgugaugagcgucaaggagaugcuguccgacaugauccggcgccggaaccucauccugaaccgcggcggggacgagaacccccggggcccggugagccgcgagcacguggaguggugccgggaguucgucaaggggaaguacaucauggcguucaacccgcccuggggcgacaucaacaaguccgggcgcagcggcaucgcccugguggccaccggccucgccaagcuggccgagaccgaggggaagggcguguucgacgaggcgaagaagacggucgaggcccugaacggguaccucgacaagcacaaggacgagguggacaaggccuccgccgacaacaugaucaccaaccugcugaagcacaucgccaaggcgcaggagcucuacaagaacagcuccgcccugcgggcccagggcgcccagaucgacaccgccuucagcagcuacuacuggcuguacaaggcgggcgugacccccgagacguuccccaccgucucccaguuccucuucgagcuggggaagcagccccgcggcaccaagaagaugaagaaggcccugcucagcacccccaugaagugggggaagaagcuguacgagcuguucgccgacgacuccuuccagcagaaccggaucuacaugcaccccgccgugcucacggcgggccgcaucagcgagaugggggugugcuucggcaccaucccggucgccaaccccgacgacgccgcccagggcuccgggcacaccaagagcauccugaaccugcggaccaacacggagaccaacaaccccugcgccaagaccaucgugaagcuguucgagauccagaagaccggcuucaacauccaggacauggacaucgucgcguccgagcaccuccugcaccagagccucguggggaagcagucccccuuccagaacgccuacaacgugaagggcaacgccacgagcgccaacaucaucuga

SEQ ID NO: 6650 - RNA, 1449 nt, Artificial Sequence
  derived and/or modified CDS sequence (opt1) from CCHFV(K168_125)__KX013461.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccaacuaccagcaggccgcgcugaaguggcggaaggacaucggguuccgcgugaacgccaacaccgccgcccucagccacaagguccuggccgaguacaaggugcccggcgacaucgugauguccgucaaggagaugcugagcgacaugauccggcgccggaaccucauccugaaccgcggcggggacgagaacccccggggcccggugucccgcgagcacguggaguggugccgggaguucgucaaggggaaguacaucauggcguucaacccgcccuggggcgacaucaacaagagcgggcgcuccggcaucgcccugguggccaccggccucgccaagcuggccgagaccgaggggaagggcguguucgacgaggcgaagaagacggucgaggcccugaacggguaccucgacaagcacaaggacgagguggacaaggccagcgccgacaacaugaucaccaaccugcugaagcacaucgccaaggcgcaggagcucuacaagaacuccagcgcccugcgggcccagggcgcccagaucgacaccgccuucuccagcuacuacuggcuguacaaggcgggcgugaccagcgagacguuccccaccgucucccaguuccucuucgagcuggggaagcagccccgcggcaccaagaagaugaagaaggcccugcucagcacccccaugaagugggggaagaagcuguacgagcuguucgccgacgacuccuuccagcagaaccggaucuacaugcaccccgccgugcucacggcgggccgcaucagcgagaugggggugugcuucggcaccauccccgucgccaacccggacgacgccgcccagggcuccgggcacaccaagagcauccugaaccugcggaccaacacggagaccaacaaccccugcgccaagaccaucgugaagcuguucgagauccagaagaccggcuucaacauccaggacauggacaucgucgcguccgagcaccuccugcaccagagccucguggggaagcagucccccuuccagaacgccuacaacgugaagggcaacgccacgagcgccaacaucaucuga

SEQ ID NO: 6651 - RNA, 1449 nt, Artificial Sequence
  derived and/or modified CDS sequence (opt1) from CCHFV(K168_40)__KX013458.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccaacuaccagcaggccgcgcugaaguggcggaaggacaucggguuccgcgugaacgccaacaccgccgcccucagccacaagguccuggccgaguacaaggugcccggcgacaucgugauguccgucaaggagaugcugagcgacaugauccggcgccggaaccucauccugaaccgcggcggggacgagaacccccggggcccggugucccgcgagcacguggaguggugccgggaguucgucaaggggaacuacaucauggcguucaacccgcccuggggcgacaucaacaagagcgggcgcuccggcaucgcccugguggccaccggccucgccaagcuggccgagaccgaggggaagggcguguucgacgaggcgaagaagacggucgaggcccugaacggguaccucgacaagcacaaggacgagguggacaaggccagcgccgacaacaugaucaccaaccugcugaagcacaucgccaaggcgcaggagcucuacaagaacuccagcgcccugcgggcccagggcgcccagaucgacaccgccuucuccagcuacuacuggcuguacaaggcgggcgugaccagcgagacguuccccaccgucucccaguuccucuucgagcuggggaagcagccccgcggcaccaagaagaugaagaaggcccugcucagcacccccaugaagugggggaagaagcuguacgagcuguucgccgacgacuccuuccagcagaaccggaucuacaugcaccccgccgugcucacggcgggccgcaucagcgagaugggggugugcuucggcaccauccccgucgccaacccggacgacgccgcccagggcuccgggcacaccaagagcauccugaaccugcggaccaacacggagaccaacaaccccugcgccaagaccaucgugaagcuguucgagauccagaagaccggcuucaacauccaggacauggacaucgucgcguccgagcaccuccugcaccagagccucguggggaagcagucccccuuccagaacgccuacaacgugaagggcaacgccacgagcgccaacaucaucuga

SEQ ID NO: 6652 - RNA, 1449 nt, Artificial Sequence
  derived and/or modified CDS sequence (opt1) from CCHFV(K323_27)__KX013473.1__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaagaacagcggcaccaucaaguccugggacgagaacuacgccgagcucaagguggacguccccaagaucgagcagcuggccaacuaccagcaggccgcgcugaaguggcgcaaggacaucggguuccgggugaacgccaacacggccgcccucagcaacaaggugcuggccgaguacaagguccccggcgagaucgugauguccgugaaggagaugcugagcgacaugauccgccggcgcaaccucauccugaaccggggcggggacgagaacccccgcggcccggucucccgggagcacguggaguggugccgcgaguucgugaaggggaaguacaucauggcguucaacccgcccuggggcgacaucaacaagagcgggcgguccggcaucgcccuggucgccaccggccucgccaagcuggccgagaccgaggggaagggcguguucgacgaggcgaagaagaccguggaggcccugaacggguaccucgacaagcaccgcgacgaggucgacaaggccagcgccgacuccaugaucacgaaccugcugaagcacaucgccaaggcgcaggagcucuacaagaacagcuccgcccugcgggcccagggcgcccagaucgacacccccuucagcagcuucuacuggcuguacaaggccggcgugacccccgagaccuuccccacgaucucccaguuccucuucgagcuggggaagcagccccgcggcaccaagaagaugaagaaggcgcugcucagcacccccaugaagugggggaagaagcuguacgagcuguucgccgacgacuccuuccagcagaaccggaucuacaugcacccggccgugcucaccgccggccgcaucagcgagaugggggucugcuucggcacgauccccguggcgaaccccgacgacgccgcccagggcuccgggcacaccaagagcauccugaaccugcggaccuccaccgagacgaacaaccccugcgccaagaccaucgugaagcuguucgagauccagaagaccggcuucaacauccaggacauggacaucgucgccagcgagcaccuccugcaccagucccucguggggaagcagagcccguuccagaacgcguucaacgucaagggcaacgccaccuccgccaacaucaucuga

SEQ ID NO: 6653 - RNA, 1449 nt, Artificial Sequence
  derived and/or modified CDS sequence (opt1) from CCHFV(Min)__KX013482.1__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaagaacagcggcaccaucaaguccugggacgagaacuacgccgagcucaagguggacguccccaagaucgagcagcuggccaacuaccagcaggccgcgcugaaguggcgcaaggacaucggguuccgggugaacgccaacacggccgcccucagcaacaaggugcuggccgaguacaagguccccggcgagaucgugauguccgugaaggagaugcugagcgacaugauccgccggcgcaaccucauccugaaccggggcggggacgagaacccccgcggcccggucucccgggagcacguggaguggugccgcgaguucgugaaggggaaguacaucauggcguucaacccgcccuggggcgacaucaacaagcuggggcggagcggcaucgcccucgucgccaccggccuggccaagcuggccgagaccgaggggaagggcguguucgacgaggcgaagaagaccguggaggcccucaacggguaccuggacaagcaccgcgacgaggucgacaaggccuccgccgacagcaugaucacgaaccugcucaagcacaucgccaaggcgcaggagcuguacaagaacuccagcgcccugcgggcccagggcgcccagaucgacacccccuucuccagcuucuacuggcucuacaaggccggcgugacccccgagaccuuccccacgaucagccaguuccuguucgagcuggggaagcagccccgcggcaccaagaagaugaagaaggcgcuccuguccacccccaugaagugggggaagaagcuguacgagcuguucgccgacgacagcuuccagcagaaccggaucuacaugcacccggccgugcugaccgccggccgcaucuccgagaugggggucugcuucggcacgauccccguggcgaaccccgacgacgccgcccagggcagcgggcacaccaaguccauccugaaccuccggaccagcaccgagacgaacaaccccugcgccaagaccaucgugaagcuguucgagauccagaagaccggcuucaacauccaggacauggacaucgucgccuccgagcaccuccuccaccagagccugguggggaagcaguccccguuccagaacgcguacaacgucaagggcaacgccaccagcgccaacaucaucuga

SEQ ID NO: 6654 - RNA, 1449 nt, Artificial Sequence
  derived and/or modified CDS sequence (opt1) from CCHFV(Saf)__KX013488.1__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaagaacagcggcaccaucaaguccugggacgagaacuacgccgagcucaagguggacguccccaagaucgagcagcuggccaacuaccagcaggccgcgcugaaguggcgcaaggacaucggguuccgggugaacgccaacacggccgcccucagcaacaaggugcuggccgaguacaagguccccggcgagaucgugauguccgugaaggagaugcugagcgacaugauccgccggcgcaaccucauccugaaccggggcggggacgagaacccccgcggcccggucucccgggagcacguggaguggugccgcgaguucgugaaggggaaguacaucauggcguucaacccgcccuggggcgacaucaacaagagcgggcgguccggcaucgcccuggucgccaccggccucgccaagcuggccgagaccgaggggaagggcguguucgacgaggcgaagaagaccguggaggcccugaacggguaccucgacaagcaccgcgacgaggucgacaaggccagcgccgacuccaugaucacgaaccugcugaagcacaucgccaaggcgcaggagcucuacaagaacagcuccgcccugcgggcccagggcgcccagaucgacacccccuucagcagcuucuacuggcuguacaaggccggcgugacccccgagaccuuccccacgaucucccaguuccucuucgagcuggggaagcagccccgcggcaccaagaagaugaagaaggcgcugcucagcacccccaugaagugggggaagaagcuguacgagcuguucgccgacgacuccuuccagcagaaccggaucuacaugcacccggccgugcucaccgccggccgcaucagcgagaugggggucugcuucggcacgauccccguggcggaccccgacgacgccgcccagggcuccgggcacaccaagagcauccugaaccugcggaccuccaccgagacgaacaaccccugcgcccgcaccaucgugaagcuguucgagauccagaagaccggcuucaacauccaggacauggacaucgucgccagcgagcaccuccugcaccagucccucguggggaagcagagcccguuccagaacgcguacaacgucaagggcaacgccaccuccgccaacaucaucuga

SEQ ID NO: 6655 - RNA, 1449 nt, Artificial Sequence
  derived and/or modified CDS sequence (opt1) from CCHFV(UCCR4459)__KY484031.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccggguaccagcaggccgcgcugaaguggcggaaggacaucggcuuccgcgugaacgccaacaccgccgcccucagccacaagguccuggccgaguacaaggugcccggcgagaucgugauguccgucaaggagaugcugagcgacaugauccggcgccggaaccucauccugaaccgcgggggcgacgagaacccccgggggccggugucccgcgagcacguggaguggugccgggaguucgucaagggcaaguacaucauggcguucaacccgcccuggggcgacaucaacaagcuggggcgcagcggcaucgcccucguggccaccgggcuggccaagcuggccgagaccgagggcaaggggguguucgacgaggcgaagaagacggucgaggcccucaacggcuaccuggacaagcacaaggacgagguggacaaggccuccgccgacaacaugaucaccaaccugcucaagcacaucgccaaggcgcaggagcuguacaagaacagcuccgcccugcgggcccagggcgcccagaucgacaccgccuucagcuccuacuacuggcucuacaaggcgggggugacccccgagacguuccccaccgucagccaguuccuguucgagcugggcaagcagccccgcgggaccaagaagaugaagaaggcccuccugagcacccccaugaaguggggcaagaagcuguacgagcuguucgccgacgacuccuuccagcagaaccggaucuacaugcaccccgccgugcugacggcggggcgcaucagcgagaugggcgugugcuucggcaccaucccggucgccaaccccgacgacgccgcccagggguccggccacaccaagagcauccugaaccuccggaccaacacggagaccaacaaccccugcgccaagaccaucgugaagcuguucgagauccagaagaccggguucaacauccaggacauggacaucgucgcguccgagcaccuccuccaccagagccuggugggcaagcagucccccuuccagaacgccuacaacgugaaggggaacgccacgagcgccaacaucaucuga

SEQ ID NO: 6656 - RNA, 1449 nt, Artificial Sequence
  derived and/or modified CDS sequence (opt1) from CCHFV(YL16070)__KY354080.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccgacuaccagcaggccgcgcugaaguggcggaaggacaucggguuccgcgugaacgccaacaccaccgcccucagccacaagguccuggccgaguacaaggugcccggcgagaucgugauguccgucaaggagaugcugagcgacaugauccggcgccggaaccucauccugaaccgcggcggggacgagaacccccggggcccggugucccgcgagcacguggaguggugccgggaguucgucaaggggaaguacaucauggccuucaacccgcccuggggcgacaucaacaagagcgggcgcuccggcaucgcgcugguggccaccggccucgccaagcuggccgagacggaggggaagggcguguucgacgaggccaagaagaccgucgaggcgcugaacggguaccucaacaagcacaaggacgagguggacaaggccagcgccgacuccaugaucaccaaccugcugaagcacaucgccaaggcccaggagcucuacaagaacagcuccgcgcugcgggcccagggcgcccagaucgacaccgccuucagcagcuacuacuggcuguacaaggccggcgugacgcccgagaccuuccccaccgucucccaguuccucuucgagcuggggaagcagccccgcggcaccaagaagaugaagaaggcgcugcucagcacgccccugaagugggggaagcggcuguacgagcuguucgccgacgacuccuuccagcagaaccgcaucuacaugcaccccgccgugcugaccgccggccggaucagcgagaugggggugugcuucggcaccaucccggucgcgaaccccgacgacgccgcccagggcuccgggcacaccaagagcauccugaaccuccgcacgaacaccgagaccaacaaccccugcgccaagaccaucgugaagcuguucgagauccagaagacgggcuucaacauccaggacauggacaucgucgccuccgagcaccuccuccaccagagccugguggggaagcagucccccuuccagaacgcguacaacgugaagggcaacgccaccagcgccaacaucaucuga

SEQ ID NO: 6657 - RNA, 1449 nt, Artificial Sequence
  derived and/or modified CDS sequence (opt1) from CCHFV(66019)__AJ010648.1__N
auggagaacaagaucgaggugaacaacaaggacgagaugaaccgcugguucgaggaguucaagaagggcaacgggcuggucgacaccuucaccaacagcuacuccuucugcgagagcgugcccaaccucgaccgguucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccagcuaccagcaggccgcgcugaaguggcgcaaggacaucggguuccgggugaacgccaacaccgccgcccucucccacaagguccuggccgaguacaaggugcccggcgagaucgugaugagcgucaaggagaugcuguccgacaugauccgccggcgcaaccucauccugaaccggggcggggacgagaacccccgcggcccggugagccgggagcacguggaguggugccgcgaguucgucaaggggaaguacaucauggcguucaacccgcccuggggcgacaucaacaaguccgggcggagcggcaucgcccugguggccaccggccucgccaagcuggccgagaccgaggggaagggcguguucgacgaggcgaagaagacggucgaggcccugaacggguaccucgacaagcacaaggacgagguggacaaggccuccgccgacaacaugaccaccaaccugcugaagcacaucgccaaggcgcaggagcucuacaagaacagcuccgcccugcgcgcccagggcgcccagaucgacaccgccuucagcagcuacuacuggcuguacaaggcgggcgugacgcccgagaccuuccccaccgucucccaguuccucuucgagcuggggaagcagccccggggcaccaagaagaugaagaaggcccugcucagcacgcccaugaagugggggaagaagcuguacgagcuguucgccgacgacuccuuccagcagaaccgcaucuacaugcaccccgccgugcucaccgcgggccggaucagcgagaugggggugugcuucggcaccaucccggucgccgaccccgacgacgccgcccagggcuccgggcacaccaagagcauccugaaccugcgcacgaacaccgagaccaacaaccccugcgccaagaccaucgugaagcuguucgagauccagaagacgggcuucaacauccaggacauggacaucgucgcguccgagcaccuccugcaccagagccucguggggaagcagucccccuuccagaacgccuacaacgugaagggcaacgccaccagcgccaacaucaucuga

SEQ ID NO: 6658 - RNA, 1449 nt, Artificial Sequence
  derived and/or modified CDS sequence (opt1) from CCHFV(8402)__AJ010649.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgagcgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccaacuaccagcaggccgcgcugaaguggcggaaggacaucggguuccgcgugaacgccaacaccgccgcccucagccacaagguccuggccgaguacaaggugcccggcgagaucgugauguccgucaaggagaugcugagcgacaugauccggcgccggaaccucauccugaaccgcggcggggacgagaacccccggggcccggugucccgcgagcacguggaguggugccgggaguucgucaaggggaaguacaucauggcguucaacccgcccuggggcgacaucaacaagagcgggcgcuccggcaucgcccugguggccaccggccucgccaagcuggccgagaccgaggggaagggcguguucgacgaggcgaagaagacggucgaggcccugaacggguaccucgacaagcacaaggacgagguggacaaggccagcgccgacaacaugaucaccaaccuguucaagcacaucgccaaggcgcaggagcuguacaagaaccucuccgcccugggcgcccagggcgcccagaucgacaccgccuucagcuccuacuacuggcuguacaaggcgggggugacccccgagacguuccccaccgucagccaguuccucuucgagcugggcaagcagccccgggggaccaagaagaugaagaaggcccugcucagcacccccaugaaguggggcaagaagcuguacgagcuguucgccgacgacuccuuccagcagaaccgcaucuacaugcaccccgccgugcucacggcggggcggaucagcgagaugggcgugugcuucggcaccaucccggucgccaaccccgacgacgccgcccagggguccggccacaccaagagcauccugaaccugcgcaccaacacggagaccaacaaccccugcgccaagaccaucgugaagcuguucgagauccagaagaccggguucaacauccaggacauggacaucgucgcguccgagcaccuccugcaccagagccucgugggcaagcagucccccuuccagaacgccuacaacgugaaggggaacgccacgagcgccaacaucaucuga

SEQ ID NO: 6659 - RNA, 1449 nt, Artificial Sequence
  derived and/or modified CDS sequence (opt1) from CCHFV(Bul/HU517)__AY277676.2__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaagaacagcggcgccaucaaguccugggacgagaacuacguggagcucaaggucgacgugcccaagaucgagcagcuggccaacuaccagcaggccgcgcugaaguggcgcaaggacaucggguuccgggugaacgccaacaccgccgcccucagcaacaagguccuggccgaguacaaggugcccggcgagaucgugauguccgucaaggagaugcugagcgacaugauccgccggcgcaaccucauccugaaccggggcuccgacgagaacccccgcgggccggugagccacgagcacguggaguggugccgggaguucgucaagggcaaguacaucauggcguucaacccgcccuggggcgacaucaacaaguccgggcgcagcgggaucgcccugguggccacgggccucgccaagcuggccgagaccgagggcaaggggguguucgacgaggcgaagaagaccgucgaggcccugaacggcuaccucgacaagcaccgggacgagguggacaaggccuccgccgacagcaugaucaccaaccugcugaagcacaucgccaaggcgcaggagcucuacaagaacuccagcgcccugcgcgcccagggggcccagaucgacacgcccuucagcuccuucuacuggcuguacaaggccggcgugacccccgagaccuuccccaccaucagccaguuccucuucgagcugggcaagcagccccgggggacgaagaagaugaagaaggcgcugcucuccacccccaugaaguggggcaagaagcuguacgagcuguucgccgacgacagcuuccagcagaaccgcaucuacaugcacccggccguccucaccgccgggcggaucuccgagaugggcgugugcuucgggaccauccccguggcgaaccccgacgacgccgcccagggcagcggccacacgaaguccauccugaaccugcgcaccagcaccgagaccaacaaccccugcgccaagacgaucgucaagcuguucgagauccagaagaccggguucaacauccaggacauggacaucguggccuccgagcaccuccugcaccagagccucgucggcaagcaguccccguuccagaacgcguacaacgugaaggggaacgccaccagcgccaacaucaucuga

SEQ ID NO: 6660 - RNA, 1449 nt, Artificial Sequence
  derived and/or modified CDS sequence (opt1) from CCHFV(V46/13)__KR011837.1__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaagaacagcggcaccaucaaguccugggacgagaacuacgccgagcucaagguggacguccccaagaucgagcagcuggccaacuaccagcaggccgcgcugaaguggcgcaaggacaucggguuccgggugaacgccaacacggccgcccucagcaacaaggugcuggccgaguacaagguccccggcgagaucgugauguccgugaaggagaugcugagcgacaugauccgccggcgcaaccucauccugaaccggggcuccgacgagaacccccgcgggccggucagccgggagcacguggaguggugccgcgaguucgugaagggcaaguacaucauggcguucaacccgcccuggggcgacaucaacaaguccgggcggagcgggaucgcccuggucgccaccggccucgccaagcuggccgagaccgagggcaaggggguguucgacgaggcgaagaaggccguggaggcccugaacggcuaccucgacaagcaccgcgacgaggucgugaaggccuccgccgacagcaugaucaccaaccugcugaagcacaucgcgaaggcccaggagcucuacaagaacuccagcgcccugcgggcccagggggcccagaucgacacgcccuucagcuccuucuacuggcuguacaaggcgggcgugacccccgagaccuuccccaccaucagccaguuccucuucgagcugggcaagcagccccgcgggacgaagaagaugaagaaggcccugcucuccacccccaugaaguggggcaagaagcuguacgagcuguucgccgacgacagcuuccagcagaaccggaucuacaugcacccggccguccucaccgcggggcgcaucuccgagaugggcgugugcuucgggaccauccccguggccaaccccgacgacgccgcccagggcagcggccacacgaaguccauccugaaccugcggaccagcaccgagaccaacaaccccugcgccaagacgaucgucaagcuguucgagauccagaagaccggguucaacauccaggacauggacaucguggcguccgagcaccuccugcaccagagccucgucggcaagcaguccccguuccagaacgccuacaacgugaaggggaacgccaccagcgccaacaucaucuga

SEQ ID NO: 6661 - RNA, 1449 nt, Artificial Sequence
  derived and/or modified CDS sequence (opt1) from CCHFV(1231-CR/TI-2015)__KU161587.1__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaagaacagcggcaccaucaaguccugggacgagaacuacgccgagcucaagguggacguccccaagaucgagcagcuggccaacuaccagcaggccgcgcugaaguggcgcaaggacaucggguuccgggugaacgccaacacggccgcccucagcaacaaggugcuggccgaguacaagguccccggcgagaucgugauguccgugaaggagaugcugagcgacaugauccgccggcgcaaccucauccugaaccggggcggggacgagaacccccgcggcccggucucccgggagcacguggaguggugccgcgaguucgugaaggggaaguacaucauggcguucaacccgcccuggggcgacaucaacaagagcgggcgguccggcaucgcccuggucgccaccggccucgccaagcuggccgagaccgaggggaagggcguguucgacgaggcgaagaagaccguggaggcccugaacggguaccucgacaagcaccgcgacgaggucgacaaggccagcgccgacuccaugaucacgaaccugcugaagcacaucgccaaggcgcaggagcucuacaagaacagcuccgcccugcgggcccagggcgcccagaucgacacccccuucagcagcuucuacuggcuguacaaggccggcgugacccccgagaccuuccccacgaucucccaguuccucuucgagcuggggaagcagccccgcggcaccaagaagaugaagaaggcgcugcucagcacccccaugaagugggggaagaagcuguacgagcuguucgccgacgacuccuuccagcagaaccggaucuacaugcacccggccgugcucaccgccggccgcaucagcgagaugggggucugcuucggcacgauccccguggcgaaccccgacgacgccgcccagggcuccgggcacaccaagagcauccugaaccugcggaccuccaccgagacgaacaaccccugcgccaagaccaucgugaagcuguucgagauccagaagaccggcuucaacauccaggacauggacaucgucgccagcgagcaccuccugcaccagucccucguggggaagcagagcccguuccagaacgcguacaacgucaagggcaacgccaccuccgccaacaucaucuga

SEQ ID NO: 6662 - RNA, 1449 nt, Artificial Sequence
  derived and/or modified CDS sequence (opt1) from CCHFV(AP92)__U04958.1__N
auggagaacaagaucgaggugaacagcaaggacgaccugaacaagugguucgaggaguucaagaagggcaacgggcucgucgacaccuucaccaacuccuacagcuucugcgagaacgugcccaaccuggaccgcuucguguaccagauggccuccgccacggacgacgcgcagaaggacagcaucuacgccuccgcccuggucgaggccaccaaguacugcgccccgaucuacgagugcgcgugggugagcuccaccggcaucgugaagaaggggcucgagugguucgagaagaacaccagcacgaucaaguccugggacgagagcuacaccgagcugaaggucgacauccccaagaucgagcagcuguccagcuaccagcaggccgcccucaaguggcggaaggacaucggcuuccgcaucaacgccaacaccaccgcgcuguccaacaaggugcuggccgaguacaaggugcccggggagauccucguccccgugaaggagaugcugagcgacaugauccggcgccggaacaucauccugaaccgcggcuccgacgagaacccgcggggccccgugagccacgagcacaucgaguggugccgcgaguucaucaaggggaaguacaucauggccuucaacccgcccuggggcgacaucaacaaguccgggcggagcggcaucgcccucgucgccacggggcuggcgaagcuggccgagaccgagggcaagggcguguucgaggaggccaagaagaccguggaggcccucaaggacuaccuggacaagcaccgcgacgaggucgacaagaccuccgccgacaacauggugacgagccugcucaagcacaucgcgaaggcccaggagcuguacaagaacagcuccgcccugcgggcccagggggcccagaucgacacccccuucagcuccuucuacuggcucuacaaggcgggcgugacccccgagaccuuccccacggucagccaguuccuguucgagcuggggaagcagccccgcggcaccaagaagaugaagaaggcccuccuguccaccccgaugaaguggggcaagaagcacuacgagcuguucgccgacgacagcuuccagcagaaccggaucuacaugcaccccgccgugcucaccgccgggcgcaucuccgagaugggcgugugcuucgggacgauccccgucgcgaaccccgacgacgccgcccagggcagcgggcacaccaaguccauccugaaccugcggaccaacaccgagagcaacaacccgugcgcccgcacgaucgugaagcuguucgagauccagaagaccggcuucgacaucaaggacauggacaucguggcguccgagcaccuccugcaccagagccucgucggcaagcagucccccuuccagaacgccuacaacgugaaggggaacgccaccagcgccaacaucaucuga

SEQ ID NO: 6663 - RNA, 1449 nt, Artificial Sequence
  derived and/or modified CDS sequence (opt1) from CCHFV(C68031)__M86625.1__N
auggagaacaagaucgaggugaacaacaaggacgagaugaacaagugguucgaggaguucaagaagggcaacgggcuggucgacaccuucaccaaccccuacagcuucugcgaguccgugccgaaccucgagcgcuucguguuccagauggccagcgccacggacgacgcgcagaaggacuccaucuacgccagcgcccuggucgaggccaccaaguucugcgcccccaucuacgagugcgcguggguguccagcaccggcaucgugaagaaggggcuggagugguucgagaagaacgccggcaccaucaaguccugggacgagagcuacaucgagcucaaggucgaggugcccaagaucgagcagcuggccaacuaccagcaggccgcgcugaaguggcggaaggacaucggguuccgcgugaacgccaacacggccgcccucucccacaagguccuggccgaguacaaggugcccggcgagaucgugaugagcgucaaggagaugcuguccgacaugauccggcgccggaaccucauccugaaccgcggcggggacgagaacccgcggggccccgugagccgcgagcacguggaguggugccgggaguucgucaaggggaaguacaucauggcguucaacccgcccuggggcgacaucaacaaguccgggcgcagcggcaucgcccugguggccaccggccucgccaagcuggccgagaccgaggggaagggcguguucgacgaggcgaagaagaccgucgaggcccugaacggguaccucgacaagcacaaggacgagguggacaaggccuccgccgacaacaugaucacgaaccugcugaagcacaucgccaaggcgcaggagcucuacaagaacagcuccgcccugcgggcccagggcgcccagaucgacaccgccuucagcuccuacuacuggcuguacaaggcgggcgugacccccgagaccuuccccacggucagccaguuccucuucgagcuggggaagcagccccgcggcaccaagaagaugaagaaggcccugcucagcacccccaugaagugggggaagaagcuguacgagcuguucgccgacgacuccuuccagcagaaccggaucuacaugcacccggccgugcucaccgcgggccgcaucagcgagaugggggugugcuucggcacgauccccgucgccaaccccgacgacgccgcccagggcuccgggcacaccaagagcauccugaaccugcggaccaacaccgagacgaacaaccccugcgccaagaccaucgugaagcuguucgagauccagaagaccggcuucaacauccaggacauggacaucgucgcguccgagcaccuccugcaccagagccucguggggaagcaguccccguuccagaacgccuacaacgugaagggcaacgccaccagcgccaacaucaucuga

SEQ ID NO: 6664 - RNA, 1449 nt, Artificial Sequence
  derived and/or modified CDS sequence (opt1) from CCHFV(1-CR/HU-2015)__KU161586.1__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguaccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaagaacagcggcaccaucaaguccugggacgagaacuacgccgagcucaagguggacguccccaagaucgagcagcuggccaacuaccagcaggccgcgcugaaguggcgcaaggacaucggguuccgggugaacgccaacacggccgcccucagcaacaaggugcuggccgaguacaagguccccggcgagaucgugauguccgugaaggagaugcugagcgacaugauccgccggcgcaaccucauccugaaccggggcggggacgagaacccccgcggcccggucucccgggagcacguggaguggugccgcgaguucgugaaggggaaguacaucauggcguucaacccgcccuggggcgacaucaacaagagcgggcgguccggcaucgcccuggucgccaccggccucgccaagcuggccgagaccgaggggaagggcguguucgacgaggcgaagaagaccguggaggcccugaacggguaccucgacaagcaccgcgacgaggucgacaaggccagcgccgacuccaugacgaccaaccugcugaagcacaucgccaaggcgcaggagcucuacaagaacagcuccgcccugcgggcccagggcgcccagaucgacacccccuucagcagcuucuacuggcuguacaaggccggcgugacccccgagacguuccccaccaucucccaguuccucuucgagcuggggaagcagccccgcggcaccaagaagaugaagaaggcgcugcucagcacccccaugaagugggggaagaagcuguacgagcuguucgccgacgacuccuuccagcagaaccggaucuacaugcacccggccgugcucacggccggccgcaucagcgagaugggggucugcuucggcaccauccccguggcgaaccccgacgacgccgcccagggcuccgggcacaccaagagcauccugaaccugcggaccuccacggagaccaacaaccccugcgccaagaccaucgugaagcuguucgagauccagaagaccggcuucaacauccaggacauggacaucgucgccagcgagcaccuccugcaccagucccucguggggaagcagagcccguuccagaacgcguacaacgucaagggcaacgccacguccgccaacaucaucuga

SEQ ID NO: 6665 - RNA, 1449 nt, Artificial Sequence
  derived and/or modified CDS sequence (opt1) from CCHFV(36-ST-2014)__KR814838.1__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaagaacaccggcacgaucaagagcugggacgacaacuacgccgagcucaagguggacguccccaagaucgagcagcuggccaacuaccagcaggccgcgcugaaguggcgcaaggacaucggguuccgggugaacgccaacaccgccgcccucuccaacaaggugcuggccgaguacaagguccccggcgagaucgugaugagcgugaaggagaugcuguccgacaugauccgccggcgcaaccucauccugaaccggggcggggacggcaacccccgcgggccggucagccacgagcacguggaguggugccgggaguucgugaagggcaaguacaucauggcguucaacccgcccuggggcgacaucaacaaguccgggcgcagcggcaucgcccuggucgccaccgggcucgccaagcuggccgagaccgagggcaaggggguguucgacgaggcgaagcggacgguggaggcccugaacggcuaccucgacaagcaccgcgacgaggucgacaaggccuccgccgacagcaugaucaccaaccugcugaagcacaucgccaaggcgcaggagcucuacaagaacuccagcgcccugcgggcccagggcgcccagaucgacacccccuucuccagcuucuacuggcuguacaaggccggggugacccccgagacguuccccaccaucagccaguuccucuucgagcugggcaagcagccccgcgggaccaagaagaugaagaaggcgcugcucuccacccccaugaaguggggcaagaagcuguacgagcuguucgccgacgacagcuuccagcagaaccggaucuacaugcacccggccgugcucacggccgggcgcaucuccgagaugggcgucugcuucggcaccauccccguggcgaaccccgacgacgccgcccaggggagcggccacaccaaguccauccugaaccugcggaccagcacggagaccaacaaccccugcgccaagaccaucgugaagcuguucgagauccagaagaccggguucaacauccaggacauggacaucgucgccuccgagcaccuccugcaccagagccucgugggcaagcaguccccguuccagaacgcguacaacgucaaggggaacgccacgagcgccaacaucaucuga

SEQ ID NO: 6666 - RNA, 1449 nt, Artificial Sequence
  derived and/or modified CDS sequence (opt1) from CCHFV(37-ST-2009)__KR814835.1__N
auggagaacaagaucguggucaacagcaaggacgagaugaacaagugguucgaggaguucaagaaggugaacggccugguggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccgggaucgugaagaagggccuggagugguucgagaagaacgccgggaccaucaagagcugggacgaguccuacacggagcucaagguggacguccccaagaucgagcagcuggccagcuaccagcaggccgcgcugaaguggcgcaaggacaucggcuuccgggugaacgccaacaccgccgcccucuccagcaaggugcuguccgaguacaagguccccggggagguggugaugcccgucaaggagaugcugagcgacaugauccgccggcgcaaccucauccugaaccggggcuccgacgagaacccgcgcggccccgugagccgggagcacguggaguggugccgcgaguucgucaaggggaaguacaucauggccuucaacccgcccuggggcgacaucaacaaguccgggcggagcggcaucgcgcugguggccaccgggcucgccaagcuggccgagaccgagggcaagggcaucuucgaggaggcccgcaagacgguggacgcgcugaaggacuaccucgaccggcacaaggaggaggucgacaagaccaacgccgacaacauggugaccaaccuguucaagcacaucgccaaggcccaggagcuguacaagaacuccagcgcccuccgcgcgcagggggcccagaucgacacccccuucagcuccuucuacuggcuguacaaggccggcgugacgcccgagaccuuccccaccgucagccaguuccuguucgagcucgggaagcagccccggggcacccgcaagaugaagaaggcccugcuguccacgccgaugaaguggggcaagaagcucuacgagcuguucgccgacgacagcuuccagcagaaccggaucuacaugcaccccgcggugcugaccgccgggcgcgucuccgagaugggcgugugcuucgggaccauccccguggacaaccccgacgacgccgcccagggcagcgggcacaccaaguccauccucaaccugcggacgagcgcggagaccaacaacccgugcgcccgcaccaucgucaagcuguucgagauccagaaggccggcuucaacauccaggagauggacaucguggccuccgagcaccuccugcaccagagccuggugggcaagcagucccccuuccagaacgccuacaacgucaaggggaacgcgaccagcgccaacaucaucuga

SEQ ID NO: 6667 - RNA, 1449 nt, Artificial Sequence
  derived and/or modified CDS sequence (opt1) from CCHFV(59-TK-2012)__KR814833.1__N
auggagaacaagaucguggucaacagcaaggacgagaugaacaagugguucgaggaguucaagaaggugaacggccugguggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccgggaucgugaagaagggccuggagugguucgagaagaacaccgggacgaucaagagcugggacgaguccuacaccgagcucaagguggacguccccaagaucgagcagcuggccagcuaccagcaggccgcccugaaguggcgcaaggacaucggcuuccgggugaacgcgaacaccgccgcccucuccagcaaggugcuguccgaguacaagguccccggggagaucgugaugcccgugaaggagaugcugagcgacaugauccgccggcgcaaccucauccugaaccggggcuccgacgagaacccgcgcggccccgucagccgggagcacguggaguggugccgcgaguucgugaaggggaaguacaucauggccuucaacccgcccuggggcgacaucaacaaguccgggcggagcggcaucgcccuggucgcgaccgggcucgccaagcuggccgagacggagggcaagggcaucuucgaggaggcccgcaagaccguggacgcccugaaggacuaccucgaccggcacaaggaggagguggacaagaccaacgcggacaacauggucaccaaccuguucaagcacaucgccaaggcccaggagcuguacaagaacuccagcgcccuccgcgcccagggggcgcagaucgacacgcccuucagcuccuucuacuggcuguacaaggccggcgugacccccgagaccuuccccaccgugagccaguuccuguucgagcucgggaagcagccccggggcacgcgcaagaugaagaaggcccugcuguccaccccgaugaaguggggcaagaagcucuacgagcuguucgccgacgacagcuuccagcagaaccggaucuacaugcaccccgccguccugaccgcggggcgcaucuccgagaugggcgugugcuucgggaccauccccgucgacaaccccgacgacgccgcccagggcagcgggcacacgaaguccauccucaaccugcggaccagcgccgagaccaacaacccgugcgcgaagaccaucgugaagcuguucgagauccagaaggccggcuucaacauccaggagauggacaucguggccuccgagcaccuccugcaccagagccuggucggcaagcagucccccuuccagaacgccuacaacgugaaggggaacgccacgagcgcgaacaucaucuga

SEQ ID NO: 6668 - RNA, 1449 nt, Artificial Sequence
  derived and/or modified CDS sequence (opt1) from CCHFV(73-ST-2013)__KR814836.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgacaaguucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgacgugcccaagaucgagcagcuggccaacuaccagcaggccgcgcugaaguggcgcaaggacaucggguuccgggugaacgccaacaccgccgcccucagcaacaagguccuggccgaguacaaggugcccggcgagaucgugauguccgucaaggagaugcugagcgacaugauccgccggcgcaaccagauccucaaccggggcggggacgagaacccccgcggcccggugucccgggagcacguggacuggugccgcgaguucgucaaggggaaguacaucauggcguucaacccgcccuggggcgacaucaacaagagcgggcgguccggcaucgcccugguggccaccggccuggccaagcucgccgagaccgaggggaagggcguguucgacgaggcgaagaagacggucgaggcccugaacggguaccuggacaagcacaaggacgagguggaccgcgccagcgccgacuccaugaucaccaaccuccugaagcacaucgccaaggcgcaggagcuguacaagaacagcuccgcccuccgggcccagggcgcccagaucgacaccgccuucagcagcuacuacuggcuguacaaggcgggcgugacccccgagacguuccccaccgucucccaguuccuguucgagcucgggaagcagccccgcggcaccaagaagaugaagaaggcccugcugagcacccccaugaagugggggaagaagcucuacgagcuguucgccgacgacuccuuccagcagaaccggaucuacaugcaccccgccgugcugacggcgggccgcaucagcgagaugggggugugcuucggcaccaucccggucgccaaccccgacgacgccgcccagggcuccgggcacaccaagagcauccucaaccugcggaccaacacggagaccaacaaccccugcgcccgcaccaucgugaagcuguucgagauccagaagaccggcuucaacauccaggacauggacaucgucgcguccgagcaccuccugcaccagagccugguggggaagcagucccccuuccagaacgccuacaacgugaagggcaacgccacgagcgccaacaucaucuga

SEQ ID NO: 6669 - RNA, 1449 nt, Artificial Sequence
  derived and/or modified CDS sequence (opt1) from CCHFV(75-ST-2010)__KR814845.1__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaagaacagcggcaccaucaaguccugggacgagaacuacgccgagcucaagguggacguccccaagaucgagcagcuggccaacuaccagcaggccgcgcugaaguggcgcaaggacaucggguuccgggugaacgccaacacggccgcccucagcaacaaggugcuggccgaguacaagguccccggcgagaucgugauguccgugaaggagaugcugagcgacaugauccgccggcgcaaccucauccugaaccggggcuccgacgagaacccccgcgggccggucagccgggagcacguggaguggugccgcgaguucgugaagggcaaguacaucauggcguucaacccgcccuggggcgacaucaacaaguccgggcggagcgggaucgcccuggucgccaccggccucgccaagcuggccgagaccgagggcaaggggguguucgacgaggcgaagaagaccguggaggcccugaacggcuaccucgacaagcaccgcgacgaggucgacaaggccuccgccgacagcaugaucacgaaccugcugaagcacaucgccaaggcgcaggagcucuacaagaacuccagcgcccugcgggcccagggggcccagaucgacacccccuucagcuccuucuacuggcuguacaaggccggcgugacccccgagaccuuccccacgaucagccaguuccucuucgagcugggcaagcagccccgcgggaccaagaagaugaagaaggcgcugcucuccacccccaugaaguggggcaagaagcuguacgagcuguucgccgacgacagcuuccagcagaaccggaucuacaugcacccggccgugcucaccgccgggcgcaucuccgagaugggcgucugcuucgggacgauccccguggcgaaccccgacgacgccgcccagggcagcggccacaccaaguccauccugaaccugcggaccagcaccgagacgaacaaccccugcgccaagaccaucgugaagcuguucgagauccagaagaccggguucaacauccaggacauggacaucgucgccuccgagcaccuccugcaccagagccucgugggcaagcaguccccguuccagaacgcguacaacgucaaggggaacgccaccagcgccaacaucaucuga

SEQ ID NO: 6670 - RNA, 1449 nt, Artificial Sequence
  derived and/or modified CDS sequence (opt1) from CCHFV(CHH)__KU707898.1__N
auggagaacaagaucgaggugaacagcaaggacgagaugaacaagugguucgaggaguucaagaagggcaacgggcuggucgacaccuucaccaacuccuacagcuucugcgaguccgugcccaaccucgaccgcuucguguuccagauggccagcgccacggacgacgcgcagaaggacuccaucuacgccagcgcccuggucgaggccaccaaguucugcgccccgaucuacgagugcgcgugggccuccagcaccggcaucgugaagaaggggcuggagugguucgagaagaacgccggcaccaucaaguccugggacgagagcuacacggagcucaagguggagguccccaagaucgagcagcuguccaacuaccagcaggccgcgcugaaguggcggaaggacaucggguuccgcgugaacgccaacaccgccgcccucagcaacaaggugcuggccgaguacaagguccccggcgagaucgugauguccgugaaggagaugcugagcgacaugauccggcgccggaaccucauccugaaccgcggcggggacgagaacccccggggcccggucucccgcgagcacguggaguggugccgggaguucgugaaggggaaguacaucauggcguucaacccgcccuggggcgacaucaacaagagcgggcgcuccggcaucgcccuggucgccaccggccucgccaagcuggccgagaccgaggggaagggcguguucgacgaggcgaagaagacgguggaggcccugaacggguaccucgacaagcacaaggacgaggucgacaaggccagcgccgacuccaugaucaccaaccugcugaagcacaucgccaaggcgcaggagcucuacaagaacagcagcgcccugcgggcccagggcgcccagaucgacaccguguucuccagcuacuacuggcuguacaaggccggcgugacccccgacacguuccccaccgucucccaguuccucuucgagcuggggaagcagccccgcggcaccaagaagaugaagaaggcgcugcucagcacccccaugaagugggggaagaagcuguacgagcuguucgccgacgacuccuuccagcagaaccggaucuacaugcaccccgccgugcucacggccggccgcaucagcgagaugggggugugcuucggcaccaucccggucgcgaaccccgacgacgccgcccugggcuccgggcacaccaagagcauccugaaccuccggaccaacacggagaccaacaaccccugcgccaagaccaucgugaagcuguucgagauccagaagaccggcuucaacauccaggacauggacaucgucgccuccgagcaccuccugcaccagagccugguggggaagcagucccccuuccagaacgcguacaacgugaagggcaacgccacgagcgccaacaucaucuga

SEQ ID NO: 6671 - RNA, 1449 nt, Artificial Sequence
  derived and/or modified CDS sequence (opt1) from CCHFV(CJH)__KU707899.1__N
auggagaacaagaucgaggugaagaacaagcacgagaagaacaagugguucgaggaguucaagaagggcaacgggcuggucgacaccuucaccaacagcuacuccuucugcgagaacgugcccaaccucgaccgcuucguguuccagauggccggcgccacggacgacgcgcagaaggacagcaucuacgccuccgcccuggucgaggccaccaaguucugcgccccgaucuacgagugcgcgugggccagcuccaccgggaucgugaagaagggccuggagugguucgagaagaacgccgggaccaucaagagcugggacgaguccuacacggagcucaagguggagguccccaagaucgagcagcugagcaacuaccagcaggccgcgcugaaguggcggaaggacaucggcuuccgcggcaacgccaacaccgccgcccucuccaacaaggugcuggccgaguacaaggugcccggggagaucgucaugagcgugaaggagaugcuguccgacaugauccggcgccggaaccucauccugaaccgcggcggggacgagaacccccggggcccggugagccgcgagcacgucgaguggugccgggaguucgugaaggggaaguacaucauggcguucaacccgcccuggggcgacaucaacaaguccggccgcagcgggaucgcccugguggccaccggccucgccaagcuggccgagaccgaggggaagggcgucuucgacgaggcgaagaagacgguggaggcccugaacggcuaccucgacaagcacaaggacgagguggacaaggccuccgccgacagcaugaucaccaaccugcugaagcacaucgccaaggcgcaggagcucuacaagaacuccagcgcccugcgggcccagggggcccagaucgacaccgucuucuccagcuacuacuggcuguacaaggccggcgugacccccgagacguuccccaccgugagccaguuccucuucgagcuggggaagcagccccgcggcaccaagaagaugaagaaggcgcugcucuccacccccaugaagugggggaagaagcuguacgagcuguucgccgacgacagcuuccagcagaaccggaucuacaugcaccccgccguccucacggccggccgcaucuccgagaugggcgugugcuucgggaccaucccgguggcgaaccccgacgacgccgcccugggcagcgggcacaccaaguccauccugaaccuccggaccaacacggagaccaacaaccccugcgccaagaccaucgucaagcuguucgagauccagaagaccggcuucaacauccaggacauggacaucguggccagcgagcaccuccugcaccagucccuggucgggaagcagagccccuuccagaacgcguacaacgugaagggcaacgccacguccgccaacaucaucuga

SEQ ID NO: 6672 - RNA, 1449 nt, Artificial Sequence
  derived and/or modified CDS sequence (opt1) from CCHFV(CLT/TI05146)__DQ227496.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccgacuaccagcaggccgcgcugaaguggcggaaggacaucggguuccgcgugaacgccaacaccaccgcccucagccacaagguccuggccgaguacaaggugcccggcgagaucgugauguccgucaaggagaugcugagcgacaugauccggcgccggaaccucauccugaaccgcggcggggacgagaacccccggggcccggugucccgcgagcacguggaguggugccgggaguucgucaaggggaaguacaucauggccuucaacccgcccuggggcgacaucaacaagagcgggcgcuccggcaucgcgcugguggccaccggccucgccaagcuggccgagacggaggggaagggcguguucgacgaggccaagaagaccgucgaggcgcugaacggguaccucaacaagcacaaggacgagguggacaaggccagcgccgacuccaugaucaccaaccugcugaagcacaucgccaaggcccaggagcucuacaagaacagcuccgcgcugcgggcccagggcgcccagaucgacaccgccuucagcagcuacuacuggcuguacaaggccggcgugacgcccgagaccuuccccaccgucucccaguuccucuucgagcuggggaagcagccccgcggcaccaagaagaugaagaaggcgcugcucagcacgccccugaagugggggaagaagcuguacgagcuguucgccgacgacuccuuccagcagaaccggaucuacaugcaccccgccgugcugaccgccggccgcaucagcgagaugggggugugcuucggcaccaucccggucgcgaaccccgacgacgccgcccagggcuccgggcacaccaagagcauccugaaccuccggacgaacaccgagaccaacaaccccugcgccaagaccaucgugaagcuguucgagauccagaagacgggcuucaacauccaggacauggacaucgucgccuccgagcaccuccuccaccagagccugguggggaagcagucccccuuccagaacgcguacaacgugaagggcaacgccaccagcgccaacaucaucuga

SEQ ID NO: 6673 - RNA, 1449 nt, Artificial Sequence
  derived and/or modified CDS sequence (opt1) from CCHFV(CYT/TI05099)__DQ227495.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccgacuaccagcaggccgcgcugaaguggcggaaggacaucggguuccgcgugaacgccaacaccaccgcccucagccacaagguccuggccgaguacaaggugcccggcgagaucgugauguccgucaaggagaugcugagcgacaugauccggcgccggaaccucauccugaaccgcggcggggacgagaacccccggggcccggugucccgcgagcacguggaguggugccgggaguucgucaaggggaaguacaucauggccuucaacccgcccuggggcgacaucaacaagagcgggcgcuccggcaucgcgcugguggccaccggccucgccaagcuggccgagacggaggggaagggcguguucgacgaggccaagaagaccgucgaggcgcugaacggguaccucaacaagcacaaggacgagguggacaaggccagcgccgacuccaugaucaccaaccugcugaagcacaucgccaaggcccaggagcucuacaagaacagcuccgcgcugcgggcccagggcgcccagaucgacaccgccuucagcagcuacuacuggcuguacaaggccggcgugacgcccgagaccuuccccaccgucucccaguuccucuucgagcuggggaagcagccccgcggcaccaagaagaugaagaaggcgcugcucagcacgccccugaagugggggaagaagcuguacgagcuguucgccgacgacuccuuccagcagaaccggaucuacaugcaccccgccgugcugaccgccggccgcaucagcgagaugggggugugcuucggcaccaucccggucgcgaaccccgacgacgccgcccagggcuccgggcacaccaagagcauccccaaccugcggacgaacaccgagaccaacaaccccugcgccaagaccaucgugaagcuguucgagauccagaagacgggcuucaacauccaggacauggacaucgucgccuccgagcaccuccuccaccagagccucguggggaagcaguccccguuccagaacgcguacaacgugaagggcaacgccaccagcgccaacaucaucuga

SEQ ID NO: 6674 - RNA, 1449 nt, Artificial Sequence
  derived and/or modified CDS sequence (opt1) from CCHFV(Dubai 616)__JN108025.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccggcgccacggacgacgcgcagaaggacuccaucuacgccagcgcccuggucgaggccaccaaguucugcgccccgaucuacgagugcgcguggguguccagcaccgggaucgugaagaagggccuggagugguucgagaagaacgccgggaccaucaaguccugggacgagagcuacacggagcucaaggucgaggugcccaagaucgagcagcuggccaacuaccagcaggccgcgcugaaguggcggaaggacaucggcuuccgcgugaacgccaacaccgccgcccucucccacaagguccuggccgaguacaaggugcccggcgagaucgugaugagcgucaaggagaugcuguccgacaugauccggcgccggaaccucauccugaaccgcgggggcgacgagaacccccgggggccggugagccgcgagcacguggaguggugccgggaguucgucaagggcaaguacaucauggcguucaacccgcccuggggcgacaucaacaaguccgggcgcagcggcaucgcccugguggccaccgggcucgccaagcuggccgagaccgagggcaaggggguguucgacgaggcgaagaagacggucgaggcccugaacggcuaccucgacaagcacaaggacgagguggacaaggccuccgccgacaacaugaucaccaaccugcugaagcacaucgccaaggcgcaggagcucuacaagaacagcuccgcccugcgggcccagggcgcccagaucgacaccgccuucagcuccuacuacuggcuguacaaggcgggggugacccccgagacguuccccaccgucagccaguuccucuucgagcugggcaagcagccccgcgggaccaagaagaugaagaaggcccugcucagcacccccaugaaguggggcaagaagcuguacgagcuguucgccgacgacuccuuccagcagaaccggaucuacaugcaccccgccgugcucacggcggggcgcaucagcgagaugggcgugugcuucggcaccaucccggucgccaaccccgacgacgccgcccagggguccggccacaccaagagcauccugaaccugcggaccaacacggagaccaacaaccccugcgccaagaccaucgugaagcuguucgagauccagaagaccggguucaacauccaggacauggacaucgucgcguccgagcaccuccugcaccagagccucgugggcaagcagucccccuuccagaacgccuacaacgugaaggggaacgccacgagcgccaacaucaucuga

SEQ ID NO: 6675 - RNA, 1449 nt, Artificial Sequence
  derived and/or modified CDS sequence (opt1) from CCHFV(GRH)__KU707900.1__N
auggagaacaagaucgaggugaacagcaaggacgagaugaacaagugguucgaggaguucaagaagggcaacgggcuggucgacaccuucaccaacuccuacagcuucugcgaguccgugcccaaccucgaccgcuucguguuccagauggccagcgccacggacgacgcgcagaaggacuccaucuacgccagcgcccuggucgaggccaccaaguucugcgccccgaucuacgagugcgcgugggccuccagcaccggcaucgugaagaaggggcuggagugguucgagaagaacgccggcaccaucaaguccugggacgagagcuacacggagcucaagguggagguccccaagaucgagcagcuguccaacuaccagcaggccgcgcugaaguggcggaaggacaucggguuccgcgugaacgccaacaccgccgcccucagcaacaaggugcuggccgaguacaagguccccggcgagaucgugauguccgugaaggagaugcugagcgacaugauccggcgccggaaccucauccugaaccgcggcggggacgagaacccccggggcccggucucccgcgagcacguggaguggugccgggaguucgugaaggggauguacaucauggcguucaacccgcccuggggcgacaucaacaagagcgggcgcuccggcaucgcccuggucgccaccggccucgccaagcuggccgagaccgaggggaagggcguguucgacgaggcgaagaagacgguggaggcccugaacggguaccucgacaagcacaaggacgaggucgacaaggccagcgccgacuccaugaucaccaaccugcugaagcacaucgccaaggcgcaggagcucuacaagaacagcagcgcccugcgggcccagggcgcccagaucgacaccguguucuccagcuacuacuggcuguacaaggccggcgugacccccgacacguuccccaccgucucccaguuccucuucgagcuggggaagcagccccgcggcaccaagaagaugaagaaggcgcugcucagcacccccaugaagugggggaagaagcuguacgagcuguucgccgacgacuccuuccagcagaaccggaucuacaugcaccccgccgugcucacggccggccgcaucagcgagaugggggugugcuucggcaccaucccggucgcgaaccccgacgacgccgcccugggcuccgggcacaccaagagcauccugaaccuccggaccaacacggagaccaacaaccccugcgccaagaccaucgugaagcuguucgagauccagaagaccggcuucaacauccaggacauggacaucgucgccuccgagcaccuccugcaccagagccugguggggaagcagucccccuuccagaacgcguacaacgugaagggcaacgccacgagcgccaacaucaucuga

SEQ ID NO: 6676 - RNA, 1449 nt, Artificial Sequence
  derived and/or modified CDS sequence (opt1) from CCHFV(Iran-Gilan69)__KJ027521.1__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaagaacagcggcaccaucaaguccugggacgagaacuacgccgagcucaagguggacguccccaagaucgagcagcuggccagcuaccagcaggccgcgcugaaguggcgcaaggacaucggguuccgggugaacgccaacacggccgcccucuccaacaaggugcuggccgaguacaagguccccggcgagaucgugaugagcgugaaggagaugcuguccgacaugauccgccggcgcaaccucauccugaaccggggcggggacgagaacccccgcggcccggucagccgggagcacguggaguggugccgcgaguucgugaaggggaaguacaucauggcguucaacccgcccuggggcgacaucaacaaguccgggcggagcggcaucgcccuggucgccaccggccucgccaagcuggccgagaccgaggggaagggcguguucgacgaggcgaagaagaccguggaggcccugaacggguaccucgacaagcaccgcgacgaggucgacaaggccuccgccgacagcaugaucacgaaccugcugaagcacaucgccaaggcgcaggagcucuacaagaacuccagcgcccugcgggcccagggcgcccagaucgacacccccuucagcuccuucuacuggcuguacaaggccggcgugacccccgagaccuuccccacgaucagccaguuccucuucgagcuggggaagcagccccgcggcaccaagaagaugaagaaggcgcugcucuccacccccaugaagugggggaagaagcuguacgagcuguucgccgacgacagcuuccagcagaaccggaucuacaugcacccggccgugcucaccgccggccgcaucuccgagaugggggucugcuucggcacgauccccguggcgaaccccgacgacgccgcccagggcagcgggcacaccaaguccauccugaaccugcggaccagcaccgagacgaacaaccccugcgccaagaccaucgugaagcuguucgagauccagaagaccggcuucaacauccaggacauggacaucgucgccuccgagcaccuccugcaccagagccucguggggaagcaguccccguuccagaacgcguacaacgucaagggcaacgccaccagcgccaacaucaucuga

SEQ ID NO: 6677 - RNA, 1449 nt, Artificial Sequence
  derived and/or modified CDS sequence (opt1) from CCHFV(Iran-Isfahan78)__KJ027522.1__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaagaacagcggcaccaucaaguccugggacgagaacuacgccgagcucaagguggacguccccaagaucgagcagcuggccaacuaccagcaggccgcgcugaaguggcgcaaggacaucggguuccgggugaacgccaacacggccgcccucagcaacaaggugcuggccgaguacaagguccccggcgagaucgugauguccgugaaggagaugcugagcgacaugauccgccggcgcaaccucauccugaaccggggcggggacgagaacccccgcggcccggucucccgggagcacguggaguggugccgcgaguucgugaaggggaaguacaucauggcguucaacccgcccuggggcgacaucaacaagagcgggcgguccggcaucgcccuggucgccaccggccucgccaagcuggccgagaccgaggggaagggcguguucgacgaggcgaagaagaccguggaggcccugaacggguaccucgacaagcaccgcgacgaggucgacaaggccagcgccgacuccaugaucacgaaccugcugaagcacaucgccaaggcgcaggagcucuacaagaacagcuccgcccugcgggcccagggcgcccagaucgacacccccuucagcagcuucuacuggcuguacaaggccggcgugacccccgagaccuuccccacggugucccaguuccucuucgagcuggggaagcagccccgcggcaccaagaagaugaagaaggcgcugcucagcacccccaugaagugggggaagaagcuguacgagcuguucgccgacgacuccuuccagcagaaccggaucuacaugcacccggccguccucaccgccggccgcaucagcgagaugggggugugcuucggcacgauccccguggcgaaccccgacgacgccgcccagggcuccgggcacaccaagagcauccugaaccugcggaccuccaccgagacgaacaaccccugcgccaagaccaucgucaagcuguucgagauccagaagaccggcuucaacauccaggacauggacaucguggccagcgagcaccuccugcaccagucccucgucgggaagcagagcccguuccagaacgcguacaacgugaagggcaacgccaccuccgccaacaucaucuga

SEQ ID NO: 6678 - RNA, 1449 nt, Artificial Sequence
  derived and/or modified CDS sequence (opt1) from CCHFV(Iran-KhRazavi72)__KJ485700.1__N
auggagaacaagaucgaggugaagaacaagcacgagaagaacaagugguucgaggaguucaagaagggcaacgggcuggucgacaccuuccccaacagcuacuccuucugcgagaacgugccgaaccucgaccgcuucguguuccagauggccggcgccaccgacgacgcgcagaaggacagcaucuacgccuccgcccuggucgaggccacgaaguucugcgcccccaucuacgagugcgcgugggccagcuccaccgggaucgugaagaagggccuggagugguucgagaagaacgccgggaccaucaagagcugggacgaguccuacaccgagcucaagguggagguccccaagaucgagcagcugagcaacuaccagcaggccgcgcugaaguggcggaaggacaucggcuuccgcggcaacgccaacacggccgcccucuccaacaaggugcuggccgaguacaaggugcccggggagaucgucaugagcgugaaggagaugcuguccgacaugauccggcgccggaaccucauccugaaccgcggcggggacgagaacccgcggggccccgugagccgcgagcacgucgaguggugccgggaguucaucaaggggaaguacaucauggcguucaacccgcccuggggcgacaucaacaaguccggccgcagcgggaucgcccugguggccaccggccucgccaagcuggccgagaccgaggggaagggcguguucgacgaggcgaagaagaccgucgaggcccugaacggcuaccucgacaagcacaaggacgagguggacaaggccuccgccgacagcaugaucacgaaccugcugaagcacaucgccaaggcgcaggagcucuacaagaacuccagcgcccugcgggcccagggggcccagaucgacaccguguucuccagcuacuacuggcuguacaaggccggcgucacccccgagaccuuccccacggugagccaguuccucuucgagcuggggaagcagccccgcggcaccaagaagaugaagaaggcgcugcucuccacccccaugaagugggggaagaagcuguacgagcuguucgccgacgacagcuuccagcagaaccggaucuacaugcacccggccgugcucaccgccggccgcaucuccgagaugggcgucugcuucgggacgauccccguggcgaaccccgacgacgccgcccugggcagcgggcacaccaaguccauccugaaccuccggaccaacaccgagacgaacaaccccugcgccaagaccaucgugaagcuguucgagauccagaagaccggcuucaacauccaggacauggacaucgucgccagcgagcaccuccugcaccagucccugguggggaagcagagcccguuccagaacgcguacaacgucaagggcaacgccaccuccgccaacaucaucuga

SEQ ID NO: 6679 - RNA, 1449 nt, Artificial Sequence
  derived and/or modified CDS sequence (opt1) from CCHFV(Iran-Zahedan19)__KJ676542.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccggcgccacggacgacgcgcagaaggacuccaucuacgccagcgcccuggucgaggccaccaaguucugcgccccgaucuacgagugcgcguggguguccagcaccgggaucgugaagaagggccuggagugguucgagaagaacgccgggaccaucaaguccugggacgagagcuacacggagcucaaggucgaggugcccaagaucgagcagcuggccaacuaccagcaggccgcgcugaaguggcggaaggacaucggcuuccgcgugaacgccaacaccgccgcccucucccacaagguccuggccgaguacaaggugcccggcgagaucgugaugagcgucaaggagaugcuguccgacaugauccggcgccggaaccucauccugaaccgcgggggcgacgagaacccccgggggccggugagccgcgagcacguggaguggugccgggaguucgucaagggcaaguacaucauggcguucaacccgcccuggggcgacaucaacaaguccgggcgcagcggcaucgcccugaucgccaccgggcucgccaagcuggccgagaccgagggcaaggggguguucgacgaggcgaagaagacgguggaggcccugaacggcuaccucgacaagcacaaggacgaggucgacaaggccuccgccgacaacaugaucaccaaccugcugaagcacaucgccaaggcgcaggagcucuacaagaacagcuccgcccugcgggcccagggcgcccagaucgacaccgccuucagcuccuacuacuggcuguacaaggcgggggugacccccgagacguuccccaccgugagccaguuccucuucgagcugggcaagcagccccgcgggaccaagaagaugaagaaggcccugcucagcacccccaugcgguggggcaagaagcuguacgagcuguucgccgacgacuccuuccagcagaaccgcaucuacaugcaccccgccguccucacggcggggcggaucagcgagaugggcgugugcuucggcaccaucccgguggccaaccccgacgacgccgcccagggguccggccacaccaagagcauccugaaccugcgcaccaacacggagaccaacaaccccugcgccaagaccaucgucaagcuguucgagauccagaagaccggguucaacauccaggacauggacaucguggcguccgagcaccuccugcaccagagccucgucggcaagcagucccccuuccagaacgccuacaacgugaaggggaacgccacgagcgccaacaucaucuga

SEQ ID NO: 6680 - RNA, 1449 nt, Artificial Sequence
  derived and/or modified CDS sequence (opt1) from CCHFV(NIV 112143)__JN572089.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccaacuaccagcaggccgcgcugaaguggcggaaggacaucggguuccgcgugaacgccaacaccgccgcccucagccacaagguccuggccgaguacaaggugcccggcgagaucgugauguccgucaaggagaugcugagcgacaugauccggcgccggaaccucauccugaaccgcggcggggacgagaacccccggggcccggugucccgcgagcacguggaguggugccgggaguucgucaaggggaaguacaucauggcguucaacccgcccuggggcgacaucaacaagagcgggcgcuccggcaucgcccugaucgccaccggccucgccaagcuggccgagaccgaggggaagggcguguucgacgaggcgaagaagacgguggaggcccugaacggguaccucgacaagcacaaggacgaggucgacaaggccagcgccgacaacaugaucaccaaccugcugaagcacaucgccaaggcgcaggagcucuacaagaacuccagcgcccugcgggcccagggcgcccagaucgacaccgccuucuccagcuacuacuggcuguacaaggcgggcgugacccccgagacguuccccaccgugagccaguuccucuucgagcuggggaagcagccccgcggcaccaagaagaugaagaaggcccugcucuccacccccaugcggugggggaagaagcuguacgagcuguucgccgacgacagcuuccagcagaaccgcaucuacaugcaccccgccguccucacggcgggccggaucuccgagaugggggugugcuucggcaccaucccgguggccaaccccgacgacgccgcccagggcagcgggcacaccaaguccauccugaaccugcgcaccaacacggagaccaacaaccccugcgccaagaccaucgucaagcuguucgagauccagaagaccggcuucaacauccaggacauggacaucguggcgagcgagcaccuccugcaccagucccucgucgggaagcagagccccuuccagaacgccuacaacgugaagggcaacgccacguccgccaacaucaucuga

SEQ ID NO: 6681 - RNA, 1449 nt, Artificial Sequence
  derived and/or modified CDS sequence (opt1) from CCHFV(NIVA 118595)__JN572088.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccaacuaccagcaggccgcgcugaaguggcggaaggacaucggguuccgcgugaacgccaacaccgccgcccucagccacaagguccuggccgaguacaaggugcccggcgagaucgugauguccgucaaggagaugcugagcgacaugauccggcgccggaaccucauccugaaccgcggcggggacgagaacccccggggcccggugucccgcgagcacguggaguggugccgggaguucgucaaggggaaguacaucauggcguucaacccgcccuggggcgacaucaacaagagcgggcgcuccggcaucgcccugguggccaccggccucgccaagcuggccgagaccgaggggaagggcguguucgacgaggcgaagaagacggucgaggcccugaacggguaccucgacaagcacaaggacgagguggacaaggccagcgccgacaacaugaucaccaaccugcugaagcacaucgccaaggcgcaggagcucuacaagaacuccagcgcccugcgggcccagggcgcccagaucgacaccgccuucuccagcuacuacuggcuguacaaggcgggcgugacccccgagacguuccccaccgucagccaguuccucuucgagcuggggaagcagccccgcggcaccaagaagaugaagaaggcccugcucuccacccccaugcggugggggaagaagcuguacgagcuguucgccgacgacagcuuccagcagaaccgcaucuacaugcaccccgccgugcucacggcgggccggaucuccgagaugggggugugcuucggcaccaucccggucgccaaccccgacgacgccgcccagggcagcgggcacaccaaguccauccugaaccugcgcaccaacacggagaccaacaaccccugcgccaagaccaucgugaagcuguucgagauccagaagaccggcuucaacauccaggacauggacaucgucgcgagcgagcaccuccugcaccagucccucguggggaagcagagccccuuccagaacgccuacaacgugaagggcaacgccacguccgccaacaucaucuga

SEQ ID NO: 6682 - RNA, 1449 nt, Artificial Sequence
  derived and/or modified CDS sequence (opt1) from CCHFV(SPU 130/89)__KJ682821.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgacaaguucguguuccagauggccuccgccacggacgacgcgcagaaggacagcaucuacgccuccgcccuggucgaggccaccaaguucugcgccccgaucuacgagugcgcgugggugagcuccaccggcaucgugaagcgcgggcuggagugguucgagaagaacgccggcaccaucaagagcugggacgaguccuacacggagcucaaggucgacgugcccaagaucgagcagcuggccaacuaccagcaggccgcgcugaaguggcggaaggacaucggguuccgcgugaacgccaacaccgccgcccucagcaacaagguccuggccgaguacaaggugcccggcgagaucgugauguccgucaaggagaugcugagcgacaugauccggcgccggaaccagauccucaaccgcggcggggacgagaacccccggggcccggugucccgcgagcacguggacuggugccgggaguucgucaaggggaaguacaucauggcguucaacccgcccuggggcgacaucaacaagagcgggcgcuccggcaucgcccugguggccaccggccuggccaagcucgccgagaccgaggggaagggcguguucgacgaggcgaagaagacggucgaggcccugaacggguaccuggacaagcacaaggacgagguggaccgggccagcgccgacuccaugaucaccaaccuccugaagcacaucgccaaggcgcaggagcuguacaagaacagcuccgcccuccgcgcccagggcgcccagaucgacaccgccuucagcagcuacuacuggcuguacaaggcgggcgugacccccgagacguuccccaccgucucccaguuccuguucgagcucgggaagcagccccggggcaccaagaagaugaagaaggcccugcugagcacccccaugaagugggggaagaagcucuacgagcuguucgccgacgacuccuuccagcagaaccgcaucuacaugcaccccgccgugcugacggcgggccggaucagcgagaugggggugugcuucggcaccaucccggucgccaaccccgacgacgccgcccagggcuccgggcacaccaagagcauccucaaccugcgcaccaacacggagaccaacaaccccugcgcccggaccaucgugaagcuguucgagauccagaagaccggcuucaacauccaggacauggacaucgucgcguccgagcaccuccugcaccagagccugguggggaagcagucccccuuccagaacgccuacaacgugaagggcaacgccacgagcgccaacaucgucuga

SEQ ID NO: 6683 - RNA, 1449 nt, Artificial Sequence
  derived and/or modified CDS sequence (opt1) from CCHFV(SPU 18/88)__KJ682818.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgacaaguucguguuccagauggccuccgccacggacgacgcgcagaaggacagcaucuacgccuccgcccuggucgaggccaccaaguucugcgccccgaucuacgagugcgcgugggugagcuccaccggcaucgugaagcgcgggcuggagugguucgagaagaacgccggcaccaucaagagcugggacgaguccuacacggagcucaaggucgacgugcccaagaucgagcagcuggccaacuaccagcaggccgcgcugaaguggcggaaggacaucggguuccgcgugaacgccaacaccgccgcccucagcaacaagguccuggccgaguacaaggugcccggcgagaucgugauguccgucaaggagaugcugagcgacaugauccggcgccggaaccagauccucaaccgcggcggggacgagaacccccggggcccggugucccgcgagcacguggacuggugccgggaguucgucaaggggaaguacaucauggcguucaacccgcccuggggcgacaucaacaagagcgggcgcuccggcaucgcccugguggccaccggccuggccaagcucgccgagaccgaggggaagggcguguucgacgaggcgaagaagacggucgaggcccugaacggguaccuggacaagcacaaggacgagguggaccgggccagcgccgacuccauggugaccaaccuccugaagcacaucgccaaggcgcaggagcuguacaagaacagcuccgcccuccgcgcccagggcgcccagaucgacaccgccuucagcagcuacuacuggcuguacaaggcgggcgucacccccgagacguuccccaccgugucccaguuccuguucgagcucgggaagcagccccggggcaccaagaagaugaagaaggcccugcugagcacccccaugaagugggggaagaagcucuacgagcuguucgccgacgacuccuuccagcagaaccgcaucuacaugcaccccgccgugcugacggcgggccggaucagcgagaugggggucugcuucggcaccaucccgguggccaaccccgacgacgccgcccagggcuccgggcacaccaagagcauccucaaccugcgcaccaacacggagaccaacaaccccugcgcccggaccaucgucaagcuguucgagauccagaagaccggcuucaacauccaggacauggacaucguggcguccgagcaccuccugcaccagagccugguggggaagcagucccccuuccagaacgccuacaacgucaagggcaacgccacgagcgccaacaucaucuga

SEQ ID NO: 6684 - RNA, 1449 nt, Artificial Sequence
  derived and/or modified CDS sequence (opt1) from CCHFV(SPU 187/90)__KJ682823.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgacaaguucguguuccagauggccuccgccacggacgacgcgcagaaggacagcaucuacgccuccgcccuggucgaggccaccaaguucugcgccccgaucuacgagugcgcgugggugagcuccaccggcaucgugaagcgcgggcuggagugguucgagaagaacgccggcaccaucaagagcugggacgaguccuacacggagcucaaggucgacgugcccaagaucgagcagcuggccaacuaccagcaggccgcgcugaaguggcggaaggacaucggguuccgcgugaacgccaacaccgccgcccucagcaacaagguccuggccgaguacaaggugcccggcgagaucgugauguccgucaaggagaugcugagcgacaugauccggcgccggaaccagauccucaaccgcggcggggacgagaacccccggggcccggugucccgcgagcacguggacuggugccgggaguucgucaaggggaaguacaucauggcguucaacccgcccuggggcgacaucaacaagagcgggcgcuccggcaucgcccugguggccaccggccuggccaagcucgccgagaccgaggggaagggcguguucgacgaggcgaagaagacggucgaggcccugaacggguaccuggacaagcacaaggacgagguggaccgggccagcgccgacuccaugaucaccaaccuccugaagcacaucgccaaggcgcaggagcuguacaagaacagcuccgcccuccgcgcccagggcgcccagaucgacaccgccuucagcagcuacuacuggcuguacaaggcgggcgugacccccgagacguuccccaccgucucccaguuccuguucgagcucgggaagcagccccggggcaccaagaagaugaagaaggcccugcugagcacccccaugaagugggggaagaagcucuacgagcuguucgccgacgacuccuuccagcagaaccgcaucuacaugcaccccgccgugcugacggcgggccggaucagcgagaugggggugugcuucggcaccaucccggucgccaaccccgacgacgccgcccagggcuccgggcacaccaagagcauccucaaccugcagaccaacacggagaccaacaaccccugcgcccgcaccaucgugaagcuguucgagauccagaagaccggcuucaacauccaggacauggacaucgucgcguccgagcaccuccugcaccagagccugguggggaagcagucccccuuccagaacgccuacaacgugaagggcaacgccacgagcgccaacaucaucuga

SEQ ID NO: 6685 - RNA, 1449 nt, Artificial Sequence
  derived and/or modified CDS sequence (opt1) from CCHFV(SPU 383/87)__KJ682816.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgacaaguucguguuccagauggccggcgccacggacgacgcgcagaaggacuccaucuacgccagcgcccuggucgaggccaccaaguucugcgccccgaucuacgagugcgcguggguguccagcaccgggaucgugaagcgcggccuggagugguucgagaagaacgccgggaccaucaaguccugggacgagagcuacacggagcucaaggucgacgugcccaagaucgagcagcuggccaacuaccagcaggccgcgcugaaguggcggaaggacaucggcuuccgcgugaacgccaacaccgccgcccucuccaacaagguccuggccgaguacaaggugcccggcgagaucgugaugagcgucaaggagaugcuguccgacaugauccggcgccggaaccagauccucaaccgcgggggcgacgagaacccccgggggccggugagccgcgagcacguggacuggugccgggaguucgucaagggcaaguacaucauggcguucaacccgcccuggggcgacaucaacaaguccgggcgcagcggcaucgcccugguggccaccgggcuggccaagcucgccgagaccgagggcaaggggguguucgacgaggcgaagaagacggucgaggcccugaacggcuaccuggacaagcacaaggacgagguggaccgggccuccgccgacagcaugaucaccaaccuccugaagcacaucgccaaggcgcaggagcuguacaagaacuccagcgcccuccgcgcccagggcgcccagaucgacaccgccuucuccagcuacuacuggcuguacaaggcgggggugacccccgagacguuccccaccgucagccaguuccuguucgagcucggcaagcagccccgggggaccaagaagaugaagaaggcccugcuguccacccccaugaaguggggcaagaagcucuacgagcuguucgccgacgacagcuuccagcagaaccgcaucuacaugcaccccgccgugcugacggcggggcggaucuccgagaugggcgugugcuucggcaccaucccggucgccaaccccgacgacgccgcccaggggagcggccacaccaaguccauccucaaccugcgcaccaacacggagaccagcaaccccugcgcccggaccaucgugaagcuguucgagauccagaagaccggguucaacauccaggacauggacaucgucgcguccgagcaccuccugcaccagagccuggugggcaagcagucccccuuccagaacgccuacaacgugaaggggaacgccacgagcgccaacaucgucuga

SEQ ID NO: 6686 - RNA, 1449 nt, Artificial Sequence
  derived and/or modified CDS sequence (opt1) from CCHFV(SPU 383/87)__KJ682816.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgacaaguucguguuccagauggccggcgccacggacgacgcgcagaaggacuccaucuacgccagcgcccuggucgaggccaccaaguucugcgccccgaucuacgagugcgcguggguguccagcaccgggaucgugaagcgcggccuggagugguucgagaagaacgccgggaccaucaaguccugggacgagagcuacacggagcucaaggucgacgugcccaagaucgagcagcuggccaacuaccagcaggccgcgcugaaguggcggaaggacaucggcuuccgcgugaacgccaacaccgccgcccucuccaacaagguccuggccgaguacaaggugcccggcgagaucgugaugagcgucaaggagaugcuguccgacaugauccggcgccggaaccagauccucaaccgcgggggcgacgagaacccccgggggccggugagccgcgagcacguggacuggugccgggaguucgucaagggcaaguacaucauggcguucaacccgcccuggggcgacaucaacaaguccgggcgcagcggcaucgcccugguggccaccgggcuggccaagcucgccgagaccgagggcaaggggguguucgacgaggcgaagaagacggucgaggcccugaacggcuaccuggacaagcacaaggacgagguggaccgggccuccgccgacagcaugaucaccaaccuccugaagcacaucgccaaggcgcaggagcuguacaagaacuccagcgcccuccgcgcccagggcgcccagaucgacaccgccuucuccagcuacuacuggcuguacaaggcgggggugacccccgagacguuccccaccgucagccaguuccuguucgagcucggcaagcagccccgggggaccaagaagaugaagaaggcccugcuguccacccccaugaaguggggcaagaagcucuacgagcuguucgccgacgacagcuuccagcagaaccgcaucuacaugcaccccgccgugcugacggcggggcggaucuccgagaugggcgugugcuucggcaccaucccggucgccaaccccgacgacgccgcccaggggagcggccacaccaaguccauccucaaccugcgcaccaacacggagaccagcaaccccugcgcccggaccaucgugaagcuguucgagauccagaagaccggguucaacauccaggacauggacaucgucgcguccgagcaccuccugcaccagagccuggugggcaagcagucccccuuccagaacgccuacaacgugaaggggaacgccacgagcgccaacaucaucuga

SEQ ID NO: 6687 - RNA, 1449 nt, Artificial Sequence
  derived and/or modified CDS sequence (opt1) from CCHFV(SPU 431/85)__KJ682815.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgacaaguucguguuccagauggccuccgccacggacgacgcgcagaaggacagcaucuacgccuccgcccuggucgaggccaccaaguucugcgccccgguguacgagugcgcgugggugagcuccaccggcaucgucaagcgcgggcuggagugguucgagaagaacgccggcaccaucaagagcugggacgaguccuacacggagcucaagguggacgugcccaagaucgagcagcuggccaacuaccagcaggccgcgcugaaguggcggaaggacaucggguuccgcgucaacgccaacaccgccgcccucagcaacaaggugcuggccgaguacaaggugcccggcgagaucgucauguccgugaaggagaugcugagcgacaugauccggcgccggaaccagauccucaaccgcggcggggacgagaacccccggggcccggugucccgcgagcacgucgacuggugccgggaguucgugaaggggaaguacaucauggcguucaacccgcccuggggcgacaucaacaagagcgggcgcuccggcaucgcccugguggccaccggccuggccaagcucgccgagaccgaggggaagggcgucuucgacgaggcgaagaagacgguggaggcccugaacggguaccuggacaagcacaaggacgagguggaccgggccagcgccgacuccaugaucaccaaccuccugaagcacaucgccaaggcgcaggagcuguacaagaacagcuccgcccuccgcgcccagggcgcccagaucgacaccgccuucagcagcuacuacuggcuguacaaggcgggcgucacccccgagacguuccccaccgugucccaguuccuguucgagcucgggaagcagccccggggcaccaagaagaugaagaaggcccugcugagcacccccaugaagugggggaagaagcucuacgagcuguucgccgacgacacguuccagcagaaccgcaucuacaugcaccccgccgugcugaccgcgggccggaucuccgagaugggggucugcuucggcaccaucccgguggccaaccccgacgacgccgcccagggcagcgggcacaccaaguccauccucaaccugcgcacgaacaccgagaccaacaaccccugcgcccggaccaucgucaagcuguucgagauccagaagacgggcuucaacauccaggacauggacaucguggcgagcgagcaccuccugcaccagucccugguggggaagcagagccccuuccagaacgccuacaacgucaagggcaacgccaccuccgugaacaucaucuga

SEQ ID NO: 6688 - RNA, 1449 nt, Artificial Sequence
  derived and/or modified CDS sequence (opt1) from CCHFV(SPU 45/88)__KJ682819.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgacaaguucguguuccagauggccuccgccacggacgacgcgcagaaggacagcaucuacgccuccgcccuggucgaggccaccaaguucugcgccccgaucuacgagugcgcgugggugagcuccaccggcaucgugaagcgcgggcuggagugguucgagaagaacgccggcaccaucaagagcugggacgaguccuacacggagcucaaggucgacgugcccaagaucgagcagcuggccaacuaccagcaggccgcgcugaaguggcggaaggacaucggguuccgcgugaacgccaacaccgccgcccucagcaacaagguccuggccgaguacaaggugcccggcgagaucgugauguccgucaaggagaugcugagcgacaugauccggcgccggaaccagauccucaaccgcggcggggacgagaacccccggggcccggugucccgcgagcacguggacuggugccgggaguucgucaaggggaaguacaucauggcguucaacccgcccuggggcgacaucaacaagagcgggcgcuccggcaucgcccugguggccaccggccuggccaagcucgccgagaccgaggggaagggcguguucgacgaggcgaagaagacggucgaggcccugaacggguaccuggacaagcacaaggacgagguggaccgggccagcgccgacuccaugaucaccaaccuccugaagcacaucgccaaggcgcaggagcuguacaagaacagcuccgcccuccgcgcccagggcgcccagaucgacaccgccuucagcagcuacuacuggcuguacaaggcgggcgugacccccgagacguuccccaccgucucccaguuccuguucgagcucgggaagcagccccggggcaccaagaagaugaagaaggcccugcugagcacccccaugaagugggggaagaagcucuacgagcuguucgccgacgacuccuuccagcagaaccgcaucuacaugcaccccgccgugcugacggcgggccggaucagcgagaugggggugugcuucggcaccaucccggucgccaaccccgacgacgccgcccagggcuccgggcacaccaagagcauccucaaccugcgcaccaacacggagaccaacaaccccugcgcccggaccaucgugaagcuguucgagauccagaagaccggcuucaacauccaggacauggacaucgucgcguccgagcaccuccugcaccagagccugguggggaagcagucccccuuccagaacgccuacaacgugaagggcaacgccacgagcgccaacaucaucuga

SEQ ID NO: 6689 - RNA, 1449 nt, Artificial Sequence
  derived and/or modified CDS sequence (opt1) from CCHFV(SPU 48/90)__KJ682822.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgacaaguucguguuccagauggccuccgccacggacgacgcgcagaaggacagcaucuacgccuccgcccuggucgaggccaccaaguucugcgccccgaucuacgagugcgcgugggugagcuccaccggcaucgugaagcgcgggcuggagugguucgagaagaacgccggcaccaucaagagcugggacgaguccuacacggagcucaaggucgacgugcccaagaucgagcagcuggccaacuaccagcaggccgcgcugaaguggcggaaggacaucggguuccgcgugaacgccaacaccgccgcccucagcaacaagguccuggccgaguacaaggugcccggcgagaucgugauguccgucaaggagaugcugagcgacaugauccggcgccggaaccagauccucaaccgcggcggggacgagaacccccggggcccggugucccgcgagcacguggacuggugccgggaguucgucaaggggaaguacaucauggcguucaacccgcccuggggcgacaucaacaagagcgggcgcuccggcaucgcccugguggccaccggccuggccaagcucgccgagaccgaggggaagggcguguucgacgaggcgaagaagacggucgaggcccugaacggguaccuggacaagcacaaggacgagguggaccgggccagcgccgacuccaugaucaccaaccucuucaagcacaucgccaaggcgcaggagcuguacaagaacagcuccgcccugcgcgcccagggcgcccagaucgacaccgccuucagcagcuacuacuggcucuacaaggcgggcgugacccccgagacguuccccaccgucucccaguuccuguucgagcuggggaagcagccccggggcaccaagaagaugaagaaggcccuccugagcacccccaugaagugggggaagaagcuguacgagcuguucgccgacgacuccuuccagcagaaccgcaucuacaugcaccccgccgugcugacggcgggccggaucagcgagaugggggugugcuucggcaccaucccggucgccaaccccgacgacgccgcccagggcuccgggcacaccaagagcauccugaaccuccgcaccaacacggagaccaacaaccccugcgcccggaccaucgugaagcuguucgagauccagaagaccggcuucuccauccaggacauggacaucgucgcgagcgagcaccuccuccaccagucccugguggggaagcagagccccuuccagaacgccuacaacgugaagggcaacgccacguccgccaacaucaucuga

SEQ ID NO: 6690 - RNA, 1449 nt, Artificial Sequence
  derived and/or modified CDS sequence (opt1) from CCHFV(SPU 497/88)__KJ682820.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgacaaguucguguuccagauggccuccgccacggacgacgcgcagaaggacagcaucuacgccuccgcccuggucgaggccaccaaguucugcgccccgaucuacgagugcgcgugggugagcuccaccggcaucgugaagcgcgggcuggagugguucgagaagaacgccggcaccaucaagagcugggacgaguccuacacggagcucaaggucgacgugcccaagaucgagcagcuggccaacuaccagcaggccgcgcugaaguggcggaaggacaucggguuccgcgugaacgccaacaccgccgcccucagcaacaagguccuggccgaguacaaggugcccggcgagaucgugauguccgucaaggagaugcugagcgacaugauccggcgccggaaccagauccucaaccgcggcggggacgagaacccccggggcccggugucccgcgagcacguggacuggugccgggaguucgucaaggggaaguacaucauggcguucaacccgcccuggggcgacaucaacaagagcgggcgcuccggcaucgcccugguggccaccggccuggccaagcucgccgagaccgaggggaagggcguguucgacgaggcgaagaagacggucgaggcccugaacggguaccuggacaagcacaaggacgagguggaccgggccagcgccgacuccaugaucaccaaccuccugaagcacaucgccaaggcgcaggagcuguacaagaacagcuccgcccuccgcgcccagggcgcccagaucgacaccgccuucagcagcuacuacuggcuguacaaggcgggcgugacccccgagacguuccccaccgucucccaguuccuguucgagcucgggaagcagccccggggcaccaagaagaugaagaaggcccugcugagcacccccaugaagugggggaagaagcucuacgagcuguucgccgacgacuccuuccagcagaaccgcaucuacaugcaccccgccgugcugacggcgggccggaucagcgagaugggggugugcuucggcgccaucccggucgccaaccccgacgacgccgcccagggcuccgggcacaccaagagcauccucaaccugcgcaccaacaccgagacgaacaaccccugcgcgcggaccaucgugaagcuguucgagauccagaagaccggcuucaacauccaggacauggacaucgucgccuccgagcaccuccugcaccagagccugguggggaagcagucccccuuccagaacgccuacaacgugaagggcaacgccaccagcgccaacaucaucuga

SEQ ID NO: 6691 - RNA, 1449 nt, Artificial Sequence
  derived and/or modified CDS sequence (opt1) from CCHFV(SPU 556/87)__KJ682817.1__N
auggagaacaagaucgaggugaacaacaaggacgagaugaaccgcugguucgaggaguucaagaagggcaacgggcuggucgacaccuucaccaacagcuacuccuucugcgagagcgugcccaaccucgaccgguucguguuccagauggccggcgccacggacgacgcgcagaaggacuccaucuacgccagcgcccuggucgaggccaccaaguucugcgccccgaucuacgagugcgcguggguguccagcaccgggaucgugaagaagggccuggagugguucgagaagaacgccgggaccaucaaguccugggacgagagcuacacggagcucaaggucgacgugcccaagaucgagcagcuggccaacuaccagcaggccgcgcugaaguggcgcaaggacaucggcuuccgggugaacgccaacaccgccgcccucuccaacaagguccuggccgaguacaaggugcccggcgagaucgugaugagcgucaaggagaugcuguccgacaugauccgccggcgcaaccagauccucaaccgcgggggcgacgagaacccccgggggccggugagccgggagcacguggacuggugccgcgaguucgucaagggcaaguacaucauggcguucaacccgcccuggggcgacaucaacaaguccgggcggagcggcaucgcccugguggccaccgggcuggccaagcucgccgagaccgagggcaaggggguguucgacgaggcgaagaagacggucgaggcccugaacggcuaccuggacaagcacaaggacgagguggaccgcgccuccgccgacagcaugaucaccaaccuccugaagcacaucgccaaggcgcaggagcuguacaagaacuccagcgcccuccgggcccagggcgcccagaucgacaccgccuucuccagcuacuacuggcuguacaaggcgggggugacccccgagacguuccccaccgucagccaguuccuguucgagcucggcaagcagccccgcgggaccaagaagaugaagaaggcccugcuguccacccccaugaaguggggcaagaagcucuacgagcuguucgccgacgacagcuuccagcagaaccggaucuacaugcaccccgccgugcugacggcggggcgcaucuccgagaugggcgugugcuucggcaccaucccggucgccaaccccgacgacgccgcccaggggagcggccacaccaaguccauccucaaccugcggaccaacacggagaccaacaaccccugcgccaagaccaucgugaagcuguucgagauccagaagaccggguucaacauccaggacauggacaucgucgcgagcgagcaccuccugcaccagucccuggugggcaagcagagccccuuccagaacgccuacaacgugaaggggaacgccacguccgccaacaucaucuga

SEQ ID NO: 6692 - RNA, 1449 nt, Artificial Sequence
  derived and/or modified CDS sequence (opt1) from CCHFV(SPU 92/01)__KC880335.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgacaaguucguguuccagauggccuccgccacggacgacgcgcagaaggacagcaucuacgccuccgcccuggucgaggccaccaaguucugcgccccgaucuacgagugcgcgugggugagcuccaccggcaucgugaagcgcgggcuggagugguucgagaagaacgccggcaccaucaagagcugggacgaguccuacacggagcucaaggucgacgugcccaagaucgagcagcuggccaacuaccagcaggccgcgcugaaguggcggaaggacaucggguuccgcgugaacgccaacaccgccgcccucagcaacaagguccuggccgaguacaaggugcccggcgagaucgugauguccgucaaggagaugcugagcgacaugauccggcgccggaaccagauccucaaccgcggcggggacgagaacccccggggcccggugucccgcgagcacguggacuggugccgggaguucgucaaggggaaguacaucauggcguucaacccgcccuggggcgacaucaacaagagcgggcgcuccggcaucgcccugguggccaccggccuggccaagcucgccgagaccgaggggaagggcguguucgacgaggcgaagaagacggucgaggcccugaacggguaccuggacaagcacaaggacgagguggaccgggccagcgccgacuccaugaucaccaaccuccugaagcacaucgccaaggcgcaggagcuguacaagaacagcuccgcccuccgcgcccagggcgcccagaucgacaccgccuucagcagcuacuacuggcuguacaaggcgggcgugacccccgagacguuccccaccgucucccaguuccuguucgagcucgggaagcagccccggggcaccaagaagaugaagaaggcccugcugagcacccccaugaagugggggaagaagcucuacgagcuguucgccgacgacuccuuccagcagaaccgcaucuacaugcaccccgccgugcugacggcgggccggaucagcgagaugggggugugcuucggcaccaucccggucgccaaccccgacgacgccgcccagggcuccgggcacaccaagagcauccucaaccugcagaccaacacggagaccaacaaccccugcgcccgcaccaucgugaagcuguucgagauccagaagaccggcuucaacauccaggacauggacaucgucgcguccgagcaccuccugcaccagagccugguggggaagcagucccccuuccagaacgccuacaacgugaagggcaacgccacgagcgucaacaucaucuga

SEQ ID NO: 6693 - RNA, 1449 nt, Artificial Sequence
  derived and/or modified CDS sequence (opt1) from CCHFV(SRR)__KU707901.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccggcgccacggacgacgcgcagaaggacuccaucuacgccagcgcccuggucgaggccaccaaguucugcgccccgaucuacgagugcgcguggguguccagcaccgggaucgugaagaagggccuggagugguucgagaagaacgccgggaccaucaaguccugggacgagagcuacacggagcucaaggucgaggugcccaagaucgagcagcuggccaacuaccagcaggccgcgcugaaguggcggaaggacaucggcuuccgcgugaacgccaacaccgccgcccucucccacaagguccuggccgaguacaaggugcccggcgagaucgugaugagcgucaaggagaugcuguccgacaugauccggcgccggaaccucauccugaaccgcgggggcgacgagaacccccgggggccggugagccgcgagcacguggaguggugccgggaguucgucaagggcaaguacaucauggcguucaacccgcccuggggcgacaucaacaaguccgggcgcagcggcaucgcccugguggccaccgggcucgccaagcuggccgagaccgagggcaaggggguguucgacgaggcgaagaagacggucgaggcccugaacggcuaccucgacaagcacaaggacgagguggacaaggccuccgccgacaacaugaucaccaaccugcugaagcacaucgccaaggcgcaggagcucuacaagaacagcuccgcccugcgggcccagggcgcccagaucgacaccgccuucagcuccuacuacuggcuguacaaggcgggggugacccccgagacguuccccaccgucagccaguuccucuucgagcugggcaagcagccccgcgggaccaagaagaugaagaaggcccugcucagcacccccaugcgguggggcaagaagcuguacgagcuguucgccgacgacuccuuccagcagaaccgcaucuacaugcaccccgccgugcucacggcggggcggaucagcgagaugggcgugugcuucggcaccaucccggucgccaaccccgacgacgccgcccagggguccggccacaccaagagcauccugaaccugcgcaccaacacggagaccaacaaccccugcgccaagaccaucgugaagcuguucgagauccagaagaccggguucaacauccaggacauggacaucgucgcguccgagcaccuccugcaccagagccucgugggcaagcagucccccuuccagaacgccuacaacgugaaggggaacgccacgagcgccaacaucaucuga

SEQ ID NO: 6694 - RNA, 1449 nt, Artificial Sequence
  derived and/or modified CDS sequence (opt1) from CCHFV(STV/HU29223)__AF481802.1__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaagaacagcggcaccaucaaguccugggacgagaacuacgccgagcucaagguggacguccccaagaucgagcagcuggccaacuaccagcaggccgcgcugaaguggcgcaaggacaucggguuccgggugaacgccaacacggccgcccucagcaacaaggugcuggccgaguacaagguccccggcgagaucgugauguccgugaaggagaugcugagcgacaugauccgccggcgcaaccucauccugaaccggggcggggacgagaaccugcgcggccccgucucccgggagcacguggaguggugccgcgaguucgugaaggggaaguacaucauggcguucaacccgcccuggggcgacaucaacaagagcgggcgguccggcaucgcccucgucgccaccggccuggccaagcuggccgagaccgaggggaagggcguguucgacgaggcgaagaagaccguggaggcccucaacggguaccuggacaagcaccgcgacgaggucgacaaggccagcgccgacuccaugaucacgaaccugcucaagcacaucgccaaggcgcaggagcuguacaagaacagcuccgcccugcgggcccagggcgcccagaucgacacccccuucagcagcuucuacuggcucuacaaggccggcgugacccccgagaccuucccgacgaucucccaguuccuguucgagcuggggaagcagccccgcggcaccaagaagaugaagaaggcgcuccugagcacccccaugaagugggggaagaagcuguacgagcuguucgccgacgacuccuuccagcagaaccggaucuacaugcaccccgccgugcugaccgccggccgcaucagcgagaugggggucugcuucggcacgaucccgguggcgaaccccgacgacgccgcccagggcuccgggcacaccaagagcauccugaaccuccggaccuccaccgagacgaacaaccccugcgccaagaccaucgugaagcuguucgagauccagaagaccggcuucaacauccaggacauggacaucgucgccagcgagcaccuccuccaccagucccugguggggaagcagagccccuuccagaacgcguacaacgucaagggcaacgccaccuccgccaacaucaucuga

SEQ ID NO: 6695 - RNA, 1449 nt, Artificial Sequence
  derived and/or modified CDS sequence (opt1) from CCHFV(TAJ/HU8966)__AY049083.2__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccaacuaccagcaggccgcgcugaaguggcggaaggacaucggguuccgcgugaacgccaacaccgccgcccucagccacaagguccuggccgaguacaaggugcccggcgagaucgugauguccgucaaggagaugcugagcgacaugauccggcgccggaaccucauccugaaccgcggcggggacgagaacccccggggcccggugucccgcgagcacguggaguggugccgggaguucgucaaggggaaguacaucauggcguucaacccgcccuggggcgacaucaacaagagcgggcgcuccggcaucgcccugguggccaccggccucgccaagcuggccgagaccgaggggaagggcguguucgacgaggcgaagaagacggucgaggcccugaacggguaccucgacaagcacaaggacgagguggacaaggccagcgccgacaacaugaucaccaaccugcugaagcacaucgccaaggcgcaggagcucuacaagaacuccagcgcccugcgggcccagggcgcccagaucgacaccgccuucuccagcuacuacuggcuguacaaggcgggcgugacccccgagacguuccccaccgucagccaguuccucuucgagcuggggaagcagccccgcggcaccaagaagaugaagaaggcccugcucuccacccccaugaagugggggaagaagcuguacgagcuguucgccgacgacagcuuccagcagaaccggaucuacaugcaccccgccgugcucacggcgggccgcaucuccgagaugggggugugcuucggcaccaucccggucgccgaccccgacgacgccgcccagggcagcgggcacaccaaguccauccugaaccugcggaccaacacggagaccaacaaccccugcgccaagaccaucgugaagcuguucgagauccagaagaccggcuucaacauccaggacauggacaucgucgcgagcgagcaccuccugcaccagucccucguggggaagcagagccccuuccagaacgccuacaacgugaagggcaacgccacguccgccaacaucaucuga

SEQ ID NO: 6696 - RNA, 1449 nt, Artificial Sequence
  derived and/or modified CDS sequence (opt1) from CCHFV(TAJ/HU8975)__AY297692.2__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacaucgagcucaaggucgaggugcccaagaucgagcagcuggccaacuaccagcaggccgcgcugaaguggcggaaggacaucggguuccgcgugaacgccaacacggccgcccucagccacaagguccuggccgaguacaaggugcccggcgagaucgugauguccgucaaggagaugcugagcgacaugauccggcgccggaaccucauccugaaccgcggcggggacgagaacccccggggcccggugucccgcgagcacguggaguggugccgggaguucgucaaggggaaguacaucauggcguucaacccgcccuggggcgacaucaacaagagcgggcgcuccggcaucgcccugguggccaccggccucgccaagcuggccgagaccgaggggaagggcguguucgacgaggcgaagaagaccgucgaggcccugaacggguaccucgacaagcacaaggacgagguggacaaggccagcgccgacaacaugaucacgaaccugcugaagcacaucgccaaggcgcaggagcucuacaagaacuccagcgcccugcgggcccagggcgcccagaucgacaccgccuucuccagcuacuacuggcuguacaaggcgggcgugacccccgagaccuuccccacggucagccaguuccucuucgagcuggggaagcagccccgcggcaccaagaagaugaagaaggcccugcucuccacccccaugaagugggggaagaagcuguacgagcuguucgccgacgacagcuuccagcagaaccggaucuacaugcaccccgccgugcucaccgcgggccgcaucuccgagaugggggugugcuucggcacgaucccggucgccaaccccgacgacgccgcccagggcagcgggcacaccaaguccauccugaaccugcggaccaacaccgagacgaacaaccccugcgccaagaccaucgugaagcuguucgagauccagaagaccggcuucaacauccaggacauggacaucgucgcgagcgagcaccuccugcaccagucccucguggggaagcagagccccuuccagaacgccuacaacgugaagggcaacgccaccuccgccaacaucaucuga

SEQ ID NO: 6697 - RNA, 1449 nt, Artificial Sequence
  derived and/or modified CDS sequence (opt1) from CCHFV(TAJ/HU8978)__AY297691.2__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccggcgccacggacgacgcgcagaaggacuccaucuacgccagcgcccuggucgaggccaccaaguucugcgccccgaucuacgagugcgcguggguguccagcaccgggaucgugaagaagggccuggagugguucgagaagaacgccgggaccaucaaguccugggacgagagcuacacggagcucaaggucgaggugcccaagaucgagcagcuggccaacuaccagcaggccgcgcugaaguggcggaaggacaucggcuuccgcgugaacgccaacaccgccgcccucucccacaagguccuggccgaguacaaggugcccggcgagaucgugaugagcgucaaggagaugcuguccgacaugauccggcgccggaaccucuuccugaaccgcgggggcgacgagaacccccgggggccggugagccgcgagcacguggaguggugccgggaguucgucaagggcaaguacaucauggcguucaacccgcccuggggcgacaucaacaaguccgggcgcagcggcaucgcccugguggccaccgggcucgccaagcuggccgagaccgagggcaaggggguguucgacgaggcgaagcggacggucgaggcccugaacggcuaccucgacaagcacaaggacgagguggacaaggccuccgccgacaacaugaucaccaaccugcugaagcacaucgccaaggcgcaggagcucuacaagaacagcuccgcccugcgcgcccagggcgcccagaucgacaccagcuucuccagcuacuacuggcuguacaaggccgggcggacccccgagacguuccccaccgugagccaguuccucuucgagcugggcaagcagccccgcgggaccaagaagaugaagaaggcgcugcucuccacccccaugaaguggggcaagaagcuguacgagcuguucgccgacgacagcuuccagcagaaccggaucuacaugcaccccgccguccucacggccgggcgcaucuccgagaugggcgugugcuucggcaccaucccgguggcgaaccccgacgacgccgcccaggggagcggccacaccaaguccauccugaaccugcggaccaacacggagaccaacaaccccugcgccaagaccaucgucaagcuguucgagauccagaagaccggguucaacauccaggacauggacaucguggccagcgagcaccuccugcaccagucccucgucggcaagcagagccccuuccagaacgcguacaacgugaaggggaacgccacguccgccaacaucaucuga

SEQ ID NO: 6698 - RNA, 1449 nt, Artificial Sequence
  derived and/or modified CDS sequence (opt1) from CCHFV(Uzbek/TI10145)__AF481799.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccgacuaccagcaggccgcgcugaaguggcggaaggacaucggguuccgcgugaacgccaacaccgccgcccucagccacaagguccuggccgaguacaaggugcccggcgagaucgugauguccgucaaggagaugcugagcgacaugauccggcgccggaaccucauccugaaccgcggcggggacgagaacccccggggcccggugucccgcgagcacguggaguggugccgggaguucgucaaggggaaguacaucauggcguucaacccgcccuggggcgacaucaacaagagcgggcgcuccggcaucgcccugguggccaccggccucgccaagcuggccgagaccgaggggaagggcguguucgacgaggcgaagaagacggucgaggcccugaacggguaccucgacaagcacaaggacgagguggacaaggccagcgccgacaacaugaucaccaaccugcugaagcacaucgccaaggcgcaggagcucuacaagaacuccagcgcccugcgggcccagggcgcccagaucgacaccgccuucuccagcuacuacuggcuguacaaggcgggcgugacccccgagacguuccccaccgucagccaguuccucuucgagcuggggaagcagccccgcggcaccaagaagaugaagaaggcccugcucuccacccccaugaagugggggaagaagcuguacgagcuguucgccgacgacagcuuccagcagaaccggaucuacaugcaccccgccgugcucacggcgggccgcaucuccgagaugggggugugcuucggcaccaucccggucgccaaccccgacgacgccgcccagggcagcgggcacaccaaguccauccugaaccugcggaccaacacggagaccaacaaccccugcgccaagaccaucgugaagcuguucgagauccagaagaccggcuucaacauccaggacauggacaucgucgcgagcgagcaccuccugcaccagucccucguggggaagcagagccccuuccagaacgccuacaacgugaagggcaacgccacguccgccaacaucaucuga

SEQ ID NO: 6699 - RNA, 1449 nt, Artificial Sequence
  derived and/or modified CDS sequence (opt1) from CCHFV(ROS/TI28044)__AY277672.1__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaagaacagcggcaccaucaaguccugggacgagaacuacgccgagcucaagguggacguccccaagaucgagcagcuggccaacuaccagcaggccgcgcugaaguggcgcaaggacaucggguuccgggugaacgccaacacggccgcccucagcaacaaggugcuggccgaguacaagguccccggcgagaucgugauguccgugaaggagaugcugagcgacaugauccgccggcgcaaccucauccugaaccggggcggggacgagaacccccgcggcccggucucccgggagcacguggaguggugccgcgaguucgugaaggggaaguacaucauggcguucaacccgcccuggggcgacaucaacaagcccgggcggagcggcaucgcccuggucgccaccggccucgccaagcuggccgagaccgaggggaagggcguguucgacgaggcgaagaagaccguggaggcccugaacggguaccucgacaagcaccgcgacgaggucgacaaggccuccgccgacagcaugaucgccaaccugcugaagcacaucgcgaaggcccaggagcucuacaagaacuccagcgcccugcgggcccagggcgcccagaucgacacgcccuucuccagcuucuacuggcuguacaaggcgggcgugacccccgagaccuuccccaccaucagccaguuccucuucgagcuggggaagcagccccgcggcacgaagaagaugaagaaggcccugcucuccaccccgaugaagugggggaagaagcuguacgagcuguucgccgacgacagcuuccagcagaaccggaucuacaugcaccccgccgugcucaccgcgggccgcaucuccgagaugggggucugcuucggcaccauccccguggccaaccccgacgacgccgcccagggcagcgggcacacgaaguccauccugaaccugcggaccagcaccgagaccaacaacccgugcgccaagacgaucgugaagcuguucgagauccagaagaccggcuucaacauccaggacauggacaucgucgcguccgagcaccuccugcaccagagccucguggggaagcagucccccuuccagaacgccuacaacgucaagggcaacgccaccagcgccaacaucaucuga

SEQ ID NO: 6700 - RNA, 1449 nt, Artificial Sequence
  derived and/or modified CDS sequence (opt1) from CCHFV(7001)__AF415236.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagcgggggcuggagugguucgagaagaacgccggcaccaucaagagcugggacgaguccuacacggagcucaaggucgaggugcccaagaucgagcagcuggccgacuaccagcaggccgcgcugaaguggcgcaaggacaucggguuccgggugaacgccaacaccaccgcccucagccacaagguccuggccgaguacaaggugcccggcgagaucgugauguccgucaaggagaugcugagcgacaugauccgccggcgcaaccucauccugaaccggggcggggacgagagcccccgcggcccggugucccgggagcacguggaguggugccgcgaguucgucaaggggaaguacaucauggccuucaacccgcccuggggcgacaucaacaaguccgggcggagcggcaucgcgcugguggccaccggccucgccaagcuggccgagacggaggggaagggcguguucgacgaggccaagaagaccgucgaggcgcugaacggguaccucaacaagcacaaggacgagguggacaaggccuccgccgacagcaugaucaccaaccugcugaagcacaucgccaaggcccaggagcucuacaagaacuccagcgcgcugcgcgcccagggcgcccagaucgacaccgccuucagcuccuacuacuggcuguacaaggccggcgugacgcccgagaccuuccccaccgucagccaguuccucuucgagcuggggaagcagccccggggcaccaagaagaugaagaaggcgcugcucuccacgccccugaagugggggaagaagcuguacgagcuguucgccgacgacagcuuccagcagaaccgcaucuacaugcaccccgccgugcugaccgccggccggaucuccgagaugggggugugcuucggcaccaucccggucgcgaaccccgacgacgccgcccagggcagcgggcacaccaaguccauccugaaccuccgcacgaacaccgagaccaacaaccccugccccaagaccaucgugaagcuguucgagauccagaagacgggcuucaacauccaggacauggacaucgucgccagcgagcaccuccuccaccagucccugguggggaagcagagcccguuccagaacgccuacaacgugaagggcaacgcgaccuccgccaacaucaucuga

SEQ ID NO: 6701 - RNA, 1449 nt, Artificial Sequence
  derived and/or modified CDS sequence (opt1) from CCHFV(79121M18)__GU477494.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagcgggggcuggagugguucgagaagaacgccggcaccaucaagagcugggacgaguccuacacggagcucaaggucgaggugcccaagaucgagcagcuggccgacuaccagcaggccgcgcugaaguggcgcaaggacaucggguuccgggugaacgccaacaccaccgcccucagccacaagguccuggccgaguacaaggugcccggcgagaucgugauguccgucaaggagaugcugagcgacaugauccgccggcgcaaccucauccugaaccggggcggggacgagagcccccgcggcccggugucccgggagcacguggaguggugccgcgaguucgucaaggggaaguacaucauggccuucaacccgcccuggggcgacaucaacaaguccgggcggagcggcaucgcgcugguggccaccggccucgccaagcuggccgagacggaggggaagggcguguucgacgaggccaagaagaccgucgaggcgcugaacggguaccucaacaagcacaaggacgagguggacaaggccuccgccgacagcaugaucaccaaccugcugaagcacaucgccaaggcccaggagcucuacaagaacuccagcgcgcugcgcgcccagggcgcccagaucgacaccgccuucagcuccuacuacuggcuguacaaggccggcgugacgcccgagaccuuccccaccgucagccaguuccucuucgagcuggggaagcagccccggggcaccaagaagaugaagaaggcgcugcucuccacgccccugaagugggggaagaagcuguacgagcuguucgccgacgacagcuuccagcagaaccgcaucuacaugcaccccgccgugcugaccgccggccggaucuccgagaugggggugugcuucggcaccaucccggucgcgaaccccgacgacgccgcccagggcagcgggcacaccaaguccauccugaaccuccgcacgaacaccgagaccaacaaccccugcgccaagaccaucgugaagcuguucgagauccagaagacgggcuucaacauccaggacauggacaucgucgccagcgagcaccuccuccaccagucccugguggggaagcagagccccuuccagaacgcguacaacgugaagggcaacgccaccuccgccaacaucaucuga

SEQ ID NO: 6702 - RNA, 1449 nt, Artificial Sequence
  derived and/or modified CDS sequence (opt1) from CCHFV(AP92)__DQ211638.1__N
auggagaacaagaucgaggugaacagcaaggacgaccugaacaagugguucgaggaguucaagaagggcaacgggcucgucgacaccuucaccaacuccuacagcuucugcgagaacgugcccaaccuggaccgcuucguguaccagauggccuccgccacggacgacgcgcagaaggacagcaucuacgccuccgcccuggucgaggccaccaaguacugcgccccgaucuacgagugcgcgugggugagcuccaccggcaucgugaagaaggggcucgagugguucgagaagaacaccagcacgaucaaguccugggacgagagcuacaccgagcugaaggucgacauccccaagaucgagcagcuguccagcuaccagcaggccgcccucaaguggcggaaggacaucggcuuccgcaucaacgccaacaccaccgcgcuguccaacaaggugcuggccgaguacaaggugcccggggagauccucguccccgugaaggagaugcugagcgacaugauccggcgccggaacaucauccugaaccgcggcuccgacgagaacccgcggggccccgugagccacgagcacaucgaguggugccgcgaguucaucaaggggaaguacaucauggccuucaacccgcccuggggcgacaucaacaaguccgggcggagcggcaucgcccucgucgccacggggcuggcgaagcuggccgagaccgagggcaagggcguguucgaggaggccaagaagaccguggaggcccucaaggacuaccuggacaagcaccgcgacgaggucgacaagaccuccgccgacaacauggugacgagccugcucaagcacaucgcgaaggcccaggagcuguacaagaacagcuccgcccugcgggcccagggggcccagaucgacacccccuucagcuccuucuacuggcucuacaaggcgggcgugacccccgagaccuuccccacggucagccaguuccuguucgagcuggggaagcagccccgcggcaccaagaagaugaagaaggcccuccuguccaccccgaugaaguggggcaagaagcuguacgagcuguucgccgacgacagcuuccagcagaaccggaucuacaugcaccccgccgugcugaccgccgggcgcaucuccgagaugggcgugugcuucgggacgauccccgucgcgaaccccgacgacgccgcccagggcagcgggcacaccaaguccauccugaaccuccggaccaacaccgagagcaacaacccgugcgcccgcacgaucgugaagcuguucgagauccagaagaccggcuucgacaucaaggacauggacaucguggcguccgagcaccuccuccaccagagccuggucggcaagcagucccccuuccagaacgccuacaacgugaaggggaacgccaccagcgccaacaucaucuga

SEQ ID NO: 6703 - RNA, 1449 nt, Artificial Sequence
  derived and/or modified CDS sequence (opt1) from CCHFV(ArD15786)__DQ211640.1__N
auggagaacaagaucgaggugaacaacaaggacgagcugaacaagugguucgaggaguucaagaagggcaacgggcucgucgacaccuucaccaacagcuacuccuucugcgagaacgugcccaaccuggaccgcuucguguuccagauggccggcgccacggacgacgcgcagaaggacagcaucuacgccuccgcccuggucgaggccaccaaguacugcgccccgaucuacgagugcgcgugggugagcuccaccgggaucgugaagcggggccucgagugguucgagaagaacaccgggacgaucaagagcugggacgaguccuacaccgagcugaaggucgacgugcccaagaucgagcagcuggccaacuaccagcaggccgcccucaaguggcgcaaggacaucggcuuccgggugaacgcgaacaccgccgcccugagcaacaagguccuguccgaguacaaggugcccggcgagaucgugaugagcgucaaggagaugcucuccgacaugauccgccggcgcaaccugauccugaaccgcgggggcgacgagaacccccgggggccggugagcaaggagcacaucgaguggugccgggaguucgugaagggcaaguacaucauggccuucaacccgcccuggggcgacgucaacaaguccgggcgcagcggcaucgcccucguggcgaccgggcuggccaagcuggccgagacggagggcaaggggguguucgaggaggccaagaagaccgucgaggcccucaaggaguaccuggacaagcacaaggacgagguggacaaggcguccgccgacagcauggugaccaaccugcucaagcacaucaccaaggcccaggagcuguacaagaacuccagcgcccugcgggcccagggcgcgcagaucgacacgcccuucuccagcuucuacuggcucuacaaggccggcgucacccccgagaccuuccccaccgugagccaguuccuguucgagcuggggaagcagccccgcggcacgaagaagaugaagaaggcccuccuguccacccccaugaagugggggaagaagcuguacgagcuguucgccgacgacagcuuccagcagaaccggaucuacaugcacccggccgugcugaccgcgggccgcaucuccgagaugggggucugcuucggcaccauccccguggccaaccccgacgacgccgcccagggcagcgggcacacgaaguccauccugaaccuccggaccaacagcgagaccaacaaccccugcgcgaagaccaucgucaagcuguucgaggugcagaagacgggcuucaacauccaggacauggacaucguggccuccgagcaccuccuccaccagagccuggucgggaagcaguccccguuccagaacgccuacaacgugaagggcaacgccaccagcgccaacaucaucuga

SEQ ID NO: 6704 - RNA, 1449 nt, Artificial Sequence
  derived and/or modified CDS sequence (opt1) from CCHFV(ArD39554)__DQ211641.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgacaaguucguguuccagauggccuccgccacggacgacgcgcagaaggacagcaucuacgccuccgcccuggucgaggccaccaaguucugcgccccgaucuacgagugcgcgugggugagcuccaccggcaucgugaagcgcgggcuggagugguucgagaagaacgccggcaccaucaagagcugggacgaguccuacacggagcucaaggucgacgugcccaagaucgagcagcuggccaacuaccagcaggccgcgcugaaguggcggaaggacaucggguuccgcgugaacgccaacaccgccgcccucagcaacaagguccuggccgaguacaaggugcccggcgagaucgugauguccgucaaggagaugcugagcgacaugauccggcgccggaaccagauccucaaccgcggcggggacgagaacccccggggcccggugucccgcgagcacguggacuggugccgggaguucgucaaggggaaguacaucauggcguucaacccgcccuggggcgacaucaacaagagcgggcgcuccggcaucgcccugguggccaccggccuggccaagcucgccgagaccgaggggaagggcguguucgacgaggcgaagaagacggucgaggcccugaacggguaccuggacaagcacaaggacgagguggacaaggccagcgccgacuccaugaucaccaaccuccugaagcacaucgccaaggcgcaggagcuguacaagaacagcuccgcccuccgggcccagggcgcccagaucgacaccgccuucagcagcuacuacuggcuguacaaggcgggcgugacccccgagacguuccccaccgucucccaguuccuguucgagcucgggaagcagccccgcggcaccaagaagaugaagaaggcccugcugaccacgcccaugaagugggggaagaagcucuacgagcuguucgccgacgacagcuuccagcagaaccggaucuacaugcaccccgccgugcugaccgcgggccgcaucuccgagaugggggugugcuucggcaccaucccggucgccaaccccgacgacgccgcccagggcagcgggcacaccaaguccauccucaaccugcggacgaacaccgagaccaacaaccccugcgcccgcaccaucgugaagcuguucgagauccagaagacgggcuucaacauccaggacauggacaucgucgcgagcgagcaccuccugcaccagucccugguggggaagcagagccccuuccagaacgccuacaacgugaagggcaacgccaccuccgccaacaucaucuga

SEQ ID NO: 6705 - RNA, 1449 nt, Artificial Sequence
  derived and/or modified CDS sequence (opt1) from CCHFV(BT958)__EF123122.1__N
auggagaacaagaucgaggugaacaacaaggacgagaugaaccgcugguucgaggaguucaagaaggagaacggccuggucgacaccuucaccaacagccacuccuucugcgagagcgugcccaaccucgacaaguucguguuccagauggccuccgccacggacgacgcgcagaaggacagcaucuacgccgccgcccuggucgaggccaccaaguucugcgcgccgaucuacgagugcgccuggguguccagcaccgggaucgugaagaagggccuggagugguucgagaagaacgccgggaccaucaaguccugggacgagagcuacacggagcucaaggucgaggugcccaagaucgagcagcuguccaacuaccagcaggccgcgcugaaguggcggaaggacaucggcuuccgcgugaacgccaacaccgccacccucagccacaagguccuggccgaguacaaggugcccggggagaucgugauguccgucaaggagaugcugagcgacaugauccggcgccggaaccucauccugaaccgcggcggcgacgagaacccccgggggccggugucccgcgagcacguggaguggugccgggaguucgucaagggcaaguacaucauggccuucaacccgcccuggggcgacaucaacaagagcgggcgcuccgggaucgcgcugguggccaccggccucgccaagcuggccgaggccgagggcaaggggguguucgacgaggcgaagaagacggucgaggcccugaacggcuaccucgacaagcacaaggacgagguggacaagagcuccgccgacagcaugaucaccaaccugcugaagcacaucgccaaggcccaggagcucuaccggaacuccagcgcgcugcgcgcccagggggcccagaucgacaccgccuucagcuccuacuacuggcuguacaaggccggcgugacccccgagacguuccccaccgucagccaguuccucuucgagcugggcaagcagccccgggggaccaagaagaugaagaaggcgcugcucuccacccccaugaaguggggcaagaagcuguacgagcuguucgccgacgacagcuuccagcagaaccgcaucuacaugcaccccgccgugcucacggccgggcggaucuccgagaugggcgugugcuucgggaccaucccggucgcgaaccccgacgacgccgcccugggcagcggccacaccaaguccauccugaaccuccgcaccagcacggaggccaacaaccccugcgccaagaccaucgugaagcuguucgagauccagaagaagggguucgucaucaaggacauggacaucguggcguccgagcaccuccugcaccagagccuggugggcaagcagucccccuuccagaacgccuacaacgucaaggggaacgccaccagcgccaacaucaucuga

SEQ ID NO: 6706 - RNA, 1449 nt, Artificial Sequence
  derived and/or modified CDS sequence (opt1) from CCHFV(C-68031)__DQ211642.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgagcgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacaucgagcucaaggucgaggugcccaagaucgagcagcuggccaacuaccagcaggccgcgcugaaguggcggaaggacaucggguuccgcgugaacgccaacacggccgcccucagccacaagguccuggccgaguacaaggugcccggcgagaucgugauguccgucaaggagaugcugagcgacaugauccggcgccggaaccucauccugaaccgcggcggggacgagaacccccggggcccggugucccgcgagcacguggaguggugccgggaguucgucaaggggaaguacaucauggcguucaacccgcccuggggcgacaucaacaagagcgggcgcuccggcaucgcccugguggccaccggccucgccaagcuggccgagaccgaggggaagggcguguucgacgaggcgaagaagaccgucgaggcccugaacggguaccucgacaagcacaaggacgagguggacaaggccagcgccgacaacaugaucacgaaccugcugaagcacaucgccaaggcgcaggagcucuacaagaacuccagcgcccugcgggcccagggcgcccagaucgacaccgccuucuccagcuacuacuggcuguacaaggcgggcgugacccccgagaccuuccccacggucagccaguuccucuucgagcuggggaagcagccccgcggcaccaagaagaugaagaaggcccugcucuccacccccaugaagugggggaagaagcuguacgagcuguucgccgacgacagcuuccagcagaaccggaucuacaugcaccccgccgugcucaccgcgggccgcaucuccgagaugggggugugcuucggcacgaucccggucgccaaccccgacgacgccgcccagggcagcgggcacaccaaguccauccugaaccugcggaccaacaccgagacgaacaaccccugcgccaagaccaucgugaagcuguucgagauccagaagaccggcuucaacauccaggacauggacaucgucgcgagcgagcaccuccugcaccagucccucguggggaagcagagccccuuccagaacgccuacaacgugaagggcaacgccaccuccgccaacaucaucuga

SEQ ID NO: 6707 - RNA, 1449 nt, Artificial Sequence
  derived and/or modified CDS sequence (opt1) from CCHFV(China)__AF354296.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgagcgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccaacuaccagcaggccgcgcugaaguggcggaaggacaucggguuccgcgugaacgccaacaccgccgcccucagccacaagguccuggccgaguacaaggugcccggcgagaucgugauguccgucaaggagaugcugagcgacaugauccggcgccggaaccucauccugaacuccggcggggacgagaacccccgcggcccggugagccgggagcacguggaguggugccgcgaguucgucaaggggaaguacaucauggcguucaacccgcccuggggcgacaucaacaaguccgggcggagcggcaucgcccugguggccaccggccucgccaagcuggccgagaccgggggcaaggggguguucgacgaggcgaagaagacggucgaggcccugaacggcuaccucgacaagcacaaggacgagguggacaaggccuccgccgacaacaugaucaccaaccugcugaagcacaucgccaaggcgcaggagcucuacaagaacagcuccgcccugcgcgcccagggcgcccagaucgacaccgccuucagcagcuacuacuggcuguacaaggcgggggccacccccgagacguuccccaccgugucccaguuccucuucgagcugggcaagcagccccgggggaccaagaagaugaagaaggcccugcucagcacccccaugaaguggggcaagaagcuguacgagcuguucgccgacgacuccuuccagcagaaccgcaucuacaugcaccccgcgguccucacggccgggcggaucagcgagaugggcgugugcuucggcaccaucccgguggccaaccccgacgacgccgcccagggguccggccacaccaagagcauccugaaccugcgcaccaacacggagaccaacaaccccugcgcgaagaccaucguccggcuguucgagauccagaagaccggguucaacauccaggacauggacaucguggccuccgagcaccuccugcaccagagccucgucggcaagcagucccccuuccagaacgccuacaacgugaaggggaacgccacgagcgccaacaucaucuga

SEQ ID NO: 6708 - RNA, 1449 nt, Artificial Sequence
  derived and/or modified CDS sequence (opt1) from CCHFV(China)__AF358784.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagcgggggcuggagugguucgagaagaacgccggcaccaucaagagcugggacgaguccuacacggagcucaaggucgaggugcccaagaucgagcaguucgccgacuaccagcaggccgcgcugaaguggcgcaaggacaucggguuccgggugaacgccaacaccaccgcccugagccacaagguccucgccgaguacaaggugcccggcgagaucgugauguccgucaaggagaugcugagcgacaugauccgccggcgcaaccugauccucaaccggggcggggacgagagcccccgcggcccggugucccgggagcacguggaguggugccgcgaguucgucaaggggaaguacaucauggccuucaacccgcccuggggcgacaucaacaaguccgggcggagcggcaucgcgcugguggccaccggccuggccaagcucgccgagacggaggggaagggcguguucgacgaggccaagaagaccgucgaggcgcugaacggguaccugaacaagcacaaggacgagguggacaaggccuccgccgacagcaugaucaccaaccuccugaagcacaucgccaaggcccaggagcuguacaagaacuccagcgcgcuccgcgcccagggcgcccagaucgacaccgccuucagcuccuacuacuggcuguacaaggccggcgugacgcccgagaccuuccccaccgucagccaguuccuguucgagcucgggaagcagccccggggcaccaagaagaugaagaaggcgcugcuguccacgccccucaagugggggaagaagcuguacgagcuguucgccgacgacagcuuccagcagaaccgcaucuacaugcaccccgccgugcucaccgccggccggaucuccgagaugggggugugcuucggcaccaucccggucgcgaaccccgacgacgccgcccagggcagcgggcacaccaaguccauccugaaccugcgcacgaacaccgagaccaacaaccccugcgccaagaccaucgugaagcuguucgagauccagaagacgggcuucaacauccaggacauggacaucgucgccagcgagcaccuccugcaccagucccucguggggaagcagagccccuuccagaacgcguacaacgugaagggcaacgccaccuccgccaacaucaucuga

SEQ ID NO: 6709 - RNA, 1449 nt, Artificial Sequence
  derived and/or modified CDS sequence (opt1) from CCHFV(China)__AF362080.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgagcgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcugaccaacuaccagcaggccgcccugaaguggcggaaggacaucggguuccgcgugaacgcgaacaccgccgcccucagccacaagguccuggccgaguacaaggugcccggcgagaucgugauguccgucaaggagaugcugagcgacaugauccggcgccggaaccucauccugaaccgcggcggggacgagaacccccggggcccggugucccgcgagcacguggaguggugccgggaguucgucaaggggaccuacaucauggccuucaacccgcccuggggcgacaucaacaagagcgggcgcuccggcaucgcgcugguggccacgggccucgccaagcuggccgagaccgaggggaagggcguguucgacgaggccaagaagaccgucgaggcgcugaacggguaccucgacaagcacaaggacgagguggacaaggccagcgccgacaacaugaucaccaaccugcugaagcacaucgccaaggcccaggagcucuacaagaacuccagcgcgcugcgggcccagggcgcccagaucgacacggccuucuccagcuacuacuggcuguacaaggccggcgugacccccgagaccuuccccaccgucagccaguuccucuucgagcuggggaagcagccccgcggcacgaagaagaugaagaaggcgcugcucuccacccccaugaagugggggaagaagcuguacgagcuguucgccgacgacagcuuccagcagaaccggaucuacaugcaccccgccgugcucaccgccggccgcaucuccgagaugggggugugcuucggcaccaucccggucgcgaaccccgacgacgccgcccagggcagcgggcacacgaaguccauccugaaccugcggaccaacaccgagaccaacaaccccugcgccaagacgaucgugaagcuguucgagauccagaagaccggcuucaacauccaggacauggacaucgucgccagcgagcaccuccugcaccagucccucguggggaagcagagccccuuccagaacgcguacaacgugaagggcaacgccaccuccgccaacaucaucuga

SEQ ID NO: 6710 - RNA, 1449 nt, Artificial Sequence
  derived and/or modified CDS sequence (opt1) from CCHFV(China)__AY029157.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgagcgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccaacuaccagcaggccgcgcugaaguggcggaaggacaucggguuccgcgugaacgccaacaccgccgcccucagccacaagguccuggccgaguacaaggugcccggcgagaucgugauguccgucaaggagaugcugagcgacaugauccggcgccggaaccucauccugaaccgcggcggggacgagaacccccggggcccggugucccgcgagcacguggaguggugccgggaguucgucaaggggaaguacaucauggcguucaacccgcccuggggcgacaucaacaagagcgggcgcuccggcaucgcccugguggccaccggccucgccaagcuggccgagaccgaggggaagggcguguucgacgaggcgaagaagacggucgaggcccugaacggguaccucgacaagcacaaggacgagguggacaaggccagcgccgacaacaugaucaccaaccugcugaagcacaucgccaaggcgcaggagcucuacaagaacuccagcgcccugcgggcccagggcgcccagaucgacaccgccuucuccagcuacuacuggcuguacaaggcgggcgugacccccgagacguuccccaccgucagccaguuccucuucgagcuggggaagcagccccgcggcaccaagaagaugaagaaggcccugcucuccacccccaugaagugggggaagaagcuguacgagcuguucgccgacgacagcuuccagcagaaccggaucuacaugcaccccgccgugcucacggcgggccgcaucuccgagaugggggugugcuucggcaccaucccggucgccaaccccgacgacgccgcccagggcagcgggcacaccaaguccauccugaaccugcggaccaacacggagaccaacaaccccugcgccaagaccaucgugaagcuguucgagauccagaagaccggcuucaacauccaggacauggacaucgucgcgagcgagcaccuccugcaccagucccucguggggaagcagagccccuuccagaacgccuacaacgugaagggcaacgccacguccgccaacaucaucuga

SEQ ID NO: 6711 - RNA, 1449 nt, Artificial Sequence
  derived and/or modified CDS sequence (opt1) from CCHFV(DAK 8194)__U88411.1__N
auggagaacaagaucgaggugaacaacaaggacgagcugaacaagugguucgaggaguucaagaagggcaacgggcucgucgacaccuucaccaacagcuacuccuucugcgagaacaugcccaaccuggaccgcuucguguuccagauggccggcgccacggacgacgcgcagaaggacagcaucuacgccuccgcccugguggaggccaccaaguacugcgccccgaucuacgagugcgcgugggucagcuccaccgggaucgugaagcggggccucgagugguucgagaagaacaccgggacgaucaagagcugggacgaguccuacaccgagcugaagguggacguccccaagaucgagcagcuggccaacuaccagcaggccgcccucaaguggcgcaaggacaucggcuuccgggugaacgcgaacaccgccgcccugagcaacaaggugcuguccgaguacaagguccccggcgagaucgugaugagcgugaaggagaugcucuccgacaugauccgccggcgcaaccugauccugaaccgcgggggcgacgagaacccccgggggccggucagcaaggagcacaucgaguggugccgggaguucgugaagggcaaguacaucauggccuucaacccgcccuggggcgacgugaacaaguccgggcgcagcggcaucgcccucgucgcgaccgggcuggccaagcuggccgagacggagggcaaggggguguucgaggaggccaagaagaccguggaggcccucaaggaguaccuggacaagcacaaggacgaggucgacaaggcguccgccgacagcauggugaccaaccugcucaagcacaucaccaaggcccaggagcuguacaagaacuccagcgcccugcgggcccagggcgcgcagaucgacacgcccuucuccagcuucuacuggcucuacaaggccggcgugacccccgagaccuuccccaccgucagccaguuccuguucgagcuggggaagcagccccgcggcacgaagaagaugaagaaggcccuccuguccacccccaugaagugggggaagaagcuguacgagcuguucgccgacgacagcuuccagcagaaccggaucuacaugcacccggccgugcugaccgcgggccgcaucuccgagaugggggugugcuucggcaccauccccgucgccgaccccgacgacgccgcccagggcagcgggcacacgaaguccauccugaaccuccggaccagcuccgagaccaacaaccccugcgcgaagaccaucgugaagcuguucgagguccagaagacgggcuucaacauccaggacauggacaucguggccagcgagcaccuccuccaccagucccugguggggaagcagagcccguuccagaacgccuacaacgucaagggcaacgccaccuccgccaacaucaucuga

SEQ ID NO: 6712 - RNA, 1449 nt, Artificial Sequence
  derived and/or modified CDS sequence (opt1) from CCHFV(Drosdov)__U88412.1__N
auggagaacaagaucgaggugaacagcaaggacgagaugaacaagugguucgaggaguucaagaaggagaacggccugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccgggaucgugaagaagggccuggagugguucgagaagaacagcgggaccaucaaguccugggacgagaacuacacggagcucaagguggacguccccaagaucgagcagcuggccaacuaccagcaggccgcccugaaguggcgcaaggacaucggcuuccgggugaacgcgaacaccgccgcccucagcaacaaggugcuggccgaguacaagguccccggggagaucgugauguccgugaaggagaugcugagcgacaugauccgccggcgcaaccucauccugaaccggggcggcgacgagaacccccgcgggccggucucccgggagcacguggaguggugccgcgaguucgugaagggcaaguacaucauggccuucaacccgcccuggggcgacaucaacaagagcgggcgguccgggaucgcgcuggucgccaccggccucgccaagcuggccgagaccgagggcaaggggguguucgacgaggccaagaagacgguggaggcgcugaacggcuaccucgacaagcaccgcgacgaggucgacaaggccagcgccgacuccaugaucaccaaccugcugaagcacaucgccaaggcccaggagcucuacaagaacagcuccgcgcugcgggcccagggggcccagaucgacacccccuucagcagcuucuacuggcuguacaaggccggcgugacccccgagacguuccccaccaucucccaguuccucuucgagcugggcaagcagccccgcgggaccaagaagaugaagaaggcccugcucagcacccccaugaaguggggcaagaagcuguacgagcuguucgcggacgacuccuuccagcagaaccggaucuacaugcacccggccgugcucacggccgggcgcaucagcgagaugggcgucugcuucgggaccauccccguggccaaccccgacgacgcggcccagggcuccggccacaccaagagcauccugaaccugcggaccuccacggagaccaacaaccccugcgccaagaccaucgugaagcuguucgagauccagaagaccggguucaacauccaggacauggacaucgucgccagcgagcaccuccugcaccagucccucgugggcaagcagagcccguuccagaacgccuacaacgucaaggggaacgcgacguccgccaacaucaucuga

SEQ ID NO: 6713 - RNA, 1449 nt, Artificial Sequence
  derived and/or modified CDS sequence (opt1) from CCHFV(Eskisehir23-2012)__KR092376.1__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaagaacaccggcacgaucaagagcugggacgagaacuacgccgagcucaagguggacguccccaagaucgagcagcuggccaacuaccagcaggccgcgcugaaguggcgcaaggacaucggguuccgggugaacgccaacaccgccgcccucuccaacaaggugcuggccgaguacaagguccccggcgagaucgugaugagcgugaaggagaugcuguccgacaugauccgccggcgcaaccucauccugaaccggggcgggggcgagaacccccgcgggccggucagccgggagcacguggaguggugccgcgaguucgugaagggcaaguacaucauggcguucaacccgcccuggggcgacaucaacaaguccgggcggagcggcaucgcccuggucgccaccgggcucgccaagcuggccgagaccgagggcaaggggguguucgacgaggcgaagcgcacgguggaggcccugaacggcuaccucgacaagcaccgggacgaggucgacaaggccuccgccgacagcaugaucaccaaccugcugaagcacaucgccaaggcgcaggagcucuacaagaacuccagcgcccugcgcgcccagggcgcccagaucgacacccccuucuccagcuucuacuggcuguacaaggccggggugacccccgagacguuccccaccaucagccaguuccucuucgagcugggcaagcagccccgggggaccaagaagaugaagaaggcgcugcucuccacccccaugaaguggggcaagaagcuguacgagcuguucgccgacgacagcuuccagcagaaccgcaucuacaugcacccggccgugcucacggccgggcggaucuccgagaugggcgucugcuucggcaccauccccguggcgaaccccgacgacgccgcccaggggagcggccacaccaaguccauccugaaccugcgcaccagcacggagaccaacaaccccugcgccaagaccaucgugaagcuguucgagauccagaagaccggguucaacauccaggacauggacaucgucgccuccgagcaccuccugcaccagagccucgugggcaagcaguccccguuccagaacgcguacaacgucaaggggaacgccacgagcgccaacaucaucuga

SEQ ID NO: 6714 - RNA, 1449 nt, Artificial Sequence
  derived and/or modified CDS sequence (opt1) from CCHFV(Hodzha)__AY223475.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccaacuaccagcaggccgcgcugaaguggcggaaggacaucggguuccgcgugaacgccaacaccgccgcccucagccacaagguccuguccgaguacaaggugcccggcgagaucgugaugagcgucaaggagaugcuguccgacaugauccggcgccggaaccucauccugaaccgcggcggggacgagaacccccggggcccggugagccgcgagcacguggaguggugccgggaguucgucaaggggaaguacaucauggccuucaacccgcccuggggcgacaucaacaaguccgggcgcagcggcaucgcgcugguggccaccggccucgccaagcuggccgagaccgaggggaagggcguguucgacgaggccaagaagacggucgaggcgcugaacggguaccucgacaagcacaaggacgagguggacaaggccuccgccgacaacaugaccaccaaccugcugaagcacaucgccaaggcccaggagcucuacaagaacagcuccgcgcugcgggcccagggcgcccagaucgacaccgccuucagcagcuacuacuggcuguacaaggccggcgugacgcccgagaccuuccccaccgucucccaguuccucuucgagcuggggaagcagccccgcggcaccaagaagaugaagaaggcgcugcucagcacgcccaugaagugggggaagaagcuguacgagcuguucgccgacgacuccuuccagcagaaccggaucuacaugcaccccgccgugcucaccgccggccgcaucagcgagaugggggugugcuucggcaccgucccgguggcggaccccgacgacgccgcccagggcuccgggcacaccaagagcauccugaaccugcggacgaacaccgagaccaacaaccccugcgccaagaccaucgucaagcuguucgagauccagaagacgggcuucaacauccaggacauggacaucguggccuccgagcaccuccugcaccagagccucguggggaagcagucccccuuccagaacgcguacaacgucaagggcaacgccaccagcgccaacaucaucuga

SEQ ID NO: 6715 - RNA, 1449 nt, Artificial Sequence
  derived and/or modified CDS sequence (opt1) from CCHFV(Iran-52)__DQ446212.1__N
auggagaacaagaucgaggugaacagcaaggacgagaugaacaagugguucgaggaguucaagaagggcaacgggcuggucgacaccuucaccaacuccuacagcuucugcgaguccgugcccaaccucgaccgcuucguguuccagauggccagcgccacggacgacgcgcagaaggacuccaucuacgccagcgcccuggucgaggccaccaaguucugcgccccgaucuacgagugcgcgugggccuccagcaccggcaucgugaagaaggggcuggagugguucgagaagaacgccggcaccaucaaguccugggacgagagcuacacggagcucaagguggagguccccaagaucgagcagcuguccaacuaccagcaggccgcgcugaaguggcggaaggacaucggguuccgcgugaacgccaacaccgccgcccucagcaacaaggugcuggccgaguacaagguccccggcgagaucgugauguccgugaaggagaugcugagcgacaugauccggcgccggaaccucauccugaaccgcggcggggacgagaacccccggggcccggucucccgcgagcacguggaguggugccgggaguucgugaaggggaaguacaucauggcguucaacccgcccuggggcgacaucaacaagagcgggcgcuccggcaucgcccuggucgccaccggccucgccaagcuggccgagaccgaggggaagggcguguucgacgaggcgaagaagacgguggaggcccugaacggguaccucgacaagcacaaggacgaggucgacaaggccagcgccgacuccaugaucaccaaccugcugaagcacaucgccaaggcgcaggagcucuacaagaacagcagcgcccugcgggcccagggcgcccagaucgacaccguguucuccagcuacuacuggcuguacaaggccggcgugacccccgacacguuccccaccgucucccaguuccucuucgagcuggggaagcagccccgcggcaccaagaagaugaagaaggcgcugcucagcacccccaugaagugggggaagaagcuguacgagcuguucgccgacgacuccuuccagcagaaccggaucuacaugcaccccgccgugcucacggccggccgcaucagcgagaugggggugugcuucggcaccaucccggucgcgaaccccgacgacgccgcccugggcuccgggcacaccaagagcauccugaaccuccggaccaacacggagaccaacaaccccugcgcccgcaccaucgugaagcuguucgagauccagaagaccggcuucaacauccaggacauggacaucgucgccuccgagcaccuccugcaccagagccugguggggaagcagucccccuuccagaacgcguacaacgugaagggcaacgccacgagcgccaacaucaucuga

SEQ ID NO: 6716 - RNA, 1449 nt, Artificial Sequence
  derived and/or modified CDS sequence (opt1) from CCHFV(Iran-53)__DQ446213.1__N
auggagaacaagaucgaggugaacagcaaggacgagaugaacaagugguucgaggaguucaagaagggcaacgggcuggucgacaccuucaccaacuccuacagcuucugcgaguccgugcccaaccucgaccgcuucguguuccagauggccagcgccacggacgacgcgcagaaggacuccaucuacgccagcgcccuggucgaggccaccaaguucugcgccccgaucuacgagugcgcgugggccuccagcaccggcaucgugaagaaggggcuggagugguucgagaagaacgccggcaccaucaaguccugggacgagagcuacacggagcucaagguggagguccccaagaucgagcagcuguccaacuaccagcaggccgcgcugaaguggcggaaggacaucggguuccgcgugaacgccaacaccgccgcccucagcaacaaggugcuggccgaguacaagguccccggcgagaucgugauguccgugaaggagaugcugagcgacaugauccggcgccggaaccucauccugaacaagggcggggacgagaacccccgcggcccggucucccgggagcacguggaguggugccgcgaguucgugaaggggaaguacaucauggcguucaacccgcccuggggcgacaucaacaagagcgggcgguccggcaucgcccuggucgccaccggccucgccaagcuggccgagaccgaggggaagggcguguucgacgaggcgaagaagacgguggaggcccugaacggguaccucgacaagcacaaggacgaggucgacaaggccagcgccgacuccaugaucaccaaccugcugaagcacaucgccaaggcgcaggagcucuacaagaacagcagcgcccugcgcgcccagggcgcccagaucgacaccguguucuccagcuacuacuggcuguacaaggccggcgugacccccgacacguuccccaccgucucccaguuccucuucgagcuggggaagcagccccggggcaccaagaagaugaagaaggcgcugcucagcacccccaugaagugggggaagaagcuguacgagcuguucgccgacgacuccuuccagcagaaccgcaucuacaugcaccccgccgugcucacggccggccggaucagcgagaugggggugugcuucggcaccaucccggucgcgaaccccgacgacgccgcccugggcuccgggcacaccaagagcauccugaaccuccgcaccaacacggagaccaacaaccccugcgcccggaccaucgugaagcuguucgagauccagaagaccggcuucaacauccaggacauggacaucgucgccuccgagcaccuccugcaccagagccugguggggaagcagucccccuuccagaacgcguacaacgugaagggcaacgccacgagcgccaacaucaucuga

SEQ ID NO: 6717 - RNA, 1449 nt, Artificial Sequence
  derived and/or modified CDS sequence (opt1) from CCHFV(JD 206)__U88414.1__N
auggagaacaagaucgaggugaacagcaaggacgagaugaacaagugguucgaggaguucaagaagggcaacgggcuggucgacaccuucaccaacuccuacagcuucugcgagaacgugcccaaccucgaccgcuucguguuccagauggccuccgccacggacgacgcgcagaaggacagcaucuacgccuccgcccuggucgaggccaccaaguucugcgccccgaucuacgagugcgcgugggccagcuccaccggcaucgugaagaaggggcuggagugguucgagaagaacgccggcaccaucaagagcugggacgaguccuacacggagcucaagguggagguccccaagaucgagcagcugagcaacuaccagcaggccgcgcugaaguggcggaaggacaucggguuccgcgugaacgccaacaccgccgcccucuccaacaaggugcuggccgaguacaagguccccggcgagaucgugaugagcgugaaggagaugcuguccgacaugauccggcgccggaaccucauccugaaccgcggcggggacgagaacccccggggcccggucagccgcgagcacguggaguggugccgggaguucgugaaggggauguacaucauggcguucaacccgcccuggggcgacaucaacaaguccgggcgcagcggcaucgcccuggucgccaccggccucgccaagcuggccgagaccgaggggaagggcguguucgacgaggcgaagaagacgguggaggcccugaacggguaccucgacaagcacaaggacgaggucgacaaggccuccgccgacagcaugaucaccaaccugcugaagcacaucgccaaggcgcaggagcucuacaagaacuccagcgcccugcgggcccagggcgcccagaucgacaccguguucagcuccuacuacuggcuguacaaggccggcgugacccccgacacguuccccaccgucagccaguuccucuucgagcuggggaagcagccccgcggcaccaagaagaugaagaaggcgcugcucuccacccccaugaagugggggaagaagcuguacgagcuguucgccgacgacagcuuccagcagaaccggaucuacaugcaccccgccgugcucacggccggccgcaucuccgagaugggggugugcuucggcaccaucccggucgcgaaccccgacgacgccgcccugggcagcgggcacaccaaguccauccugaaccuccggaccaacacggagaccaacaaccccugcgccaagaccaucgugaagcuguucgagauccagaagaccggcuucaacauccaggacauggacaucgucgccagcgagcaccuccugcaccagucccugguggggaagcagagccccuuccagaacgcguacaacgugaagggcaacgccacguccgccaacaucaucuga

SEQ ID NO: 6718 - RNA, 1449 nt, Artificial Sequence
  derived and/or modified CDS sequence (opt1) from CCHFV(Kashmanov)__DQ211644.1__N
auggagaacaagaucgaggugaacagcaaggacgagaugaacaagugguucgaggaguucaagaaggagaacggccugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccgggaucgugaagaagggccuggagugguucgagaagaacagcgggaccaucaaguccugggacgagaacuacgccgagcucaagguggacguccccaagaucgagcagcuggccaacuaccagcaggccgcgcugaaguggcgcaaggacaucggcuuccgggugaacgccaacacggccgcccucagcaacaaggugcuggccgaguacaagguccccggggagaucgugauguccgugaaggagaugcugagcgacaugauccgccggcgcaaccucauccugaaccggggcggcgacgagaacccccgcgggccggucucccgggagcacguggaguggugccgcgaguucgugaagggcaaguacaucauggcguucaacccgcccuggggcgacaucaacaagagcgggcgguccgggaucgcccuggucgccaccggccucgccaagcuggccgagaccgagggcaaggggguguucgacgaggcgaagaagaccguggaggcccugaacggcuaccucgacaagcaccgcgacgaggucgacaaggccagcgccgacuccaugaucacgaaccugcugaagcacaucgccaaggcgcaggagcucuacaagaacagcuccgcccugcgggcccagggggcccagaucgacacccccuucagcagcuucuacuggcuguacaaggccggcgugacccccgagaccuuccccacgaucucccaguuccucuucgagcugggcaagcagccccgcgggaccaagaagaugaagaaggcgcugcucagcacccccaugaaguggggcaagaagcuguacgagcuguucgccgacgacuccuuccagcagaaccggaucuacaugcacccggccgugcucaccgccgggcgcaucagcgagaugggcgucugcuucgggacgauccccguggcgaaccccgacgacgccgcccagggcuccggccacaccaagagcauccugaaccugcggaccuccaccgagacgaacaaccccugcgccaagaccaucgugaagcuguucgagauccagaagaccggguucaacauccaggacauggacaucgucgccagcgagcaccuccugcaccagucccucgugggcaagcagagcccguuccagaacgcguacaacgucaaggggaacgccaccuccgccaacaucaucuga

SEQ ID NO: 6719 - RNA, 1449 nt, Artificial Sequence
  derived and/or modified CDS sequence (opt1) from CCHFV(NIV 10405051)__JF922681.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccaacuaccagcaggccgcgcugaaguggcggaaggacaucggguuccgcgugaacgccaacaccgccgcccucagccacaagguccuggccgaguacaaggugcccggcgagaucgugauguccgucaaggagaugcugagcgacaugauccggcgccggaaccucauccugaaccgcggcggggacgagaacccccggggcccggugucccgcgagcacguggaguggugccgggaguucgucaaggggaaguacaucauggcguucaacccgcccuggggcgacaucaacaagagcgggcgcuccggcaucgcccugguggccaccggccucgccaagcuggccgagaccgaggggaagggcguguucgacgaggcgaagaagacggucgaggcccugaacggguaccucgacaagcacaaggacgagguggacaaggccagcgccgacaacaugaucaccaaccugcugaagcacaucgccaaggcgcaggagcucuacaagaacuccagcgcccugcgggcccagggcgcccagaucgacaccgccuucuccagcuacuacuggcuguacaaggcgggcgugacccccgagacguuccccaccgucagccaguuccucuucgagcuggggaagcagccccgcggcaccaagaagaugaagaaggcccugcucuccacccccaugcggugggggaagaagcuguacgagcuguucgccgacgacagcuuccagcagaaccgcaucuacaugcaccccgccgugcucacggcgggccggaucuccgagaugggggugugcuucggcaccaucccggucgccaaccccgacgacgccgcccagggcagcgggcacaccaaguccauccugaaccugcgcaccaacacggagaccaacaaccccugcgccaagaccaucgugaagcuguucgagauccagaagaccggcuucaacauccaggacaucgacaucgucgcgagcgagcaccuccugcaccagucccucguggggaagcagagccccuuccagaacgccuacaacgugaagggcaacgccacguccgccaacaucaucuga

SEQ ID NO: 6720 - RNA, 1449 nt, Artificial Sequence
  derived and/or modified CDS sequence (opt1) from CCHFV(Oman)__DQ211645.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggccagcuccaccggcaucgugaagaaggggcuggagugguucgagaagaacgccggcaccaucaagagcugggacgaguccuacacggagcucaagguggagguccccaagaucgagcagcugagcaacuaccagcaggccgcgcugaaguggcggaaggacaucggguuccgcgugaacgccaacaccgccgcccucuccaacaaggugcuggccgaguacaagguccccggcgagaucgugaugagcgugaaggagaugcuguccgacaugauccggcgccggaaccucauccugaaccgcggcggggacgagaacccccggggcccggucagccgcgagcacguggaguggugccgggaguucaucaaggggaaguacaucauggcguucaacccgcccuggggcgacaucaacaaguccgggcgcagcggcaucgcccugguggccaccggccucgccaagcuggccgagaccgaggggaagggcgucuucgacgaggcgaagaagacgguggaggcccugaacggguaccucgacaagcacaaggacgagguggacaaggccuccgccgacagcaugaucaccaaccugcugaagcacaucgccaaggcgcaggagcucuacaagaacuccagcgcccugcgggcccagggcgcccagaucgacaccgucuucagcuccuacuacuggcuguacaaggccggcgugacccccgacacguuccccaccgugagccaguuccucuucgagcuggggaagcagccccgcggcaccaagaagaugaagaaggcgcugcucuccacccccaugaagugggggaagaagcuguacgagcuguucgccgacgacagcuuccagcagaaccggaucuacaugcaccccgccguccucacggccggccgcaucuccgagaugggggugugcuucggcaccaucccgguggcgaaccccgacgacgccgcccugggcagcgggcacaccaaguccauccugaaccuccggaccaacacggagaccaacaaccccugcgccaagaccaucgucaagcuguucgagauccagaagaccggcuucaacauccaggacauggacaucguggccagcgagcaccuccugcaccagucccuggucgggaagcagagccccuuccagaacgcguacaacgugaagggcaacgccacguccgccaacaucaucuga

SEQ ID NO: 6721 - RNA, 1449 nt, Artificial Sequence
  derived and/or modified CDS sequence (opt1) from CCHFV(SCT ex Afghanistan)__JX908640.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggccagcuccaccggcaucgugaagaaggggcuggagugguucgagaagaacgccggcaccaucaagagcugggacgaguccuacacggagcucaagguggagguccccaagaucgagcagcugagcaacuaccagcaggccgcgcugaaguggcggaaggacaucggguuccgcgugaacgccaacaccgccgcccucuccaacaaggugcuggccgaguacaagguccccggcgagaucgugaugagcgugaaggagaugcuguccgacaugauccggcgccggaaccucauccugaaccgcggcggggacgagaacccccggggcccggucagccgcgagcacguggaguggugccgggaguucaucaaggggaaguacaucauggcguucaacccgcccuggggcgacaucaacaaguccgggcgcagcggcaucgcccugguggccaccggccucgccaagcuggccgagaccgaggggaagggcgucuucgacgaggcgaagaagacgguggaggcccugaacggguaccucgacaagcacaaggacgagguggacaaggccuccgccgacagcaugaucaccaaccugcugaagcacaucgccaaggcgcaggagcucuacaagaacuccagcgcccugcgggcccagggcgcccagaucgacaccgucuucagcuccuacuacuggcuguacaaggccggcgugacccccgagacguuccccaccgugagccaguuccucuucgagcuggggaagcagccccgcggcaccaagaagaugaagaaggcgcugcucuccacccccaugaagugggggaagaagcuguacgagcuguucgccgacgacagcuuccagcagaaccggaucuacaugcaccccgccguccucacggccggccgcaucuccgagaugggggugugcuucggcaccaucccgguggcgaaccccgacgacgccgcccugggcagcgggcacaccaaguccauccugaaccuccggaccaacacggagaccaacaaccccugcgccaagaccaucgucaagcuguucgagauccagaagaccggcuucaacauccaggacauggacaucguggccagcgagcaccuccugcaccagucccuggucgggaagcagagccccuuccagaacgcguacaacgugaagggcaacgccacguccgccaacaucaucuga

SEQ ID NO: 6722 - RNA, 1449 nt, Artificial Sequence
  derived and/or modified CDS sequence (opt1) from CCHFV(Semunya)__DQ076413.1__N
auggagaacaagaucgaggugaccagcaaggacgagaugaaccgcugguucgaggaguucaagaaguccaacggccuggucgacaccuucacgaacagcuacuccuucugcgagagcgugcccaaccucgaccgguucguguuccagauggccuccgccaccgacgacgcgcagaaggacagcaucuacgccuccgcccuggucgaggccaccaaguucugcgccccgaucuacgagugcgcgugggugagcuccaccgggaucgugaagaagggccuggagugguucgagaagaacgccgggacgaucaagagcugggacgaguccuacaccgagcucaaggucggcgugcccaagaucgagcagcuggccaacuaccagcaggccgcgcugaaguggcgcaaggacaucggguuccgggugaacgccaacaccgccgcccucagcaacaagguccuggccgaguacaaggugcccggcgagaucgugauguccgucaaggagaugcugagcgacaugauccgccggcgcaaccucauccugaaccggggcggggacgagaacccccgcggcccggugucccgggagcacguggaguggugccgcgaguucgucaaggggaaguacaucauggcguucaacccgcccuggggcgacaucaacaagagcgggcgguccggcaucgcccugguggccaccggccucgccaagcuggccgagacggaggggaagggcguguucgacgaggcgaagaagaccgucgaggcccugaacggguaccucgacaagcacaaggacgagguggacaaggccagcgccgacggcauggugaccaaccugcugaagcacaucgccaaggcgcaggagcucuacaagaacuccagcgcccugcgcgcccagggcgcccagaucgacacccccuucagcuccuucuacuggcuguacaaggccggggucagccccgagacguuccccaccgugucccaguuccucuucgagcugggcaagcagccccgggggaccaagaagaugaagaaggcgcugcucagcacccccaugaaguggggcaagaagcuguacgagcuguucgccgacgacuccuuccaggagaaccgcaucuacaugcacccggccgugcucacggccgggcggaucagcgagaugggcgucugcuucggcaccauccccguggcgaaccccgacgacgccgcccagggguccggccacaccaagagcauccugaaccugcgcaccaacacggagaccaacaaccccugcgccaagaccaucgucaagcuguucgagauccagaagaccggguucaacauccaggacauggacaucguggccuccgagcaccuccugcaccagagccucgugggcaagcaguccccguuccagaacgcguacaacgucaaggggaacgccacgagcgccaacaucaucuga

SEQ ID NO: 6723 - RNA, 1449 nt, Artificial Sequence
  derived and/or modified CDS sequence (opt1) from CCHFV(SK 2015/human)__KX129738.1__N
auggagaacaagaucgaggugaacaacaaggacgagaugaacaagugguucgaggaguucaagaagggcaacgggcuggucgacaccuacaccaacagcuacuccuucugcgagagcgugcccaaccucgaccgcuucguguuccagauggccuccgccacggacgacgcgcagaaggacagcaucuacgccuccgcccuggucgaggccaccaaguucugcgccccgaucuacgagugcgcgugggccagcuccaccggcaucgugaagaaggggcuggagugguucgagaagaacgccggcaccaucaagcucugggacgagagcuacgccgagcugaagguggagguccccaagaucgagcagcuguccaacuaccagcaggcggcccucaaguggcggaaggacaucggguuccgcgugaacgccaacacggccgcccugagcaacaaggugcuggcggaguacaagguccccggcgagaucgugauguccgugaaggagaugcucagcgacaugauccggcgccggaaccugauccugaaccgcggcggggacgagaacccccggggcccggucucccgcgagcacguggaguggugccgggaguucgugaaggggaaguacaucauggccuucaacccgcccuggggcgacaucaacaagagcgggcgcuccggcaucgcccucgucgccaccggccuggccaagcuggcggagaccgaggggaagggcguguucgacgaggccaagaagaccguggaggcccucaacggguaccuggacaagcacaaggacgaggucgacaaggccagcgccgacuccaugaucacgaaccugcucaagcacaucgcgaaggcccaggagcuguacaagaacagcuccgcccugcgggcccagggcgcccagaucgacaccguguucagcagcuacuacuggcucuacaaggcgggcgugacccccgacaccuuccccacggucucccaguuccuguucgagcuggggaagcagccccgcggcaccaagaagaugaagaaggcccuccugagcacccccaugaagugggggaagaagcuguacgagcuguucgccgacgacuccuuccagcagaaccggaucuacaugcaccccgccgugcucaccgcgggccgcaucagcgagaugggggugugcuucggcacggucccgguggccaaccccgacgacgccgcccugggcuccgggcacaccaagagcauccucaaccugcggaccaacaccgagacgaacaaccccugcgccaagaccaucgucaagcuguucgagauccagaagaccggcuucaacauccaggacauggacaucguggcguccgagcaccuccugcaccagagccugguggggaagcagucccccuuccagaacgccuacaacgucaagggcaacgccaccagcgccaacaucaucuga

SEQ ID NO: 6724 - RNA, 1449 nt, Artificial Sequence
  derived and/or modified CDS sequence (opt1) from CCHFV(SPU128/81/7)__DQ076415.1__N
auggagaacaagaucgaggugaacaacaagcacgagaugaacaagugguucgaggaguucaagaagggcaacgggcuggucgacaccuucaccaacagcuacuccuucugcgagagcgugcccaaccucgacaaguucguguuccagauggccuccgccacggacgacgcgcagaaggacagcaucuacgccuccgcccuggucgaggccaccaaguucugcgccccgaucuacgagugcgcgugggugagcuccaccggcaucgugaagcgcgggcuggagugguucgagaagaacgccggcaccaucaagagcugggacgaguccuacacggagcucaaggucgacgugcccaagaucgagcagcuggccaacuaccagcaggccgcgcugaaguggcggaaggacaucggguuccgcgugaacgccaacaccgccgcccucagcaacaagguccuggccgaguacaaggugcccggcgagaucgugauguccgucaaggagaugcugagcgacaugauccggcgccggaaccagauccucaaccgcggcggggacgagaacccccggggcccggugucccgcgagcacguggacuggugccgggaguucgucaaggggaaguacaucauggcguucaacccgcccuggggcgacaucaacaagagcgggcgcuccggcaucgcccugguggccaccggccuggccaagcucgccgagaccgaggggaagggcguguucgacgaggcgaagaagacggucgaggugcugaacggguaccuggacaagcacaaggacgagguggaccgggccagcgccgacuccaugaucaccaaccuccugaagcacaucgccaaggcccaggagcuguacaagaacagcuccgcgcuccgcgcccagggcgcccagaucgacaccgccuucagcagcuacuacuggcuguacaaggccggcgucacccccgagacguuccccaccgugucccaguuccuguucgagcucgggaagcagccccggggcaccaagaagaugaagaaggcgcugcugagcacccccaugaagugggggaagaagcucuacgagcuguucgccgacgacuccuuccagcagaaccgcaucuacaugcaccccgccgugcugacggccggccggaucagcgagaugggggucugcuucggcaccaucccgguggcgaaccccgacgacgccgcccagggcuccgggcacaccaagagcauccucaaccugcgcaccaacacggagaccaacaaccccugcgcccggaccaucgucaagcuguucgagauccagaagaccggcuucaacauccaggacauggacaucguggccuccgagcaccuccugcaccagagccugguggggaagcagucccccuuccagaacgcguacaacgucaagggcaacgccacgagcgccaacaucaucuga

SEQ ID NO: 6725 - RNA, 1449 nt, Artificial Sequence
  derived and/or modified CDS sequence (opt1) from CCHFV(Sudan Al-Fulah 4-2008)__GQ862372.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgacaaguucguguuccagauggccuccgccacggacgacgcgcagaaggacagcaucuacgccuccgcccuggucgaggccaccaaguucugcgccccgaucuacgagugcgcgugggugagcuccaccggcaucgugaagcgcgggcuggagugguucgagaagaacgccggcaccaucaagagcugggacgaguccuacacggagcucaaggucgacgugcccaagaucgagcagcuggccaacuaccagcaggccgcgcugaaguggcggaaggacaucggguuccgcgugaacgccaacaccgccgcccucagcaacaagguccuggccgaguacaaggugcccggcgagaucgugauguccgucaaggagaugcugagcgacaugauccggcgccggaaccagauccucaaccgcggcggggacgagaacccccggggcccggugucccgcgagcacguggacuggugccgggaguucgucaaggggaaguacaucauggcguucaacccgcccuggggcgacaucaacaagagcgggcgcuccggcaucgcccugguggccaccggccuggccaagcucgccgagaccgaggggaagggcguguucgacgaggcgaagaagacggucgaggcccugaacggguaccuggacaagcacaaggacgagguggaccgggccagcgccgacuccaugaucaccaaccuccugaagcacaucgccaaggcgcaggagcuguacaagaacagcuccgcccuccgcgcccagggcgcccagaucgacaccgccuucagcagcuacuacuggcuguacaaggcgggcgugacccccgagacguuccccaccgucucccaguuccuguucgagcucgggaagcagccccggggcaccaagaagaugaagaaggcccugcugagcacccccaugaagugggggaagaagcucuacgagcuguucgccgacgacuccuuccagcagaaccgcaucuacaugcaccccgccgugcugacggcgggccggaucagcgagaugggggugugcuucggcaccaucccggucgccaaccccgacgacgccgcccagggcuccgggcacaccaagagcauccucaaccugcgcaccaacacggagaccaacaaccccugcgcccggaccaucgugaagcuguucgagauccagaagaccggcuucuccauccaggacauggacaucgucgcgagcgagcaccuccugcaccagucccugguggggaagcagagccccuuccagaacgccuacaacgugaagggcaacgccacguccgccaacaucaucuga

SEQ ID NO: 6726 - RNA, 1449 nt, Artificial Sequence
  derived and/or modified CDS sequence (opt1) from CCHFV(TAJUK)__JN086996.1__N
auggagaacaagaucgaggugaacaacaaggacgagaugaacaagugguucgaggaguucaagaagggcaacgggcuggucgacaccuucaccaacagcuacuccuucugcgagagcgugcccaaccucgaccgcuucguguuccagauggccuccgccacggacgaggcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgaggugcccaagaucgagcagcuggccaacuaccagcaggccgcgcugaaguggcggaaggacaucggguuccgcgugaacgccaacaccgccgcccucagccacaagguccuggccgaguacaaggugcccggcgagaucgugauguccgucaaggagaugcugagcgacaugauccggcgccggaaccucauccugaaccgcggcggggacgagaacccccggggcccggugucccgcgagcacguggaguggugccgggaguucgucaaggggaaguacaucauggcguucaacccgcccuggggcgacaucaacaagagcgggcgcuccggcaucgcccugguggccaccggccucgccaagcuggccgagaccgaggggaagggcguguucgacgaggcgaagaagacggucgaggcccugaacggguaccucgacaagcacaaggacgagguggacaaggccagcgccgacaacaugaucaccaaccugcugaagcacaucgccaaggcgcaggagcucuacaagaacuccagcgcccugcgggcccagggcgcccagaucgacaccgccuucuccagcuacuacuggcuguacaaggcgggcgugacccccgagacguuccccaccgucagccaguuccucuucgagcuggggaagcagccccgcggcaccaagaagaugaagaaggcccugcucuccacccccaugaagugggggaagaagcuguacgagcuguucgccgacgacagcuuccagcagaaccggaucuacaugcaccccgccgugcucacggcgggccgcaucuccgagaugggggugugcuucggcaccaucccggucgccaaccccgacgacgccgcccagggcagcgggcacaccaaguccauccugaaccugcggaccaacacggagaccaacaaccccugcgccaagaccaucgugaagcuguucgagauccagaagaccggcuucaacauccaggacauggacaucgucgcgagcgagcaccuccugcaccagucccucguggggaagcagagccccuuccagaacgccuacaacgugaagggcaacgccacguccgccaacaucaucuga

SEQ ID NO: 6727 - RNA, 1449 nt, Artificial Sequence
  derived and/or modified CDS sequence (opt1) from CCHFV(UG3010)__DQ211650.1__N
auggagaacaagaucgaggugaccagcaaggacgagaugaaccgcugguucgaggaguucaagaaguccaacggccuggucgacaccuucacgaacagcuacuccuucugcgagagcgugcccaaccucgaccgguucguguuccagauggccuccgccaccgacgacgcgcagaaggacagcaucuacgccuccgcccuggucgaggccaccaaguucugcgccccgaucuacgagugcgcgugggugagcuccaccgggaucgugaagaagggccuggagugguucgagaagaacgccgggacgaucaagagcugggacgaguccuacaccgagcucaaggucggcgugcccaagaucgagcagcuggccaacuaccagcaggccgcgcugaaguggcgcaaggacaucggguuccgggugaacgccaacaccgccgcccucagcaacaagguccuggccgaguacaaggugcccggcgagaucgugauguccgucaaggagaugcugagcgacaugauccgccggcgcaaccucauccugaaccggggcggggacgagaacccccgcggcccggugucccgggagcacguggaguggugccgcgaguucgucaaggggaaguacaucauggcguucaacccgcccuggggcgacaucaacaagagcgggcgguccggcaucgcccugguggccaccggccucgccaagcuggccgagacggaggggaagggcguguucgacgaggcgaagaagaccgucgaggaccugaacggguaccucgacaagcacaaggacgagguggacaaggccagcgccgacggcauggugaccaaccugcugaagcacaucgccaaggcccaggagcucuacaagaacuccagcgcgcugcgcgcccagggcgcccagaucgacacccccuucagcuccuucuacuggcuguacaaggccggggucagccccgagacguuccccaccgugucccaguuccucuucgagcugggcaagcagccccgggggaccaagaagaugaagaaggcccugcucagcacccccaugaaguggggcaagaagcuguacgagcuguucgcggacgacuccuuccaggagaaccgcaucuacaugcacccggccgugcucacggccgggcggaucagcgagaugggcgucugcuucggcaccauccccguggccaaccccgacgacgcggcccagggguccggccacaccaagagcauccugaaccugcgcaccaacacggagaccaacaaccccugcgccaagaccaucgucaagcuguucgagauccagaagaccggguucaacauccaggacauggacaucguggccuccgagcaccuccugcaccagagccucgugggcaagcaguccccguuccagaacgccuacaacgucaaggggaacgcgacgagcgccaacaucaucuga

SEQ ID NO: 6728 - RNA, 1449 nt, Artificial Sequence
  derived and/or modified CDS sequence (opt1) from CCHFV(UGANDA 3010)__U88416.1__N
auggagaacaagaucgaggugaccagcaaggacgagaugaaccgcugguucgaggaguucaagaaguccaacggccuggucgacaccuucacgaacagcuacuccuucugcgagagcgugcccaaccucgaccgguucguguuccagauggccuccgccaccgacgacgcgcagaaggacagcaucuacgccuccgcccuggucgaggccaccaaguucugcgccccgaucuacgagugcgcgugggugagcuccaccgggaucgugaagaagggccuggagugguucgagaagaacgccgggacgaucaagagcugggacgaguccuacaccgagcucaaggucggcgugcccaagaucgagcagcuggccaacuaccagcaggccgcgcugaaguggcgcaaggacaucggguuccgggugaacgccaacaccgccgcccucagcaacaagguccuggccgaguacaaggugcccggcgagaucgugauguccgucaaggagaugcugagcgacaugauccgccggcgcaaccucauccugaaccggggcggggacgagaacccccgcggcccggugucccgggagcacguggaguggugccgcgaguucgucaaggggaaguacaucauggcguucaacccgcccuggggcgacaucaacaagagcgggcgguccggcaucgcccugguggccaccggccucgccaagcuggccgagacggaggggaagggcguguucgacgaggcgaagaagaccgucgaggaccugaacggguaccucgacaagcacaaggacgagguggacaaggccagcgccgacggcauggugaccaaccugcugaagcacaucgccaaggcccaggagcucuacaagaacuccagcgcgcugcugcuccagggcgcccagaucgacacccccuucagcuccuucuacuggcuguacaaggccggggucagccccgagacguuccccaccgugucccaguuccuguucgagcucggcaagcagccccgcgggaccaagaagaugaagaaggcccugcugagcacccccaugaaguggggcaagaagcucuacgagcuguucgccgacgacuccuuccaggagaaccggaucuacaugcacccggcggugcugacggccgggcgcaucagcgagaugggcgucugcuucggcaccauccccguggccaaccccgacgacgccgcgcagggguccggccacaccaagagcauccucaaccuggggaccaacacggagaccaacaaccccugcgccaagaccaucgucaagcuguucgagauccagaagaccggcuucaacauccaggacauggacaucguggccuccgagcaccuccugcaccagagccugguggggaagcaguccccguuccagaacgccuacaacgucaagggcaacgccacgagcgcgaacaucaucuga

SEQ ID NO: 6729 - RNA, 1449 nt, Artificial Sequence
  derived and/or modified CDS sequence (opt1) from CCHFV(UK ex Bulgaria)__KM201260.1__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccacccgcuucugcgccccgaucuacgagugcgcgugggucagcuccaccggcaucgugaagaaggggcuggagugguucgagaagaacagcggcaccaucaaguccugggacgagaacuacgccgagcucaagguggacguccccaagaucgagcagcuggccaacuaccagcaggccgcgcugaaguggcggaaggacaucggguuccgcgugaacgccaacacggccgcccucagcaacaaggugcuggccgaguacaagguccccggcgagaucgugauguccgugaaggagaugcugagcgacaugauccggcgccggaaccucauccugaaccgcggcggggacgagaacccccggggcccggucucccgcgagcacguggaguggugccgggaguucgugaaggggaaguacaucauggcguucaacccgcccuggggcgacaucaacaagagcgggcgcuccggcaucgcccuggucgccaccggccucgccaagcuggccgagaccgaggggaagggcguguucgacgaggcgaagaagaccguggaggcccugaacggguaccucgacaagcaccgggacgaggucgacaaggccagcgccgacuccaugaucacgaaccugcugaagcacaucgccaaggcgcaggagcucuacaagaacagcuccgcccugcgcgcccagggcgcccagaucgacacccccuucagcagcuucuacuggcuguacaaggccggcgugacccccgagaccuuccccacgaucucccaguuccucuucgagcuggggaagcagccccggggcaccaagaagaugaagaaggcgcugcucagcacccccaugaagugggggaagaagcuguacgagcuguucgccgacgacuccuuccagcagaaccgcaucuacaugcacccggccgugcucaccgccggccggaucagcgagaugggggucugcuucggcacgauccccguggcgaaccccgacgacgccgcccagggcuccgggcacaccaagagcauccugaaccugcgcaccuccaccgagacgaacaaccccugcgccaagaccaucgugaagcuguucgagauccagaagaccggcuucaacauccaggacauggacaucgucgccagcgagcaccuccugcaccagucccucguggggaagcagagcccguuccagaacgcguacaacgucaagggcaacgccaccuccgccaacaucaucuga

SEQ ID NO: 6730 - RNA, 1449 nt, Artificial Sequence
  derived and/or modified CDS sequence (opt1) from CCHFV(Yozgat19-2012)__KR092375.1__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaagaacagcggcaccaucaaguccugggacgagaacuacgccgagcucaagguggacguccccaagaucgagcagcuggccaacuaccagcaggccgcgcugaaguggcgcaaggacaucggguuccgggugaacgccaacacggccgcccucagcaacaaggugcuggccgaguacaagguccccggcgagaucgugauguccgugaaggagaugcugagcgacaugauccgccggcgcaaccucauccugaaccgguccggcgacgagaacccccgcgggccggucagccgggagcacguggaguggugccgcgaguucgugaagggcaaguacaucauggcguucaacccgcccuggggcgacaucaacaaguccgggcggagcgggaucgcccuggucgccaccggccucgccaagcuggccgagaccgagggcaaggggguguucgacgaggcgaagaagaccguggaggcccugaacggcuaccucgacaagcaccgcgacgaggucgacaaggccuccgccgacagcaugaucacgaaccugcugaagcacaucgccaaggcgcaggagcucuacaagaacuccagcgcccugcgggcccagggggcccagaucgacacccccuucagcuccuucuacuggcuguacaaggccggcgugacccccgagaccuuccccacgaucagccaguuccucuucgagcugggcaagcagccccgcgggaccaagaagaugaagaaggcgcugcucuccacccccaugaaguggggcaagaagcuguacgagcuguucgccgacgacagcuuccagcagaaccggaucuacaugcacccggccgugcucaccgccgggcgcaucuccgagaugggcgucugcuucgggacgauccccguggcgaaccccgacgacgccgcccagggcagcggccacaccaaguccauccugaaccugcggaccagcaccgagacgaacaaccccugcgccaagaccaucgugaagcuguucgagauccagaagaccggguucaacauccaggacauggacaucgucgccuccgagcaccuccugcaccagagccucgugggcaagcaguccccguuccagaacgcguaccacgucaaggggaacgccaccagcgccaacaucaucuga

SEQ ID NO: 6731 - RNA, 1449 nt, Artificial Sequence
  derived and/or modified CDS sequence (opt1) from CCHFV(Yozgat207-2011)__KR092377.1__N
auggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaagaacagcggcaccaucaaguccugggacgagaacuacgccgagcucaagguggacguccccaagaucgagcagcuggccaacuaccagcaggccgcgcugaaguggcgcaaggacaucggguuccgggugaacgccaacacggccgcccucagcaacaaggugcuggccgaguacaagguccccggcgagaucgugauguccgugaaggagaugcugagcgacaugauccgccggcgcaaccucauccugaaccggggcggggacgagaacccccgcggcccggucucccgggagcacguggaguggugccgcgaguucgugaaggggaaguacaucauggcguucaacccgcccuggggcgacaucaacaagagcgggcgguccggcaucgcccuggucgccaccggccucgccaagcuggccgagaccgaggggaagggcguguucgacgaggcgaagaagaccguggaggcccugaacggguaccucgacaagcaccgcgacgaggucgacaaggccagcgccgacuccaugaucacgaaccugcugaagcacaucgccaaggcgcaggagcucuacaagaacagcuccgcccugcgggcccagggcgcccagaucgacacccccuucagcagcuucuacuggcuguacaaggccggcgugacccccgagaccuuccccacgaucucccaguuccucuucgagcuggggaagcagccccgcggcaccaagaagaugaagaaggcgcugcucagcacccccaugaagugggggaagaagcuguacgagcuguucgccgacgacuccuuccagcagaaccggaucuacaugcacccggccgugcucaccgccggccgcaucagcgagaugggggucugcuucggcacgauccccguggcgaaccccgacgacgccgcccagggcuccgggcacaccaagagcauccugaaccugcggaccuccaccgagacgaacaaccccugcgccaagaccaucgugaagcuguucgagauccaggagaccggcuucaacauccaggacauggacaucgucgccagcgagcaccuccugcaccagucccucguggggaagcagagcccguuccagaacgcguacaacgucaagggcaacgccaccuccgccaacaucaucuga

SEQ ID NO: 6732 - RNA, 1452 nt, Artificial Sequence
  derived and/or modified CDS sequence (opt1) from DUGV(ArD44313)__AF434161.1__N
auggagaaccagaucaaggccaacaacaagaaggaguucgacgagugguucaagcccuucagcgagaagcugcagcuccgcuccaaccugaccaacagcgccucccugugcgaccgggugccggaccucgcgcuggccgagaugaagauggcccuggccaccgacgacaaggagaaggacagcaucuucuccaacgcccucgucgaggcgacgcgcuucugcgcccccaucuacgagugcgccuggaccugcagcaccggcguggugcagaagucccugagcugguucgacaagaacaaggacuucaucaagcugugggacgccaaguacauggaccucaagaaggggauccccgagcccgagcagcuggucuccuaccagcaggcggcccagaaguggcggaaggacgugggcuacgagaucaaccaguucacccgcagccugacgcacccgguggucgccgaguacaaggugcccggggagaucgccguggacgucaaggagaugcucuccgacaugauccggcgccggaacgugcugcugaacggcgacggggagaacgccggcaagaagggccccaucagccgcgagcacguguccugggggcgggagcucgcgggcgggaaguuccaggucguguucaacccgcccuggggcgacaucaacaagugcggcaagagcgggaucccccuggccgccaccgccauggugaaggucgccgagcuggacggcuccaagaagcucgaggacauccgccaggcgcugcuggaccucaagaaguggguggaggacaacaaggacgcccuggaggacgggaagggcaacgagcuggugcagaccaugaccaagcaccucgcccaggccgucgagcugagcaagaaguccaacgcccugcgggcgcagggggcccagaucgacacgcccuucagcgccuacuacugggccugguccgccggcgugaagcccgagaccuucuucacccucagccaguuccuguucgagaugggccagagcgcgcgcgggggcaagaagaugaucaaggcccugaccuccacgccgcuccggugggggaagggccugaucaaccuguucgccgacgacgacuuccucgggaaccgccuguacaugcaccccgccgugcugacccccggccggaugagcgagaugggcgcgugcuucggggucauccccguggccuccccggaggacgccauccucggcagcgggcacuccaagaacauccugaacuucaagaucgacaccagcgugcagaaccccugcgccuccaccaucguccagcuguaccgcauccagaaguccggcuucgaccucgagagccuggagguggucagcacggagcaccuccugcaccaguccuucguggggaagcggugccccacccagaacgccuacaaggugcgcggcaacgcgaccaacgucaacaucaucuga

SEQ ID NO: 6733 - RNA, 1452 nt, Artificial Sequence
  derived and/or modified CDS sequence (opt1) from DUGV(ArD16095)__AF434162.1__N
auggagaaccagaucaaggccaacaacaagaaggaguucgacgagugguucaagcccuucagcgagaagcugcagcugcgcuccaaccugaccaacagcgccucccugugcgaccgggugccggaccucgcgcuggccgagaugaagauggcccuggccaccgacgacaaggagaaggacagcaucuucuccaacgcccucgucgaggcgacgcgcuucugcgcccccaucuacgagugcgccuggaccugcagcaccggcguggugcagaagucccugagcugguucgacaagaacaaggacuucaucaagcugugggacuccaaguacauggaccuccggaaggggauccccgagcccgagcagcuggucagcuaccagcaggccgcgcagaaguggcgcaaggacgugggcuacgagaucaaccaguucacccggucccugacgcacccgguggucgccgaguacaaggugcccggggagaucgccguggacgucaaggagaugcucagcgacaugauccgccggcgcaacgugcugcugaacggcgacggggagaacgccggcaagaagggccccaucucccgggagcacgugagcugggggcgcgagcucgccggcgggaaguuccaggucguguucaacccgcccuggggcgacaucaacaagugcgggaaguccggcaucccccuggcggccaccgccauggugaaggucgccgagcuggacggcagcaagaagcucgaggacauccggcaggcccugcuggaccucaagaaguggguggaggacaacaaggacgcgcuggaggacgggaagggcaacgagcuggugcagaccaugaccaagcaccucgcccaggccgucgagcuguccaagaaguccaacgcccugcgcgcccagggggcgcagaucgacacgcccuucagcgccuacuacugggccuggagcgccggcgugaagcccgagaccuucuucacccucagccaguuccuguucgagaugggccaguccgcccgcgggggcaagaagaugaucaaggcgcugaccagcacgccgcuccggugggggaagggccugaucaaccuguucgccgacgacgacuucuccgggaaccggcucuacaugcaccccgccgugcugacccccggccgcaugagcgagaugggcgccugcuucggggucauccccguggcguccccggaggacgccauccugggcagcgggcacuccaagaacauccucaacuucaagaucgacaccagcgugcagaaccccugcgccuccaccaucguccagcuguaccggauccagaaguccggcuucgaccuggagagccucgagguggucagcacggagcaccuccugcaccaguccuucguggggaagcgcugccccacccagaacgccuacaaggugcggggcaacgccaccaacgucaacaucaucuga

SEQ ID NO: 6734 - RNA, 1452 nt, Artificial Sequence
  derived and/or modified CDS sequence (opt1) from DUGV(IbH11480)__AF434163.1__N
auggagaaccagaucaaggccaacaacaagaaggaguucgacgagugguucaagcccuucagcgagaagcugcagcuccgcuccaaccugaccaacagcgccucccugugcgaccgggugccggaccucgcgcuggccgagaugaagauggcccuggccaccgacgacaaggagaaggacagcaucuucuccaacgcccucgucgaggcgacgcgcuucugcgcccccaucuacgagugcgccuggaccugcagcaccggcguggugcagaagucccugagcugguucgacaagaacaaggacuucaucaagcugugggacgccaaguacauggaccuccggaaggggauccccgagcccgagcagcuggucuccuaccagcaggcggcccagaaguggcgcaaggacgugggcuacgagaucaaccaguucacccggagccugacgcacccgguggucgccgaguacaaggugcccggggagaucgccguggacgucaaggagaugcucuccgacaugauccgccggcgcaacgugcugcugaacggcgacggggagaacgccggcaagaagggccccaucagccgggagcacguguccugggggcgcgagcucgcgggcgggaaguuccaggucguguucaacccgcccuggggcgacaucaacaagugcggcaagagcgggaucccccuggccgccaccgccauggugaaggucgccgagcuggacggcuccaagaagcucgaggacauccggcaggcgcugcuggaccucaagaaguggguggaggacaacaaggacgcccuggaggacgggaagggcaacgagcuggugcagaccaugaccaagcaccucgcccaggccgucgagcugagcaagaaguccaacgcccugcgcgcgcagggggcccagaucgacacgcccuucagcgccuucuacugggccugguccgccggcgugaagcccgagaccuucuucacccucagccaguuccuguucgagaugggccagagcgcgcgcgggggcaagaagaugaucaaggcccugaccuccacgccgcuccggugggggaagggccugaucaaccuguucgccgacgacgacuuccucgggaaccggcuguacaugcaccccgccgugcugacccccggccgcaugagcgagaugggcgcgugcuucggggucauccccguggccuccccggaggacgccauccucggcagcgggcacuccaagaacauccugaacuucaagaucgacaccagcgugcagaaccccugcgccuccaccaucguccagcuguaccggauccagaaguccggcuucgaccucgagagccuggagguggucagcacggagcaccuccugcaccaguccuucguggggaagcgcugccccacccagaacgccuacaaggugcggggcaacgcgaccaacgucaacaucaucuga

SEQ ID NO: 6735 - RNA, 1452 nt, Artificial Sequence
  derived and/or modified CDS sequence (opt1) from DUGV(IbAr1792)__AF434164.1__N
auggagaaccagaucaaggccaacaacaagaaggaguucgacgagugguucaagcccuucagcgagaagcugcagcuccgcuccaaccugaccaacagcgccucccugugcgaccgggugccggaccucgcgcuggccgagaugaagauggcccuggccaccgacgacaaggagaaggacagcaucuucuccaacgcccucgucgaggcgacgcgcuucugcgcccccaucuacgagugcgccuggaccugcagcaccggcguggugcagaagucccugagcugguucgacaagaacaaggacuucaucaagcugugggacgccaaguacauggaccuccggaaggggauccccgagcccgagcagcuggucuccuaccagcaggcggcccagaaguggcgcaaggacgugggcuacgagaucaaccaguucacccggagccugacgcacccgguggucgccgaguacaaggugcccggggagaucgccguggacgucaaggagaugcucuccgacaugauccgccggcgcaacgugcugcugaacggcgacggggagaacgccggcaagaagggccccaucagccgggagcacguguccugggggcgcgagcucgcgggcgggaaguuccaggucguguucaacccgcccuggggcgacaucaacaagugcggcaagagcgggaucccccuggccgccaccgccauggugaaggucgccgagcuggacggcuccaagaagcucgaggacauccggcaggcgcugcuggaccucaagaaguggguggaggacaacaaggacgcccuggaggacgggaagggcaacgagcuggugcagaccaugaccaagcaccucgcccaggccgucgagcugagcaagaaguccaacgcccugcgcgcgcagggggcccagaucgacacgcccuucagcgccuacuacugggccugguccgccggcgugaagcccgagaccuucuucacccucagccaguuccuguucgagaugggccagagcgcgcgcgggggcaagaagaugaucaaggcccugaccuccacgccgcuccggugggggaagggccugaucaaccuguucgccgacgacgacuuccucgggaaccggcuguacaugcaccccgccgugcugacccccggccgcaugagcgagaugggcgcgugcuucggggucauccccguggccuccccggaggacgccauccucggcagcgggcacuccaagaacauccugaacuucaagaucgacaccagcgugcagaaccccugcgccuccaccaucguccagcuguaccggauccagaaguccggcuucgaccucgagagccuggagguggucagcacggagcaccuccugcaccaguccuucguggggaagcgcugccccacccagaacgccuacaaggugcggggcaacgcgaccaacgucaacaucaucuga

SEQ ID NO: 6736 - RNA, 1452 nt, Artificial Sequence
  derived and/or modified CDS sequence (opt1) from DUGV(KT281/75)__AF434165.1__N
auggagaaccagaucaaggccaacaccaagaaggaguucgacgagugguucaagcccuucagcgacaagcugcagcugcgcuccacccugacgaacagcgccucccugugcgaccgggugccggaccucgcgcuggccgagaugaagauggcccuggccaccgacgacaaggagaaggacagcaucuucuccaacgcccucgucgaggcgacccgcuucugcgcccccaucuacgagugcgccuggaccugcagcacgggcguggugcagaagucccugagcugguucgacaagaacaaggacuucaucaagcugugggacgccaaguacauggaccuccggaaggggauccccgagcccgagcagcuggucuccuaccagcaggcggcccagaaguggcgcaaggacaucggcuacgagaucaaccaguucacccggagccugacccacccggugguggccgaguacaagguccccggggagaucgccguggacgugaaggagaugcucuccgacaugauccgccggcgcaacguccugcugaacggcgacggggagaacgccggcaagaagggccccaucagccgggagcacguguccugggggcgcgagcucgcgggcgggaaguuccagguggucuucaacccgcccuggggcgacaucaacaagugcggcaagagcgggaucccccuggccgccaccgccauggugaagguggccgagcuggacggcuccaagaagcucgaggacauccggcaggcgcugcuggaccucaagaaguggaucgaggacaacaaggacgcccuggaggacgggaagggcaacgagcugauccagacgaugaccaagcaccucgcccaggccgucgagcugagcaagaaguccaacgcccugcgcgcgcagggggcccagaucgacacccccuucagcgccuucuacugggccugguccgccggcgugaagcccgagaccuucuucacgcucagccaguuccuguucgagaugggccagagcgcgcgcgggggcaagaagaugaucaaggcccugaccuccaccccgcuccggugggggaagggccugaucaaccuguucgccgacgacgacuucagcgggaaccggcucuacaugcaccccgccgugcugacccccggccgcauguccgagaugggcgcgugcuucggggucauccccguggccagcccggaggacgccauccugggcuccgggcacagcaagaacauccucaacuucaagaucgacacguccgugcagaaccccugcgccagcaccaucguccagcuguaccggauccagaaguccggcuucgaccuggagagccucgaggugguguccaccgagcaccuccugcaccagagcuucgucgggaagcgcugccccacccagaacgccuacaaggugcggggcaacgcgacgaacgucaacaucaucuga

SEQ ID NO: 6737 - RNA, 1452 nt, Artificial Sequence
  derived and/or modified CDS sequence (opt1) from DUGV(NJT130)__FJ422213.2__N
auggagaaccagaucaaggccaacaacaagaaggaguucgacgagugguucaagcccuucagcgacaagcugcagcugcgcuccacccugaccaacagcgccucccugugcgacaaggugccggaccucgcgcuggccgagaugaagauggcccuggccacggacgacaaggagaaggacagcaucuucuccaacgcccucgucgaggcgacccgguucugcgcccccaucuacgagugcgccuggaccugcagcaccggcguggugcagaagucccugagcugguucgacaagaacaaggacuucaucaagcugugggacgccaaguacauggaccuccgcaaggggauccccgagcccgagcagcuggucuccuaccagcaggcggcccagaaguggcggaaggacaucggcuacgagaucaaccaguucacgcgcagccugacccacccggugguggccgaguacaagguccccggggagaucgccguggacgugaaggagaugcucuccgacaugauccggcgccggaacguccugcugaacggcgacggggagaacgccggcaagaagggccccaucagccgcgagcacguguccugggggcgggagcucgcggagggcaaguuccagguggucuucaacccgcccuggggcgacaucaacaagugcggcaagagcgggaucccccuggccgccaccgccauggugaagguggccgagcuggacggguccaagaagcucgaggacauccgccaggcgcugcuggaccucaagaagugggucgaggacaacaaggacgcccuggaggacggcaaggggaacgagcugauccagaccaugacgaagcaccucgcccaggccguggagcugagcaagaaguccaacgcccugcgggcgcagggcgcccagaucgacacccccuucagcgccuucuacugggccugguccgccggggugaagcccgagaccuucuucacccucagccaguuccuguucgagaugggccagagcgcgcgcggcgggaagaagaugaucaaggcccugacguccaccccgcuccgguggggcaaggggcugaucaaccuguucgccgacgacgacuucagcggcaaccgccucuacaugcaccccgccguccugacccccgggcggauguccgagaugggcgcgugcuucggcgugauccccguggccagcccggaggacgccauccugggguccggccacagcaagaacauccucaacuucaagaucgacaccuccguccagaaccccugcgccagcacgaucgugcagcuguaccgcauccagaaguccggguucgaccuggagagccucgagguggucuccaccgagcaccuccugcaccagagcuucgugggcaagcggugccccacccagaacgccuacaagguccgcgggaacgcgaccaacgugaacaucaucuga

SEQ ID NO: 6738 - RNA, 1452 nt, Artificial Sequence
  derived and/or modified CDS sequence (opt1) from DUGV(IbAr1792)__KU925457.1__N
auggagaaccagaucaaggccaacaacaagaaggaguucgacgagugguucaagcccuucagcgagaagcugcagcuccgcuccaaccugaccaacagcgccucccugugcgaccgggugccggaccucgcgcuggccgagaugaagauggcccuggccaccgacgacaaggagaaggacagcaucuucuccaacgcccucgucgaggcgacgcgcuucugcgcccccaucuacgagugcgccuggaccugcagcaccggcguggugcagaagucccugagcugguucgacaagaacaaggacuucaucaagcugugggacgccaaguacauggaccuccggaaggggauccccgagcccgagcagcuggucuccuaccagcaggcggcccagaaguggcgcaaggacgugggcuacgagaucaaccaguucacccggagccugacgcacccgguggucgccgaguacaaggugcccggggagaucgccguggacgucaaggagaugcucuccgacaugauccgccggcgcaacgugcugcugaacggcgacggggagaacgccggcaagaagggccccaucagccgggagcacguguccugggggcgcgagcucgcgggcgggaaguuccaggucguguucaacccgcccuggggcgacaucaacaagugcggcaagagcgggaucccccuggccgccaccgccauggugaaggucgccgagcuggacggcuccaagaagcucgaggacauccggcaggcgcugcuggaccucaagaaguggguggaggacaacaaggacgcccuggaggacgggaagggcaacgagcuggugcagaccaugaccaagcaccucgcccaggccgucgagcugagcaagaaguccaacgcccugcgcgcgcagggggcccagaucgacacgcccuucagcgccuucuacugggccugguccgccggcgugaagcccgagaccuucuucacccucagccaguuccuguucgagaugggccagaacgcgcgcgggggcaagaagaugaucaaggcccugaccagcacgccgcuccggugggggaagggccugaucaaccuguucgccgacgacgacuuccucgggaaccggcuguacaugcaccccgccgugcugacccccggccgcauguccgagaugggcgcgugcuucggggucauccccguggccagcccggaggacgccauccucggcuccgggcacagcaagaacauccugaacuucaagaucgacaccuccgugcagaaccccugcgccagcaccaucguccagcuguaccggauccagaaguccggcuucgaccucgagagccuggagguggucuccacggagcaccuccugcaccagagcuucguggggaagcgcugccccacccagaacgccuacaaggugcggggcaacgcgaccaacgucaacaucaucuga

SEQ ID NO: 6739 - RNA, 1449 nt, Artificial Sequence
  derived and/or modified CDS sequence (opt1) from NSDV(Jilin)__NC_034386.1__N
augcagaaccagaucguggccgacaacaaggacgccauccuggcguggcacaagaccuacagcgagaagcaccgccucaaguccguccugaccaacagcgccuccuucugcgagacgauccccgaccugagcggcuacgagguguccaugcggcucgugagcuccgagagcgagaaggacuccgucuacgccagcgcccugguggccgcgaccaaguucugcgccccgauccuggagugcgccuggaccuccugcaccgggaugguggagcgcggccucgacugguucgagaacaacaaggagacggucaagaucugggacgccgaguacgggaagcugcggaccgaggcgcccagccccgagcagcugcucggcuaccagcgcgccgcccugaaguggcggaaggacaccaaguacgggaucaaccgcaacaccgccgcccuggcggccgccaucgccacggaguaccgggugcccggcuccaucguggucaacgugaaggacaugcucagcgacaugauccgccggcgcaacaagauccugaaccgggacggcuccgaggacgugccgaagcgcgggcccgucagcaaggagcacaucgacugggcccgggaccuggcgcagggcaaguuccucgugguguucaacccgcccuggggcgacaucaacaaggccgggaaguccgggaucgcccuggccgccaccggcauggcgaagcugaucgagcucgacggccccaagaucgccgaggaccugcgcgagagccugaaggggcucgucgccuggaucaacgcccacaaggacgagguggagaacggcaaggagguggucgacgggcugaccaagcaccuccagaaggcccuggagcuggcgaagcaguccagcgccaugcgggcccagggcgcccagaucgacaccguguucagcuccuacuacuggcuguggaaggcgggcgugacggccgagauguuccccaccgucagccaguuccucuucgagcuggggaaggugccccgcggcaacaagaagaugaagaaggcccuguccagcaugccccucaagugggggaagaagcugcuggcccucuucgccgacgacuccuucaccgcgaaccggaucuacaugcacccgggcgugcugaccgccgggcgcaugagcgagcugggcgucugcuucggcgccauccccguggccaaccccgacgacgccgcggagggguccggccacaucaagaacauccucgcccagacgaccgacacccaggccgggaaccccugcgcccagaacaucgucgcccuguucaacauccagaaggcgggcuucgacaucgagagcauggacaucguggcccuggagcaccuccugcaccagucccugguggggaagcggagcccguuccagaacgccuacaacauccgcggcaacgccaccuccauccagaucaucuga

SEQ ID NO: 6740 - RNA, 1449 nt, Artificial Sequence
  derived and/or modified CDS sequence (opt1) from NSDV(62873)__HQ286609.1__N
augcagaaccagaucguggccgacaacaaggacgccauccuggcguggcacaagaccuacagcgagaagcacaagcucaaguccguccugaccaacagcgccuccuucugcgagacgauccccgaccugagcggcuacgagguguccaugcgccucgugagcuccgagagcgagaaggacuccgucuacgccagcgcccugguggccgcgaccaaguucugcgccccgauccuggagugcgccuggaccuccugcaccgggaugauccagcggggccucgacugguucgagaacaacggggagauggugaagaucugggacgccgacuacggcaagcugcgcacggagauccccagccccgagcagcugcucggguaccagcgggcggcccugaaguggcgcaaggacaccaaguacggcaucaacaagaacaccgccgcccuggccgcggccaucgccaccgaguaccggguccccggcuccaucguggugaacgucaaggacaugcucagcgacaugauccgccggcgcaacaagauccugaaccgggacggguccgaggacgugccgaagcgcggccccgugagcaaggagcacaucgacugggcccgggaccuggcccaggggaaguuccucgucguguucaacccgcccuggggcgacaucaacaaggcggggaaguccggcaucgcccuggccgccacgggcauggccaagcugaucgagcucgacgggcccaagguggcggaggaccugaaggagagccugaagucccucgucgccuggaucaacgcccacaaggacgagguggagaacggcaaggagguggucgacgggcugaccaagcaccuccagaaggcccuggagcuggccaagcagagcagcgcgaugcgcgcccagggcgcccagaucgacaccguguucuccagcuacuacuggcuguggaaggccggcgugaccgcggagauguuccccacggucucccaguuccucuucgagcuggggaaggugccccggggcaacaagaagaugaagaaggcccugagcuccaugccccucaagugggggaagaagcugcuggcccucuucgccgacgacagcuucaccgccaaccgcaucuacaugcacccgggcgugcugaccgcggggcggauguccgagcugggcgucugcuucggcgccauccccguggccaaccccgacgacgccgccgaggggagcggccacaucaagaacauccucaacuacaagaccgacacgcaggcggggaaccccugcgcccagaacaucgucgcccuguucaacauccagaaggccggcuucgacaucgaguccauggacaucguggccagcgagcaccuccugcaccagucccugguggggaagcgcagcccguuccagaacgcguacaacauccggggcaacgccaccuccauccagaucaucuga

SEQ ID NO: 6741 - RNA, 1449 nt, Artificial Sequence
  derived and/or modified CDS sequence (opt1) from NSDV(779)__HQ286602.1__N
augcagaaccagaucguggccgacaacaaggacgccauccuggcguggcacaagaccuacagcgagaagcacaagcucaaguccguccugaccaacagcgccuccuucugcgagacgauccccgaccugagcggcuacgagguguccaugcgccucgugagcuccgagagcgagaaggacuccgucuacgccagcgcccugguggccgcgaccaaguucugcgccccgauccuggagugcgccuggaccuccugcaccgggaugauccagcggggccucgacugguucgacaacaacggggagauggugaagaucugggacgccgacuacggcaagcugcgcacggagguccccagccccgagcagcugcucggguaccagcgggcggcccugaaguggcgcaaggacaccaaguacggcaucaacaagaacaccgccgcccuggccgcggccaucgccaccgaguaccgggugcccggcuccaucguggucaacgugaaggacaugcucagcgacaugauccgccggcgcaacaagauccugaaccgggacggguccgaggacgugccgaagcgcggccccgucagcaaggagcacaucgacugggcccgggaccuggcccaggggaaguuccucgugguguucaacccgcccuggggcgacaucaacaaggcggggaaguccggcaucgcccuggccgccacgggcauggccaagcugaucgagcucgacgggcccaaggucgcggaggaccugaaggagagccugaagucccucguggccuggaucaacgcccacaaggacgagguggagaacggcaaggaggucguggacgggcugaccaagcaccuccagaaggcccuggagcuggccaagcagagcagcgcgaugcgcgcccagggcgcccagaucgacaccguguucuccagcuacuacuggcuguggaaggccggcgucaccgcggagauguuccccacggugucccaguuccucuucgagcuggggaaggugccccggggcaacaagaagaugaagaaggcccugagcuccaugccccucaagugggggaagaagcugcuggcccucuucgccgacgacagcuucaccgccaaccgcaucuacaugcacccgggcguccugaccgcggggcggauguccgagcugggcgugugcuucggcgccauccccgucgccaaccccgacgacgccgccgaggggagcggccacaucaagaacauccucaacuacaagaccgacacgcaggcggggaaccccugcgcccagaacaucguggcccuguucaacauccagaaggccggcuucgacaucgaguccauggacaucguggccagcgagcaccuccugcaccagucccuggucgggaagcgcagcccguuccagaacgcguacaacauccggggcaacgccaccuccauccagaucaucuga

SEQ ID NO: 6742 - RNA, 1449 nt, Artificial Sequence
  derived and/or modified CDS sequence (opt1) from NSDV(6233)__HQ286603.1__N
augcagaaccagaucguggccgacaacaaggacgccauccuggcguggcacaagaccuacagcgagaagcacaagcucaaguccguccugaccaacagcgccuccuucugcgagacgauccccgaccugagcggcuacgagguguccaugcgccucgugagcuccgagagcgagaaggacuccgucuacgccagcgcccugguggccgcgaccaaguucugcgccccgauccuggagugcgccuggaccuccugcaccgggaugauccagcggggccucgacugguucgacaacaacggggagauggugaagaucugggacgccgacuacggcaagcugcgcacggagguccccagccccgagcagcugcucggguaccagcgggcggcccugaaguggcgcaaggacaccaaguacggcaucaacaagaacaccgccgcccuggccgcggccaucgccaccgaguaccgggugcccggcuccaucguggucaacgugaaggacaugcucagcgacaugauccgccggcgcaacaagauccugaaccgggacggguccgaggacgugccgaagcgcggccccgucagcaaggagcacaucgacugggcccgggaccuggcccaggggaaguuccucgugguguucaacccgcccuggggcgacaucaacaaggcggggaaguccggcaucgcccuggccgccacgggcauggccaagcugaucgagcucgacgggcccaaggucgcggaggaccugaaggagagccugaagucccucguggccuggaucaacgcccacaaggacgagguggagaacggcaaggacgucguggacgggcugaccaagcaccuccagaaggcccuggagcuggccaagcagagcagcgcgaugcgcgcccagggcgcccagaucgacaccguguucuccagcuacuacuggcuguggaaggccggcgucaccgcggagauguuccccacggugucccaguuccucuucgagcuggggaaggugccccggggcaacaagaagaugaagaaggcccugagcuccaugccccucaagugggggaagaagcugcuggcccucuucgccgacgacagcuucaccgccaaccgcaucuacaugcacccgggcguccugaccgcggggcggauguccgagcugggcgugugcuucggcgccauccccgucgccaaccccgacgacgccgccgaggggagcggccacaucaagaacauccucaacuacaagaccgacacgcaggcggggaaccccugcgcccagaacaucguggcccuguucaacauccagaaggccggcuucgacaucgaguccauggacaucguggccagcgagcaccuccugcaccagucccuggucgggaagcgcagcccguuccagaacgcguacaacauccggggcaacgccaccuccauccagaucaucuga

SEQ ID NO: 6743 - RNA, 1449 nt, Artificial Sequence
  derived and/or modified CDS sequence (opt1) from NSDV(40350)__HQ286608.1__N
augcagaaccagaucguggccgacagcaaggacgccauccuggcguggcacaagaccuacuccgagaagcacaagcucaagagcguccugaccaacuccgccagcuucugcgagacgauccccgaccuguccggcuacgaggugagcaugcgccucguguccagcgacuccgagaaggacagcgucuacgccuccgcccugguggccgcgaccaaguucugcgccccgauccuggagugcgccuggaccagcugcaccgggaugauccagcggggccucgacugguucgagaacaacggggagauggugaagaucugggacgccgacuacggcaagcugcgcacggagguccccucccccgagcagcugcucggguaccagcgggcggcccugaaguggcgcaaggacaccaaguacggcaucaacaagaacaccgccgcccuggccgcggccaucgccaccgaguaccgggugcccggcagcaucguggucaacgugaaggacaugcucuccgacaugauccgccggcgcaacaagauccugaaccgggacgggagcgaggacgugccgaagcgcggccccgucuccaaggagcacaucgacugggcccgggaccuggcccaggggaaguuccucgugguguucaacccgcccuggggcgacaucaacaaggcgggcaagagcgggaucgcccuggccgccacgggcauggccaagcugaucgagcucgacgggcccaagaucgcggaggaccugaaggagucccucaagagccuggucgccuggaucaacgcccacaaggacgagguggagaacggcaaggagguggucgacgggcugaccaagcaccuccagaaggcccuggagcuggccaagcagagcuccgcgaugcgcgcccagggcgcccagaucgacaccguguucagcuccuacuacuggcuguggaaggccggcgugaccgcggagauguuccccacggucagccaguuccucuucgagcuggggaaggugccccggggcaacaagaagaugaagaaggcccuguccagcaugccccucaagugggggaagaagcugcuggcccucuucgccgacgacuccuucaccgccaaccgcaucuacaugcacccgggcgugcugaccgcggggcggaugagcgagcugggcgucugcuucggcgccauccccguggccaaccccgacgacgccgccgagggguccggccacaucaagaacauccucaacuacaagaccgacacgcaggcggggaaccccugcgcccagaacaucgucgcccuguucaacauccagaaggccggcuucgacaucgagagcauggacaucguggccuccgagcaccuccugcaccagagccugguggggaagcgcuccccguuccagaacgcguacaacauccggggcaacgccaccagcauccagaucaucuga

SEQ ID NO: 6744 - RNA, 1449 nt, Artificial Sequence
  derived and/or modified CDS sequence (opt1) from NSDV(616287)__HQ286605.1__N
augcagaaccagaucguggccgacaacaaggacgccauccuggcguggcacaagaccuacagcgagaagcacaagcucaaguccguccugaccaacagcgccuccuucugcgagacgauccccgaccugagcggcuacgagguguccaugcgccucgugagcuccgagagcgagaaggacuccgucuacgccagcgcccugguggccgcgaccaaguucugcgccccgauccuggagugcgccuggaccuccugcaccgggaugauccagcggggccucgacugguucgacaacaacggggagauggugaagaucugggacgccgacuacggcaagcugcgcacggagguccccagccccgagcagcugcucggguaccagcgggcggcccugaaguggcgcaaggacaccaaguacggcaucaacaagaacaccgccgcccuggccgcggccaucgccaccgaguaccgggugcccggcuccaucguggucaacgugaaggacaugcucagcgacaugauccgccggcgcaacaagauccugaaccgggacggguccgaggacgugccgaagaagggccccgucagcaaggagcacguggacugggcccgcgaccuggcccaggggaaguuccucguggucuucaacccgcccuggggcgacaucaacaaggcggggaaguccggcaucgcccuggccgccacgggcauggccaagcugaucgagcucgacgggcccaagguggcggaggaccugaaggagagccugaagucccucguggccuggaucaacgcccacaaggacgaggucgagaacggcaaggaggugguggacgggcugaccaagcaccuccagaaggcccuggagcuggccaagcagagcagcgcgaugcgggcccagggcgcccagaucgacaccgucuucuccagcuacuacuggcuguggaaggccggcgugaccgcggagauguuccccacggugucccaguuccucuucgagcuggggaaggucccccgcggcaacaagaagaugaagaaggcccugagcuccaugccccucaagugggggaagaagcugcuggcccucuucgccgacgacagcuucaccgccaaccggaucuacaugcacccgggcgugcugaccgcggggcgcauguccgagcugggcgucugcuucggcgccauccccguggccaaccccgacgacgccgccgaggggagcggccacaucaagaacauccucaacuacaagaccgacacgcaggcggggaaccccugcgcccagaacaucguggcccuguucaacauccagaaggccggcuucgacaucgaguccauggacaucgucgccagcgagcaccuccugcaccagucccugguggggaagcggagcccguuccagaacgcguacaacauccgcggcaacgccaccuccauccagaucaucuga

SEQ ID NO: 6745 - RNA, 1449 nt, Artificial Sequence
  derived and/or modified CDS sequence (opt1) from NSDV(615526)__HQ286606.1__N
augcagaaccagaucguggccgacaacaaggacgccauccuggcguggcacaaggccuacagcgagaagcacaagcucaaguccguccugaccaacagcgccuccuucugcgagaccauccccgaccugagcggcuacgagguguccaugcgccucgugagcuccgagagcgagaaggacuccgucuacgccagcgcccugguggcggccacgaaguucugcgccccgauccuggagugcgccuggaccuccugcaccgggaugauccagcggggccucgacugguucgacagcaacggggagauggugaagaucugggacgcggacuacggcaagcugcgcaccgagguccccucccccgagcagcugcucggguaccagcgggccgcccugaaguggcgcaaggacacgaaguacggcaucaacaagaacaccgccgcccuggcggccgccaucgccaccgaguaccgggugcccggcagcaucguggucaacgugaaggacaugcucuccgacaugauccgccggcgcaacaagauccugaaccgggacgggagcgaggacgugccgaagggcgggcccgucuccaaggagcacaucgacugggcccgcgaccuggcgcagggcaaguuccucgugguguucaacccgcccuggggcgacaucaacaaggccggcaagagcgggaucgcccuggccgccaccgggauggcgaagcugaucgagcucgacggccccaagaucgccgaggaccugaaggagucccucaagagccuggucgccuggaucaacgcccacaaggacgagguggagaacgggaaggagguggucgacggccugacgaagcaccuccagaaggcccuggagcuggcgaagcagagcuccgccaugcgggcccagggcgcccagaucgacaccguguucagcuccuacuacuggcuguggaaggcgggggugaccgccgagauguuccccaccgucagccaguuccucuucgagcugggcaaggugccccgcgggaacaagaagaugaagaaggcccuguccagcaugccccucaaguggggcaagaagcugcuggcccucuucgccgacgacuccuucacggcgaaccggaucuacaugcacccgggggugcugaccgccggccgcaugagcgagcugggcgucugcuucggggccauccccguggccaaccccgacgacgccgcggagggcuccgggcacaucaagaacauccucaacuacaagaccgacacccaggccggcaaccccugcgcccagaacaucgucgcccuguucaacauccagaaggccggguucgacaucgagagcauggacaucguggcguccgagcaccuccugcaccagagccuggugggcaagcgguccccguuccagaacgccuacaacauccgcggcaacgccacgagcauccagaucaucuga

SEQ ID NO: 6746 - RNA, 1449 nt, Artificial Sequence
  derived and/or modified CDS sequence (opt1) from NSDV(708)__AF504293.1__N
augcagaaccagaucguggccgacaacaaggacgccauccuggcguggcacaaggccuacagcgagaagcacaagcucaaguccguccugaccaacagcgccuccuucugcgaggccauccccgaccugagcggcuacgagguguccaugcgccucgugagcuccgacagcgagaaggacuccgucuacgccagcgcgcugguggccgccaccaaguucugcgccccgauccuggagugcgcguggacguccugcaccgggaugguggagcggggccucgacugguucgagaacaaccgcgagauggucaagaucugggacaccgaguacgggaagcugcggaccgaggugcccagccccgagcagcugcucggcuaccagcgcgccgcccugaaguggcggaaggacacgaaguacgggaucaacaagaacaccgccgcccuggcggccgccaucgccaccgaguacaaggugcccggcucccucgucgugaacgugaaggacaugcugagcgacaugauccgccggcgcaacaagauccugaaccgggacggcuccgaggacgucccgaagcgcgggcccgugagcaaggagcacaucgacugggcccgggaccucgcgcagggcaaguuccugguggucuucaacccgcccuggggcgacaucaacaaggccgggaaguccgggaucgcccuggccgccaccggcauggcgaagcucaucgagcuggacggccccaagaucgccgaggaccugaaggagagccucaagucccugguggccuggaucaacgcccacaaggacgagguggagaacgggaaggaggucguggacagccugacgaaguaccuccagaaggcccuggagcuggcgaagcagagcuccgccaugcgcgcccagggcgcccagaucgacaccguguucagcuccuacuacuggcucuggaaggcgggggucaccgccgagauguuccccaccgugagccaguuccuguucgagcugggcaaggugccccggggcaacaagaagaugaagaaggcccucuccagcaugccccugaagugggggaagaagcugcucgcccuguucgccgacgacuccuucacggcgaaccgcaucuacaugcacccgggcguccugaccgccgggcggaugagcgagcucggcgugugcuucggggccauccccgucgccaaccccgacgacgccgcggacggcuccggccacaucaagagcauccugaacuacaagaccgacacccaggccgggaaccccugcgcccagaacaucguggcccuguucaacauccagaaggccggcuucgacaucgaguccauggacaucguggcgagcgagcaccuccugcaccagucccuggucgggaagcgcagcccguuccagaacgccuacaacauccggggcaacgccacguccauccagaucaucuga

SEQ ID NO: 6747 - RNA, 702 nt, Artificial Sequence
  derived and/or modified CDS sequence (opt1) from BUNV__NC_001927.1__N
augaucgagcuggaguuccacgacguggccgccaacaccagcuccaccuucgaccccgaggucgcguacgccaacuucaagcgcgugcacacgaccggccucagcuacgaccacauccggaucuucuacaucaaggggcgcgagaucaagaccucccuggccaagcggagcgagugggaggugacccugaaccucggcggguggaagaucacggucuacaacaccaacuucccgggcaaccgcaacaaccccgugcccgacgacgggcugacccugcaccggcucuccggcuuccuggcccgcuaccugcucgagaagaugcugaaggugagcgagcccgagaagcugaucaucaaguccaagaucaucaacccgcucgccgagaagaacggcaucaccuggaacgacggggaggaggucuaccugagcuucuuccccggcuccgagauguuccuggggacguuccgguucuacccccucgcgaucggcaucuacaaggugcagcgcaaggagauggagcccaaguaccuggagaagaccaugcggcagcgcuacauggggcuggaggccgccaccuggaccgugagcaagcucacggagguccaguccgcccugaccguggugagcucccugggcuggaagaagaccaacgucagcgcggccgcccgggacuuccucgccaaguucggcaucaacauguga

SEQ ID NO: 6748 - RNA, 702 nt, Artificial Sequence
  derived and/or modified CDS sequence (opt1) from BUNV(SFCrEq231)__KP063894.1__N
augaucgagcuggaguucaacgacguggccgccaacaccagcuccaccuucgaccccgaggucgcguacaucaacuucaagcgcaucuacacgaccggccucagcuacgaccacauccggaucuucuacaucaaggggcgcgagaucaagaccucccugaccaagcggagcgagugggaggugacgcugaaccucggcggguggaaggugaccgucuucaacaccaacuucccgggcaaccgcaacucccccgugcccgacgacgggcugacccugcaccggcucagcggcuuccuggcccgcuaccugcucgagaagauccugaagguguccgagcccgagaagcugaucaucaagagcaagaucaucaacccgcucgccgagaagaacggcaucacgugguccgacggggaggaggucuaccugagcuucuuccccggcuccgagauguuccuggggaccuucaaguucuacccccucgccaucggcaucuacaaggugcagcggaaggagauggagcccaaguaccuggagaagaccaugcgccagcgguacauggggcuggaggccagcaccuggacgguguccaaggucaacgaggugcagagcgcgcucaccguggucuccggccugggcuggaagaagaccaacgugagcgccgccgcccgcgaguuccuggcgaaguucgggaucaacauguga

SEQ ID NO: 6749 - RNA, 702 nt, Artificial Sequence
  derived and/or modified CDS sequence (opt1) from BUNV(AMH001130)__JF961342.1__N
augaucgagcuggaguuccacgacguggccgccaacaccagcuccaccuucgaccccgaggucgcguacgccaacuucaagcgcgugcacacgaccggccucagcuacgaccacauccggaucuucuacaucaaggggcgcgaggugaagaccucccuggccaagcggagcgagugggaggucacccugaaccucggcggguggaagaucacgguguacaacaccaacuucccgggcaaccgcaacaaccccgugcccgacgacgggcugacccugcaccggcucuccggcuuccuggcccgcuaccugcucgagaagaugcugaaggucagcgagcccgagaagcugaucaucaaguccaagaucaucaacccgcucgccgagaagaacggcaucaccuggaacgacggggaggagguguaccugagcuucuuccccggcuccgagauguuccuggggacguuccgguucuacccccucgcgaucggcaucuacaaggugcagcgcaaggagauggagcccaaguaccuggagaagaccaugcggcagcgcuacauggggcuggaggccgccaccuggaccgucagcaagcucacggaggugcaguccgcccugaccguggucagcucccugggcuggaagaagaccaacgugagcgcggccgcccgggacuuccucgccaaguucggcaucaacauguga

SEQ ID NO: 6750 - RNA, 702 nt, Artificial Sequence
  derived and/or modified CDS sequence (opt1) from BUNV(ArB29051)__AM709778.1__N
augaucgagcuggaguuccacgacguggccgccaacaccagcuccaccuucgaccccgaggucgcguacgccaacuucaagcgcgugcacacgaccggccucagcuacgaccacauccggaucuucuacaucaaggggcgcgagaucaagaccucccuggccaagcggagcgagugggaggugacccugaaccucggcggguggaagaucacggucuacaacaccaacuucccgggcaaccgcaacaaccccgugcccgacgacgggcugacccugcaccggcucuccggcuuccuggcccgcuaccugcucgagaagaugcugaagcugagcgagcccgagaagcucaucaucaaguccaagaucaucaacccgcuggccgagaagaacggcaucaccuggaacgacggggaggagguguaccugagcuucuuccccggcuccgagauguuccucgggacguuccgguucuacccccuggcgaucggcaucuacaagguccagcgcaaggagauggagcccaaguaccuggagaagaccaugcggcagcgcuacauggggcucgaggccgccaccuggaccgugagcaagcugacggaggugcaguccgcccugaccgucgugagcucccucggcuggaagaagaccaacgugagcgcggccgcccgggacuuccuggccaaguucggcaucaacauguga

SEQ ID NO: 6751 - RNA, 702 nt, Artificial Sequence
  derived and/or modified CDS sequence (opt1) from BUNV(ArB28215)__AM711130.1__N
augaucgagcuggaguucaacgacguggccgucaacaccagcuccagcuucgaccccgaggccgcguacgccaacuucaagcgcgugcacaccacgggccucuccuacgaccacauccggaucuucuacaucaaggggcgcgagaucaaggugagccuguccaagcggagcgagugggaggucaccaucaaccugggcggguggaagaucgccguguacaacaccaacuucccgggcaaccgcaacucccccgugcccgacgacgggcucacccugcaccggcugagcggcuuccucgcccgcuuccugcuggagaagaugcucaagauguccgagcccgagaagcugaucaucaaggccaagaucaucaacccgcuggcggagaagaaccggaucacguggaacgacggcgaggaggucuaccucagcuucuuccccggguccgagauguuccugggcaccuucaaguucuacccccuggccaucgggaucuacaaggugcagcgcaaggagauggagcccaaguacuucgagaagaccaugcggcagcgcuacaugggccucgaggccagcuccuggaccgugagcaagcugacggacguccaguccgcccugaccguggugagcgggcucggcuggaagaagaccaacgucuccgcggccgcccgggacuuccuggccaaguucggcaucaacauguga

SEQ ID NO: 6752 - RNA, 702 nt, Artificial Sequence
  derived and/or modified CDS sequence (opt1) from BUNV(Peurto Almendras)__AJ697960.1__N
augagcgagaucgccuucgacgacaucggccagaucgccgcguccaccuucaaccccgacaaccaguacaucggguucaagaagguguucaccaucggccugacguacgaccagauccgcaucuucuuccucaacgggaagaaggccaaggagacccugagcaagcgguccgaggagaccgucacccugaacuucggcggguggcgcaucccgaucgugaacacgcacuuccccggcaaccggaacaucgaccucgccgacgacgcccugacccugcaccgcgugagcggcuaccucgcccgguaccugcuggagaagguccucuccgcgcaggagcccgagaaggugaucaucaagacccgcaucaucaaccccaucgccgccagcaacgggaucaccugggacgacggcuacgagguguaccuguccuucuucccggggagcgagugcuuccuggaggccuucaaguucuacccccucgcgaucggcaucuacaagguccagaaggggaugauggacgugaaguuccuggagaagacgaugcggcagaaguacgccggccuggacgccaccguguggacccagcagaaguacaccgacgucaucaacgcccuccugguggugaacggccugggguggaagaaguccaacgucagcgccgcggccaaggacuuccucuccaaguucggcauccagaucuga

SEQ ID NO: 6753 - RNA, 702 nt, Artificial Sequence
  derived and/or modified CDS sequence (opt1) from BUNV__AF325122.1__N
augaucgagcuggaguucaacgacguggccgccaacaccagcuccaccuucgaccccgaggucgcguacaucaacuucaagcgccucuacacgaccggccugagcuacgaccacauccggaucuucuacaucaaggggcgcgagaucaagaccucccuggccaagcggagcgagugggaggugacccucaaccugggcggguggaaggugacggucuucaacaccaacuucccgggcaaccgcaacucccccgugcccgacgacgggcugacccuccaccggcugagcggcuaccuggcccgcuaccuccuggagaagauccugaagguguccgaccccgagaagcucaucaucaagagcaagaucaucaacccgcuggccgagaagaacggcaucaccugguccgacggggaggaggucuaccugagcuucuuccccggcuccgagauguuccucgggacguuccgguucuacccccuggccaucggcaucuacaaggugcagcgcaaggagauggagcccaaguaccuggagaagaccaugcggcagcgcuacauggggcucgaggcgagcaccuggaccguguccaagcugaacgagguccagagcgcccugacggugguguccggccucggcuggaagaagaccaacgucagcuccgccgcccgggaguuccuggcgaaguucgggaucagcauguga

SEQ ID NO: 6754 - RNA, 702 nt, Artificial Sequence
  derived and/or modified CDS sequence (opt1) from Ab-BUNV(Cu20-XJ)__KJ710424.1__N
augcuggagcucgaguucgaggacgugcccaccaacaucggcagcaccuucgacccggaguccggguacaucaacuuccagcgcaacuaccugcccggcgucacgcuggaccagauccggaucuucuacaucaaggggcgcgagaucaagaacagccucgccaagcgguccgagugggaggugacccugaaccugggcggguggaaggugcccguccucaacaccaacuuccccggcaaccgcagcaacgccgugccggacuacggccugaccuuccaccggaucuccggguaccuggcgcgcuaccuccugggcaaguaccuggccgagacggagcccgagaagcucaucaugcggaccaagaucaucaacccccuggccgagaagaacgggaucaccugggagagcggccccgagguguaccuguccuucuucccgggggccgagauguuccucggcaccuucaaguucuacccccuggccaucggcaucuacaagguccagcgcaaggagauggaccccaaguuccuggagaagacgaugcggcagcgcuaccucgggcuggacgcgcagaccuggaccaccacgaagcuggacgagguggagcgggcccucaagguggucagcggccugggguggaagaagaccaacguguccaacgccgcccgcgaguuccugagcaaguucggcauccggauguga

SEQ ID NO: 6755 - RNA, 702 nt, Artificial Sequence
  derived and/or modified CDS sequence (opt1) from ANADV(2513 Irkutsk)__KT313716.1__N
augaucgagcuggaguucaacgacguggccgccaacaccagcuccaccuucgaccccgaggucgcguacaucaacuucaagcgcaucuacacgaccggccucagcuacgaccacauccggaucuucuacaucaaggggcgcgagaucaagaccucccuggccaagcggagcgagugggaggugacccugaaccucggcggguggaaggugacggucuucaacaccaacuucccgggcaaccgcaacucccccgugcccgacgacgggcugacccugcaccggcucagcggcuuccuggcccgcuaccugcucgagaagauccugaagguguccgaccccgagaagcugaucaucaagagcaagaucaucaacccgcucgccgagaagaacggcaucaccugggccgacggggaggaggucuaccuguccuucuuccccggcagcgagauguuccuggggacguuccgguucuacccccucgcgaucggcaucuacaaggugcagcgcaaggagauggagcccaaguaccuggagaagaccaugcggcagcgcuacauggggcuggaggccuccaccuggaccgugagcaagcucaacgagguccaguccgcccugacgguggugagcggccugggcuggaagaagaccaacgucuccagcgccgcgcgggaguuccucgcccgcuucgggaucaacauguga

SEQ ID NO: 6756 - RNA, 702 nt, Artificial Sequence
  derived and/or modified CDS sequence (opt1) from ANADV(EIV-23263Tyum)__KT313761.1__N
augaucgagcuggaguucaacgacguggccgccaacaccagcuccaccuucgaccccgaggucgcguacaucaacuucaagcgcaucuacacgaccggccucagcuacgaccacauccggaucuucuacaucaaggggcgcgagaucaagaccucccuggccaagcggagcgagugggaggugacccugaaccucggcggguggaagaucacgguguucaacaccaacuucccgggcaaccgcaacucccccguccccgacgacgggcugacccugcaccggcucagcggcuuccuggcccgcuaccugcucgagaagauccugaagguguccgaccccgagaagcugaucaucaagagcaagaucaucaacccgcucgccgagaagaacggcaucaccugggccgacggggaggagguguaccuguccuucuuccccggcagcgagauguuccuggggacguuccgguucuacccccucgcgaucggcaucuacaagguccagcgcaaggagauggagcccaaguaccuggagaagaccaugcggcagcgcuacauggggcuggaggccuccaccuggaccgugagcaagcucaacgaggugcaguccgcccugacggucgugagcggccugggcuggaagaagaccaacguguccagcgccgcgcgggaguuccucgcccgcuucgggaucaacauguga

SEQ ID NO: 6757 - RNA, 702 nt, Artificial Sequence
  derived and/or modified CDS sequence (opt1) from BATV__X73464.1__N
augaucgagcuggaguucaacgacguggccgccaacaccagcuccaccuucgaccccgaggucgcguacaucaacuucaagcgcaucuacacgaccggccucagcuacgacaacauccggaucuucuacaucaaggggcgcgagaucaagaccucccugagcaagcgguccgagugggaggugacccugaaccucggcggguggaaggugacggucuucaacaccaacuucccgggcaaccgcaacagccccgugcccgacgacgggcugacccugcaccggcucuccggcuuccuggcccgcuaccugcucgagaagauccugaaggugagcgaccccgagaagcugaucaucaaguccaagaucgucaacccgcucgccgagaagaacggcaucaccugggccgacggggaggagguguaccugagcuucuuccccggcuccgagauguuccuggggacguuccgguucuacccccucgccaucggcaucuacaaggugcagcgcaaggagauggagcccaaguaccuggagaagaccaugcggcagcgcuacauggggcuggaggcgagcaccuggaccgucuccaagcucaacgaggugcagagcgcccugacgguggucuccggccugggcuggaagaagaccaacgugagcuccgccgcccgggaguuccucgcgaaguucgggaucagcauguga

SEQ ID NO: 6758 - RNA, 702 nt, Artificial Sequence
  derived and/or modified CDS sequence (opt1) from BATV(668)__KT313687.1__N
augaucgagcuggaguucaacgacguggccgccaacaccagcuccaccuucgaccccgaggucgcguaccucaacuucaagcgcaucuacacgaccggccugagcuacgacaacauccggaucuucuacaucaaggggcgcgagaucaaggugucccuggccaagcggagcgagugggaggugacccucaaccugggcggguggaaggucaccguguucaacacgaacuucccgggcaaccgcaacucccccgugcccgacgacgggcugacccuccaccggcugagcggcuuccuggcccgcuaccuccuggagaagauccugaaggucuccgaccccgagaagcucaucaucaagagcaagaucaucaacccgcuggccgagaagaacggcaucaccugguccgacggggaggagguguaccugagcuucuuccccggcuccgagauguuccucgggaccuuccgguucuacccccuggccaucggcaucuacaaggugcagcgcaaggagauggagcccaaguaccuggagaagacgaugcggcagcgcuacauggggcucgaggcgagcaccuggaccgucuccaagcugaacgaggugcagagcgcccugaccguggucuccggccucggcuggaagaagacgaacgugagcuccgccgcccgggaguuccuggcgaaguucgggaucaacauguga

SEQ ID NO: 6759 - RNA, 702 nt, Artificial Sequence
  derived and/or modified CDS sequence (opt1) from BATV(804922)__FJ436805.1__N
augaucgagcuggaguucaacgacguggccgccaacaccagcuccaccuucgaccccgaggucgcguacaucaacuucaagcgcaucuacacgaccggccucagcuacgacaacauccggaucuucuacaucaaggggcgcgagaucaagaccucccuggccaagcggagcgagugggaggugacccugaaccucggcggguggaaggugacggucuucaacaccaacuucccgggcaaccgcaacucccccgugcccgacgacgggcugacccugcaccggcucagcggcuuccuggcccgcuaccugcucgagaagauccugaagguguccgaccccgagaagcugaucaucaagagcaagaucgucaacccgcucgccgagaagaacggcaucaccugggccgacggggaggagguguaccuguccuucuuccccggcagcgagauguuccuggggacguuccgguucuacccccucgcgaucggcaucuacaaggugcagcgcaaggagauggagcccaaguaccuggagaagaccaugcggcagcgcuacauggggcuggaggccuccaccuggaccgucagcaagcucaacgaggugcaguccgcccugacgguggucagcggccugggcuggaagaagaccaacguguccagcgccgcgcgggaguuccucgccaaguucgggaucuccauguga

SEQ ID NO: 6760 - RNA, 702 nt, Artificial Sequence
  derived and/or modified CDS sequence (opt1) from BATV(8627-11)__FJ436802.1__N
augaucgagcuggaguucaacgacguggccgccaacaccagcuccaccuucgaccccgaggucgcguacaucaacuucaagcgcaucuacacgaccggccucagcuacgacaacauccggaucuucuacaucaaggggcgcgagaucaagaccucccuggccaagcggagcgagugggaggugacccugaaccucggcggguggaaggugacggucuucaacaccaacuucccgggcaaccgcaacucccccgugcccgacgacgggcugacccugcaccggcucagcggcuuccuggcccgcuaccugcucgagaagauccugaagguguccgaccccgagaagcugaucaucaagagcaagaucgucaacccgcucgccgagaagaacggcaucaccugggccgacggggaggagguguaccuguccuucuuccccggcagcgagauguuccuggggacguuccgguucuacccccucgcgaucggcaucuacaaggugcagcgcaaggagauggagcccaaguaccuggagaagaccaugcggcaccgcuacauggggcuggaggccuccaccuggaccgucagcaagcucaacgaggugcaguccgcccugacgguggucagcggccugggcuggaagaagaccaacguguccagcgccgcgcgggaguuccucgccaaguucgggaucuccauguga

SEQ ID NO: 6761 - RNA, 702 nt, Artificial Sequence
  derived and/or modified CDS sequence (opt1) from BATV(G-20217)__FJ436806.1__N
augaucgagcuggaguucaacgacguggccgccaacaccagcuccaccuucgaccccgaggucgcguacaucaacuucaagcgcaucuacacgaccggccucagcuacgacaacauccggaucuucuacaucaaggggcgcgagaucaagaccucccuggccaagcggagcgagugggaggugacccugaaccucggcggguggaaggugacggucuucaacaccaacuucccgggcaaccgcaacucccccgugcccgacgacgggcugacccugcaccggcucagcggcuuccuggcccgcuaccugcucgagaagauccugaagguguccgaccccgagaagcugaucaucaagagcaagaucgucaacccgcucgccgagaagaacggcaucaccugggccgacggggaggagguguaccuguccuucuuccccggcagcgagauguuccuggggacguuccgguucuacccccucuccaucggcaucuacaaggugcagcgcaaggagauggagcccaaguaccuggagaagaccaugcggcagcgcuacauggggcuggaggcgagcaccuggaccgucuccaagcucaacgaggugcagagcgcccugacgguggucuccggccugggcuggaagaagaccaacgugagcuccgccgcccgggaguuccucgcgaaguucgggaucagcauguga

SEQ ID NO: 6762 - RNA, 702 nt, Artificial Sequence
  derived and/or modified CDS sequence (opt1) from BATV(MS50)__JX846604.1__N
augaucgagcuggaguucaacgacguggccgccaacaccagcuccaccuucgaccccgaggucgcguacgccaacuucaagcgcgugcacacgaccggccucagcuacgaccacgugcggaucuucuacaucaaggggcgcgagaucaagaccucccugagcaagcgguccgagugggaggucacccugaaccucggcggguggaagaucgccguguacaacacgaacuucccgagcaaccgcaacaaccccgugcccgacgacggccugacccugcaccggcucuccggguaccuggcccgcuaccuguucgagaagaucgucaaggugagcgagcccgagaagcuccugaucaaguccaagaucaucaacccgcuggccgagaagaacggcaucaccugggcggacggcgaggagaucuaccucagcuucuuccccggguccgagauguuccugggcaccuucaaguucuacccccuggccaucgggaucuacaaggugcagcggaaggagauggagcccaaguaccucgagaagacgaugcgccagcgguacaugggccuggaggccgggaccuggaccgucagcaaggugaacgaggugcaggccgcggucaacgugguguccacccugggcuggaagaagacgaacgucagcgccgccgcccgcgaguuccucgccaaguucggcaucgcgauguga

SEQ ID NO: 6763 - RNA, 702 nt, Artificial Sequence
  derived and/or modified CDS sequence (opt1) from BATV(ON-1/E/94)__AB257761.1__N
augaucgagcuggaguucaacgacguggccgccaacaccagcuccaccuucgaccccgaggucgcguacaucaacuucaagcgcguguacacgaccggccucagcuacgacaacauccggaucuucuacaucaaggggcgcgagaucaagaccucccuggccaagcggagcgagugggaggugacccugaaccucggcggguggaaggucacgguguucaacaccaacuucccgggcaaccgcaacucccccgugcccgacgacgggcugacccugcaccggcucagcggcuuccuggcccgcuaccugcucgagaagauccugaaggucuccgaccccgagaagcugaucaucaagagcaagaucgugaacccgcucgccgagaagaacggcaucaccugggccgacggggaggagguguaccuguccuucuuccccggcagcgagauguuccuggggacguuccgguucuacccccucgcgaucggcaucuacaagguccagcgcaaggagauggagcccaaguaccuggagaagaccaugcggcagcgcuacauggggcuggaggccuccaccuggaccgugagcaagcucaacgaggugcaguccgcccugacggucgugagcggccugggcuggaagaagaccaacguguccagcgccgcgcgggaguuccucgccaaguucgggaucuccauguga

SEQ ID NO: 6764 - RNA, 702 nt, Artificial Sequence
  derived and/or modified CDS sequence (opt1) from BATV(UgMP-6830)__JX846601.1__N
augaucgagcuggaguucaacgacguggccgccaacaccagcuccaccuucgaccccgaggucgcguacaucaacuucaagcgcaucuacacgaccggccucagcuacgacaacauccggaucuucuacaucaaggggcgcgagaucaagaccucccuggccaagcggagcgagugggaggugacccugaaccucggcggguggaaggugacggucuucaacaccaacuucccgggcaaccgcaacucccccgugcccgacgacgggcugacccugcaccggcucagcggcuuccuggcccgcuaccugcucgagaagauccugaagguguccgaccccgagaagcugaucaucaagagcaagaucaucaacccgcucgccgagaagaacggcaucaccugggccgacggggaggaggucuaccuguccuucuuccccggcagcgagauguuccuggggacguuccgguucuacccccucgcgaucggcaucuacaaggugcagcgcaaggagauggagcccaaguaccuggagaagaccaugcggcagcgcuacauggggcuggaggccuccaccuggaccgugagcaagcucaacgagguccaguccgcccugacgguggugagcggccugggcuggaagaagaccaacgucuccagcgccgcgcgggaguuccucgccaaguucgggaucuccauguga

SEQ ID NO: 6765 - RNA, 702 nt, Artificial Sequence
  derived and/or modified CDS sequence (opt1) from BIRV(ArB2198)__AM711131.1__N
augaucgagcuggaguuccaccacguggccgccaacaccagcuccaccuucgaccccgaggucgcguacgccaacuucaagcgcauccacacgaacggccucagcuacgacaacauccggaucuucuacaucaaggggcgcgagaucaagaccucccuggccaagcggagcgagugggaggugacccugaaccucggcggguggaagguggccgucuacaacaccaacuucccgggcaaccgcaacaaccccgugcccgacgacgggcugacgcugcaccggcucuccggcuuccuggcccgcuaccugcucgagaagaugcugaaggugagcgagcccgagaagcugaucaucaagaccaagaucaucaacccgcucgcggagaagaacggcaucaccuggaaggacggggaggaggucuaccuguccuucuuccccggcagcgagauguuccuggggaccuucaaguucuacccccucgccaucggcaucuacaaggugcagaagaaggagauggaccccaaguaccuggagaagacgaugcggcagcgcuacauggggcuggaggccuccaccuggaccgugagcaaggucuccgaggugcagagcgcccucaccguggucuccagccugggcuggaagaagacgaacgugaccgcggccgcccgggacuucuucgccaaguucggcaucaacauguga

SEQ ID NO: 6766 - RNA, 702 nt, Artificial Sequence
  derived and/or modified CDS sequence (opt1) from BOZOV(ArB13529)__AM711132.1__N
augaucgagcuggaguucaacgacguggccgccaacaccagcuccaccuucgaccccgaggcggccuacgccaacuucaagcgcguccacacgaccggccucaccuacgaccacauccggaucuucuacaucaaggggagcgagaucaagaccucccuggccaagcgcagcgagugggaggugacgcugaaccucggcggguggaagaucaccguguacaacaccaacuucccgggcaaccggaacaaccccucccccgacgacgggcugacccugcacuucuucugcggcuuccucgccaagagccugcuggagaagaugcucaaggucuccgcgcccgagaagcugaucaucaagagcaagaucacguccccgcuggccgagaagaacggcaucaccuggaacgacggggaggagguguaccucagcuucuuccccggcuccgagauguuccuggggaccuuccacuucuacccccugcccaucggcaucuaccaggggcuccgccgggaccuggagccgaaguacuucggcaagacccugcgccucauguacaugggccuggaggccagcuccuggacggugagcaagcugaccgaggggcaguccgcccucaccgucgugagcggccugggguggaagaagaccaacguguccgcggccgcccgggacuuccuggccaaguucggcaucaacauguga

SEQ ID NO: 6767 - RNA, 702 nt, Artificial Sequence
  derived and/or modified CDS sequence (opt1) from CVV__X73465.1__N
augaucgagcuggaguucaacgacguggccgccaacaccagcuccaccuucgaccccgagaucgcguacgucaacuucaagcgcauccacacgaccggccucagcuacgaccacauccggaucuucuacaucaaggggcgcgagaucaagaccucccugaccaagcggagcgagugggaggugacgcugaaccucggcggguggaaggugaccgucuucaacaccaacuucccgggcaaccgcaacucccccgugcccgacgacgggcugacccugcaccggcucagcggcuaccuggcccgcuaccugcucgagaagauccugaagguguccgaccccgagaaggucaucaucaagagcaagaucaucaacccgcuggccgagaagaacggcaucacgugguccgacggggaggagguguaccucagcuucuuccccggcuccgagauguuccuggggaccuucaaguucuacccccuggccaucggcaucuacaaggugcagcggaaggagauggagcccaaguaccucgagaagaccaugcgccagcgguacauggggcuggaggccagcaccuggacgaucuccaaggucaacgaggugcaggcggcccugaccguggucagcggccucggcuggaagaagaccaacguguccgccgccgcgcgcgaguuccuggccaaguucgggaucagcauguga

SEQ ID NO: 6768 - RNA, 702 nt, Artificial Sequence
  derived and/or modified CDS sequence (opt1) from CVV(10081)__KP835932.1__N
augaucgagcuggaguucaacgacguggccgccaacaccagcuccaccuucgaccccgagaucgcguacgucaacuucaagcgcaucuacacgaccggccucagcuacgaccacauccggaucuucuacaucaaggggcgcgagaucaagaccucccugaccaagcggagcgagugggaggugacgcugaaccucggcggguggaagaucaccguguucaacaccaacuucccgggcaaccgcaacucccccguccccgacgacgggcugacccugcaccggcucagcggcuaccuggcccgcuaccugcucgagaagauccugaagguguccgaccccgagaaggugaucaucaagagcaagaucaucaacccgcuggccgagaagaacggcaucacgugguccgacggggaggaggucuaccucagcuucuuccccggcuccgagauguuccuggggaccuucaaguucuacccccuggccaucggcaucuacaaggugcagcggaaggagauggagcccaaguaccucgagaagaccaugcgccagcgguacauggggcuggaggccagcaccuggacgaucuccaaggugaacgagguccaggcggcccugaccguggugagcggccucggcuggaagaagaccaacgucuccgccgccgcgcgcgaguuccuggccaaguucgggaucagcauguga

SEQ ID NO: 6769 - RNA, 702 nt, Artificial Sequence
  derived and/or modified CDS sequence (opt1) from CHLV(CHLV-Mex07)__EU879062.3__N
augaucgagcuggaguucaacgacguggccgccaacaccagcuccaccuucgaccccgagaucgcguacgucaacuucaagcgcaucuacacgaccggccucagcuacgaccacauccggaucuucuacaucaaggggcgcgagaucaagaccucccugaccaagcggagcgagugggaggugacgcugaaccucggcggguggaaggugaccgucuucaacaccaacuucccgggcaaccgcaacucccccgugcccgacgacgggcugacccugcaccggcucagcggcuaccuggcccgcuaccugcucgagaagauccugaagguguccgaccccgagaaggucaucaucaagagcaagaucaucaacccgcuggccgagaagaacggcaucacgugguccgacggggaggagguguaccucagcuucuuccccggcuccgagauguuccuggggaccuucaaguucuacccccuggccaucggcaucuacaaggugcagcggaaggagauggagcccaaguaccucgagaagaccaugcgccagcgguacauggggcuggaggccagcaccuggacggucuccaaggugaacgaggugcaggcggcccugaccgucgugagcggccucggcuggaagaagaccaacguguccgccgccgcgcgcgaguuccuggccaaguucgggaucagcauguga

SEQ ID NO: 6770 - RNA, 702 nt, Artificial Sequence
  derived and/or modified CDS sequence (opt1) from GERV__M19420.1__N
augcuggagcucgaguucgaggacgugcccaacaacaucggcagcaccuucgacccggaguccggguacaccaacuuccagcgcaacuaccugcccggcgucacgcuggaccagauccggaucuucuacaucaaggggcgcgagaucaagaacagccucuccaagcggagcgagugggaggugacccugaaccugggcggguggaaggugcccguccucaacaccaacuuccccggcaaccgcaacaacgccgugccggacuacggccugaccuuccaccggaucuccggguaccuggcccgcuaccuccugggcaaguaccuggcggagacggagcccgagaagcucaucaugcggaccaagaucgugaacccccuggccgagaagaacgggaucaccugggagagcggccccgaggucuaccuguccuucuucccgggggccgagauguuccucggcaccuuccgcuucuacccccuggccaucggcaucuacaaggugcagcggaaggagauggaccccaaguuccuggagaagacgaugcgccagcgguaccucgggaucgacgcccagaccuggaccaccacgaagcugggcgagguggaggcggcccugaaggucgugagcgggcucggcuggaagaagaccaacguguccagcgccgcccgcgaguuccuguccaaguucggcauccggauguga

SEQ ID NO: 6771 - RNA, 702 nt, Artificial Sequence
  derived and/or modified CDS sequence (opt1) from IACOV(BeAn314206)__JN572067.1__N
augagcgagaucaucuucgacgacgugggccagaucaccuccagcaccuucaaccccgacguccaguacaucaacuucaagaagaaccacacgaccgggcugaacuacgaccagauccgcguguucuuccucaacggcaagaaggccaaggagacccuggccaagcgguccgaggagagccugcagcucaacuucgggggcuggcgcguggucgugaugaacacccacuucccggggaaccggaacaugcugauccccgacgaggcgaugacgcugcaccgccucuccggcuaccuggcccgguaccugcucgagcgcauccugagcggccccgagcacgagaagguggucaucaccuccaagaucgugaaccccaucgccgccagcaacgggaucaccuggaccgacggcccggagguguaccuguccuucuuccccgggacggagauguuccucgagagcuucaaguucuacccccuggccaucggcaucuacaagguccagaagaagaugauggaguccaaguaccuggagaaggcgaugcggcagaaguacagcgggauggacgccacccucuggacccagcagaaguacgccgaggugaccaacgcccuggcgguggucuccaaccugggcuggaagaaguccaacgugagcgccgccgcccgcgacuuccucgccaaguucggcauccagcuguga

SEQ ID NO: 6772 - RNA, 702 nt, Artificial Sequence
  derived and/or modified CDS sequence (opt1) from ILEV(ArB16282)__AM709780.1__N
augaucgagcuggaguuccacgacgugaccgccaacaccagcuccacguucgaccccgaggucgccuacgcgaacuucaagcgcauccacaccaacggccucaacuacgaccacauccggaucuucuacaucaaggggcgcgagaucaagaccagccuggccaagcgguccgagugggaggugacccugaaccucggcggguggaagaucagcguguacaacacgaaguucccgggcaaccgcaacaaccccguccccgacgacgggcugacccugcaccggcucuccggcuuccuggcccgcuaccugcucgagaagaugcugaaggugagcgagcccgagaagcugaucaucaaguccaagaucaucaacccgcucgccgagaagaacggcaucaccugguacgacggggaggagguguaccugagcuucuuccccggcuccgagaugugccuggggacccaggacuucuaccccauggccaucgaguucuaccagguccagcggaaggagauggagcccaaguuccucgagaagacgcugaagcagcgcagccugggccucgagccguccaccuggaccaucagccagcuggugaagcugcaguccgcgcucaccguggucagcgggcugggcuggaagaagacgaacgugggcgccgccgcccggaacuuccuggcgaaguucgggaucaacauguga

SEQ ID NO: 6773 - RNA, 702 nt, Artificial Sequence
  derived and/or modified CDS sequence (opt1) from ILEV(HB80P125)__AM709779.1__N
augaucgagcuggaguuccacgacgugaccgccaacaccagcuccacguucgaccccgaggucgccuacgcgaacuucaagcgcauccacaccaacggccucaacuacgaccacauccggaucuucuacaucaaggggcgcgagaucaagaccagccuggccaagcgguccgagugggaggugacccugaaccucggcggguggaagaucgccguguacaacacgaacuucccgggcaaccgcaacaaccccguccccgacgacgggcugacccugcaccggcucagcggcuaccuggcccgcugccugcucgagaagaugcugaagguguccgagcccgagaagcagaucaucaagagcaagaucaucaacccgcuggccgagaagaacggcaucaccugggacgacggggaggagguguaccucuccuucuuccccggcagcgagauguuccuggggaccuuccgguucuacccccuggcgaucggcaucuacaagguccagcgcaaggagauggagcccaaguaccucgagaagacgaugcggcagcgcuacauggggcuggaggccuccaccuggaccaucagcaagcuggccgaggugcaguccgcccucaccguggucagcggccugggcuggaagaagacgaacguguccgcggccgcccgggacuuccuggccaaguucgggaucaacauguga

SEQ ID NO: 6774 - RNA, 702 nt, Artificial Sequence
  derived and/or modified CDS sequence (opt1) from ILEV(ILESHA/8e)__KC608151.1__N
augaucgagcuggaguuccacgacgugaccgccaacaccagcuccacguucgaccccgaggucgccuacgcgaacuucaagcgcauccacaccaacggccucaacuacgaccacauccggaucuucuacaucaaggggcgcgagaucaagaccagccuggccaagcgguccgagugggaggugacccugaaccucggcggguggaagaucgccguguacaacacgaacuucccgggcaaccgcaacaaccccauccccgacgacgggcugacccugcaccggcucagcggcuaccuggcccgcuaccugcucgagaagaugcugaaggucuccgagcccgagaagcagaucaucaagagcaagaucaucaacccgcuggccgagaagaacggcaucaccugggacgacggggaggagguguaccucuccuucuuccccggcagcgagauguuccuggggaccuuccgguucuacccccuggcgaucggcaucuacaaggugcagcgcaaggagauggagcccaaguaccucgagaagacgaugcggcagcgcuacauggggcuggaggccuccaccuggaccaucagcaagcuggccgagguccaguccgcccucaccguggugagcggccugggcuggaagaagacgaacgucuccgcggccgcccgggacuuccuggccaaguucgggaucaacauguga

SEQ ID NO: 6775 - RNA, 702 nt, Artificial Sequence
  derived and/or modified CDS sequence (opt1) from ILEV(R5964)__AY729651.1__N
augaucgagcuggaguuccacgacgugaccgccaacaccagcuccacguucgaccccgaggucgccuacgcgaacuucaagcgcauccacaccaacggccucaacuacgaccacauccggaucuucuacaucaaggggcgcgagaucaagaccagccuggccaagcgguccgagugggaggugacccugaaccucggcggguggaagaucgccguguacaacacgaacuucccgggcaaccgcaacaaccccauccccgacgacgggcugacccugcaccggcucagcggcuaccuggcccgcuaccugcucgagaagaugcugaaggucuccgagcccgagaagcagaucaucaagagcaagaucaucaacccgcuggccgagaagaacggcaucaccugggacgacggggaggagguguaccucuccuucuuccccggcagcgagauguuccuggggaccuuccgguucuacccccuggcgaucggcaucuacaaggugcagcgcaaggagauggagcccaaguaccucgagaagacgaugcggcagcgcuacauggggcuggaggccuccaccuggaccaucagcaagcuggccgagguccaguccgcccucaccguggugagcggccugggcuggaagaagacgaacgucuccgcgccggcccgggacuuccuggccaaguucgggaucaacauguga

SEQ ID NO: 6776 - RNA, 702 nt, Artificial Sequence
  derived and/or modified CDS sequence (opt1) from MAGV__D13783.1__N
augaucgagcuggaguucaacgacguggccgccaacaccagcuccaccuucgaccccgagaucgcguacgucaacuucaagcgcauccacacgaccggccucagcuacgaccacauccgggugcuguacaucaaggggcgcgagaucaagaccucccugaccaagcggagcgagugggaggugacgcucaaccugggcggguggaaggucgccguguucaacaccaacuucccgggcaaccgcaacucccccgugcccgacgacgggcugacccuccaccggcugagcggcuuccuggcccgcuaccuccuggagaagauccugaaggucuccgaccccgagaagcucaucaucaagagcaagaucaucaacccgcuggccgagaagaacggcaucaccugggccgacggggaggagguguaccuguccuucuuccccggcagcgagauguuccucgggacguucaaguucuacccccuggcgaucggcaucuacaaggugcagaagaaggagauggagcccaaguaccuggagaagaccaugcggcagcgcuacauggggcucgaggccgccaccuggaccgucuccaaggugaacgaggugcaggccgcgcugacggucgugagcggccugggcuggaagaagaccaacguguccgccgccgcccgggaguuccucgccaaguucgggaucaacauguga

SEQ ID NO: 6777 - RNA, 702 nt, Artificial Sequence
  derived and/or modified CDS sequence (opt1) from MAGV(7272)__KX100103.1__N
augaucgagcuggaguucaacgacguggccgccaacaccagcuccaccuucgaccccgagaucgcguacgucaacuucaagcgcauccacacgaccggccucagcuacgaccacauccgggugcuguacaucaaggggcgcgagaucaagaccucccugaccaagcggagcgagugggaggugacgcucaaccugggcggguggaaggucgccguguucaacaccaacuucccgggcaaccgcaacucccccgugcccgacgacgggcugacccuccaccggcugagcggcuuccuggcccgcuaccuccuggagaagauccugaaggucuccgaccccgagaagcucaucaucaagagcaagaucaucaacccgcuggccgagaagaacggcaucaccugggccgacggggaggagguguaccuguccuucuuccccggcagcgagauguuccucgggacguucaaguucuacccccuggcgaucggcaucuacaaggugcagcggaaggagauggagcccaaguaccuggagaagaccaugcgccagcgguacauggggcucgaggccgccaccuggaccgucuccaaggugaacgaggugcaggccgcgcugacggucgugagcggccugggcuggaagaagaccaacguguccgccgccgcccgcgaguuccucgccaaguucgggaucaacauguga

SEQ ID NO: 6778 - RNA, 702 nt, Artificial Sequence
  derived and/or modified CDS sequence (opt1) from MAGV(3363)__KX100106.1__N
augaucgagcuggaguucaacgacguggccgccaacaccagcuccaccuucgaccccgagaucgcguacgucaacuucaagcgcaucuacacgaccggccucagcuacgaccacauccggaucuucuacaucaaggggcgcgagaucaagaccucccugaccaagcggagcgagugggaggugacgcugaaccucggcggguggaaggugaccgucuucaacaccaacuucccgggcaaccgcaacucccccgugcccgacgacgggcugacccugcaccggcucagcggcuaccuggcccgcuaccugcucgagaagauccugaagguguccgaccccgagaaggucaucaucaagagcaagaucaucaacccgcuggccgagaagaacggcaucacgugguccgacggggaggagguguaccucagcuucuuccccggcuccgagauguuccuggggaccuucaaguucuacccccuggccaucggcaucuacaaggugcagcggaaggagauggagcccaaguaccucgagaagaccaugcgccagcgguacauggggcuggaggccagcaccuggacgaucuccaaggucaacgaggugcaggcggcccugaccguggucagcggccucggcuggaagaagaccaacguguccgccgccgcgcgcgaguuccuggccaaguucgggaucagcauguga

SEQ ID NO: 6779 - RNA, 702 nt, Artificial Sequence
  derived and/or modified CDS sequence (opt1) from NRIV(DakArY357/6e)__AY593727.1__N
augaucgagcuggaguuccacgacgugaccgccaacaccagcuccacguucgaccccgaggucgccuacgcgaacuucaagcgcauccacaccaacggccucaacuacgacuacauccggaucuucuacaucaaggggcgcgagaucaagaccagccuggccaagcgguccgagugggaggugacccugaaccucggcggguggaagaucgccguguacaacacgaacuucccgggcaaccgcaacaaccccauccccgacgacgggcugacccugcaccggcucagcggcuaccuggcccgcuaccugcucgagaagaugcugaaggucuccgagcccgagaagcagaucaucaagagcaagaucaucaacccgcuggccgagaagaacggcaucaccugggacgacggggaggagguguaccucuccuucuuccccggcagcgagauguuccuggggaccuuccgguucuacccccuggcgaucggcaucuacaaggugcagcgcaaggagauggagcccaaguaccucgagaagacgaugcggcagcgcuacauggggcuggaggccuccaccuggaccaucagcaagcuggccgagguccaguccgcccucaccguggugagcggccugggcuggaagaagacgaacgucuccgcggccgcccgggacuuccuggccaaguucgggaucaacauguga

SEQ ID NO: 6780 - RNA, 702 nt, Artificial Sequence
  derived and/or modified CDS sequence (opt1) from NORV__X73470.1__N
augaucgagcuggaguucaacgacguggccgccaacaccagcuccaccuucgaccccgaggucgcguacaucaacuucaagcgcguguacacgaccggccucagcuacgaccacauccggaucuucuacaucaaggggcgcgagaucaagaccucccugaccaagcggagcgagugggaggugacgcugaaccucggcggguggaaggucaccguguucaacaccaacuucccgggcaaccgcaacucccccgugcccgacgacgggcugacccugcaccggcucagcggcuuccuggcccgcuaccugcucgagaagauccugaaggucuccgagcccgagaagcugaucaucaagagcaagaucaucaacccgcucgccgagaagaacggcaucacguggaccgacggggaggagguguaccuguccuucuuccccggcagcgagauguuccuggggaccuucaaguucuacccccucgccaucggcaucuacaaggugcagcggaaggagauggagcccaaguaccuggagaagaccaugcgccagcgguacauggggcuggaggccuccacguggaccaucagcaaggucaacgaggugcaggcggcccucaccguggucuccggccugggcuggaagaagaccaacgugagcgccgccgcgcgcgaguuccuggccaaguucgggaucaacauguga

SEQ ID NO: 6781 - RNA, 702 nt, Artificial Sequence
  derived and/or modified CDS sequence (opt1) from POTV(89-3380)__AY729652.1__N
augaucgagcuggaguucaacgacguggccgccgacaccagcuccaccuucgaccccgagaucgcguacgucaacuucaagcgcauccacacgaccggccucagcuacgaccacauccggaucuucuacaucaaggggcgcgagaucaagaccucccugaccaagcggagcgagugggaggugacgcugaaccucggcggguggaagaucaccguguucaacaccaacuucccgggcaaccgcaacucccccguccccgacgacgggcugacccugcaccggcucagcggcuaccuggcccgcuaccugcucgagaagauccugaagguguccgaccccgagaaggugaucaucaagagcaagaucaucaacccgcuggccgagaagaacggcaucacgugguccgacggggaggaggucuaccucagcuucuuccccggcuccgagauguuccuggggaccuucaaguucuacccccuggccaucggcaucuacaaggugcagcggaaggagauggagcccaaguaccucgagaagaccaugcgccagcgguacauggggcuggaggccagcaccuggacgguguccaaggucaacgaggugcaggcggcccugaccguggucagcggccucggcuggaagaagaccaacguguccgccgccgcgcgcgaguuccuggccaaguucgggaucagcauguga

SEQ ID NO: 6782 - RNA, 702 nt, Artificial Sequence
  derived and/or modified CDS sequence (opt1) from SHOV(4042)__EU564831.1__N
augaucgagcuggaguuccacgacguggccgccaacaccagcuccaccuucgaccccgaggucgcguacgccaacuucaagcgcgugcacacgaccggccucagcuacgaccacauccggaucuucuacaucaaggggcgcgagaucaagaccucccuggccaagcggagcgagugggaggugacccugaaccucggcggguggaagaucacggucuacaacaccaacuucccgggcaaccgcaacaaccccgugcccgacgacgggcugacccugcaccggcucuccggcuuccuggcccgcuaccugcucgagaagaugcugaaggugagcgagcccgagaagcugaucaucaaguccaagaucaucaacccgcucgccgagaagaacggcaucaccuggacggacggggaggaggucuaccugagcuucuuccccggcgcggagauguuccuggggaccuucaaguucuacccccucgccaucggcaucuacaaggugcagcggaaggagauggagcccaaguaccuggagaagaccaugcgccagcgguacauggggcuggaggccgccaccuggacgguguccaagcucaccgagguccaggcggcccugaccguggugagcggccugggcuggaagaagaccaacgucuccgccgccgcccgcgacuuccucgcgaaguucgggaucagcauguga

SEQ ID NO: 6783 - RNA, 702 nt, Artificial Sequence
  derived and/or modified CDS sequence (opt1) from TENV(TSV-FE3-66FB)__FJ943505.1__N
augaucgagcuggaguucaacgacguggccgccaacaccagcuccaccuucgaccccgaggucggcuacgugaacuucaagcgcgugcacacgaccgggcucagcuacgaccacauccggaucuucuacaucaagggccgcgagaucaagaccucccugaccaagcggagcgagugggaggucacgcugaaccucgggggcuggaaggugaccguguucaacaccaacuucccggggaaccgcaacucccccguccccgacgacggccugacccugcaccggcucagcggcuuccuggcgcgcuaccugcucgagaagauccugaagguguccgaccccgagaagcugaucaucaagagcaagaucaucaacccgcucgccgagaagaacgggaucacgugggccgacggcgaggagguguaccuguccuucuuccccgggagcgagauguuccugggcaccuucaaguucuacccccucgccaucgggaucuacaagguccagcggaaggagauggagcccaaguaccuggagaagaccaugcgccagcgguacaugggccuggaggccgcgaccuggacgaucuccaaggugaacgaggugcagagcgcccucaccgucguguccggccugggguggaagaagaccaacgugagcgccgccgcgcgcgaguuccuggccaaguucggcaucaacauguga

SEQ ID NO: 6784 - RNA, 702 nt, Artificial Sequence
  derived and/or modified CDS sequence (opt1) from XINV(BeH388464)__EU564830.1__N
augcuggagcucgaguucaacgacguggccgccaacaccagcuccaccuucgaccccgaggucggcuacgcgaacuucaagcgcauccacacgaacgggcugagcuacgacaacauccggaucuucuacaucaagggccgcgagaucaagaccucccuggccaagcggagcgagugggaggugacccucaaccucgggggcuggaagaucaccguguacaacacgaacuucccggggaaccgcaaccaccccauccccgacgacggccugaccauccaccggcuguccggcuaccuggcccgcuaccugcucgagaagauccugaaggucagcgaccccgagaagcugcucaucaagaccaagaucaucaacccgcuggccgagaagaacgggaucaccuggaacgacggcgaggagguguaccuguccuucuuccccgggagcgagauguuccucggcacguucaaguucuacccccuggccaucgggaucuacaaggugcagcggaaggagauggagcccaaguaccuggagaaggcgaugcgccagcgguacaugggccucgaguccgccaccuggaccgucagcaagcugaacgaggugcaguccgcccugaccguggucagcggccucggguggaagaagacgaacguguccgccgcggcccgcgaguuccuggccaaguucggcaucaacauguga

SEQ ID NO: 6785 - RNA, 702 nt, Artificial Sequence; identical to SEQ ID NO: 6747
  derived and/or modified CDS sequence (opt1) from NRIV(9800535)__JX857328.1__N

SEQ ID NO: 6786 - RNA, 702 nt, Artificial Sequence
  derived and/or modified CDS sequence (opt1) from NRIV(Adrar)__KJ716848.1__N
augaucgagcuggaguuccacgacguggccgccaacaccagcuccaccuucgaccccgaggucgcguacgccaacuucaagcgcaucuacacgaccggccucagcuacgaccacauccggaucuucuacaucaaggggcgcgagaucaagaccucccuggccaagcggagcgagugggaggugacccugaaccucggcggguggaagaucacgguguacaacaccaacuucccgggcaaccgcaacaaccccguccccgacgacgggcugacccugcaccggcucuccggcuuccuggcccgcuaccugcucgagaagaugcugaaggugagcgagcccgagaagcugaucaucaaguccaagaucaucaacccgcucgccgagaagaacggcaucaccuggaacgacggggaggagguguaccugagcuucuuccccggcuccgagauguuccuggggacguuccgguucuacccccucgcgaucggcaucuacaagguccagcgcaaggagauggagcccaaguaccuggagaagaccaugcggcagcgcuacauggggcuggaggccgccaccuggaccgugagcaagcucacggaggugcaguccgcccugaccgucgugagcucccugggcuggaagaagaccaacgugagcgcggccgcccgggacuuccucgccaaguucggcaucaacauguga

SEQ ID NO: 6787 - RNA, 702 nt, Artificial Sequence
  derived and/or modified CDS sequence (opt1) from NRIV(D28542/4e)__KC608154.1__N
augaucgagcuggaguuccacgacguggccgccaacaccagcuccaccuucgaccccgaggucgcguacgccaacuucaagcgcguguacacgaccggccucagcuacgaccacauccggaucuucuacaucaaggggcgcgagaucaagaccucccuggccaagcggagcgagugggaggugacccugaaccucggcggguggaagaucacggucuacaacaccaacuucccgggcaaccgcaacaaccccgugcccgacgacgggcugacccugcaccggcucuccggcuuccuggcccgcuaccugcucgagaagaugcugaaggugagcgagcccgagaagcugaucaucaaguccaagaucaucaacccgcucgccgagaagaacggcaucaccuggaacgacggggaggaggucuaccugagcuucuuccccggcuccgagauguuccuggggacguuccgguucuacccccucgcgaucggcaucuacaaggugcagcgcaaggagauggagcccaaguaccuggagaagaccaugcggcagcgcuacauggggcuggaggccgccaccuggaccgugagcaagcucacggagguccaguccgcccugaccguggugagcucccugggcuggaagaagaccaacgucagcgcggccgcccgggacuuccucgccaaguucggcaucaacauguga

SEQ ID NO: 6788 - RNA, 702 nt, Artificial Sequence
  derived and/or modified CDS sequence (opt1) from NRIV(SUD-HKV141)__JX857322.1__N
augaucgagcuggaguuccacgacguggccgccaacaccagcuccaccuucgaccccgaggucgcguacgccaacuucaagcgcgugcacacgaccggccucagcuacgaccacauccggaucuucuacaucaaggggcgcgagaucaagaccucccuggccaagcggagcgagugggaggugacccugaaccucggcggguggaaggucacgguguacaacaccaacuucccgggcaaccgcaacaaccccgugcccgacgacgggcugacccugcaccggcucuccggcuuccuggcccgcuaccugcucgagaagaugcugaaggucagcgagcccgagaagcugaucaucaaguccaagaucaucaacccgcucgccgagaagaacggcaucaccuggaacgacggggaggagguguaccugagcuucuuccccggcuccgagauguuccuggggacguuccgguucuacccccucgcgaucggcaucuacaaggugcagcgcaaggagauggagcccaaguaccuggagaagaccaugcggcagcgcuacauggggcuggaggccgccaccuggaccgucagcaagcucacggaggugcaguccgcccugaccguggucagcucccugggcuggaagaagaccaacgugagcgcggccgcccgggacuuccucgccaaguucggcaucaacauguga

SEQ ID NO: 6789 - RNA, 705 nt, Artificial Sequence
  derived and/or modified CDS sequence (opt1) from BWAV(M459)__NC_034480.1__N
augagcgaccugaucuucuacgacguggacuccgucaacgccaacgaguucgaccccgacaccggcuaccucgacuucaagaacaacuacccgggggcccugaacaccaacacggcgcgcaccuucuuccugaacgccgccaaggccaagaacgugcuccggaacaagcccgacaagaaggugaaccccaaguucggcaacugggaggucgagguggugaacaaccacuuccccgggaaccgcaacaacccgaucggcaaggacgaccugacccugcaccggaucagcggguaccucgcccgcuggauccuggaggaguacaagcgggacgacgaguccgagaaggagaucaucgagagcaccgucaucaaccccaucgcggaguccaacggcauccgcuggagcgacggcgccgagaucuaccuguccuucuuccccgggacggagauguuccucgagcccuucaaguucuacccgcuggccaucggcaucuaccgggugaagcacaagaugauggacgcccaguuccugaagaaggcgcuccgccagcgguacgggaagaugaccgccgagaaguggaugagcaccaaggugaagaccaucggcgaggccguccgcaacguggagaagcugaagugggggaagggcggccuguccgacgccgcccggaacuuccucaagaaguucgacaucgcgaugaucuga

SEQ ID NO: 6790 - RNA, 705 nt, Artificial Sequence
  derived and/or modified CDS sequence (opt1) from BWAV(M459)__EU564827.1__N
augagcgaccugaucuucuacgacguggacuccgucaacgccaacgaguucgaccccgacaccggcuaccucgacuucaagaacaacuacccgggggcccugaacaccaacacggcgcgcaccuucuuccugaacgccgccaaggccaagaacgugcuccggaacaagcccgacaagaaggugaaccccaaguucggcaacugggaggucgagguggugaacaaccacuuccccgggaaccgcaacaacccgaucggcaaggacgaccugacccugcaccggaucagcggguaccucgcccgcuggauccuggaggaguacaagcgggacgacgaguccgagaaggagaucaucgagagcaccgucaucaaccccaucgcggaguccaacggcauccgcuggagcgacggcgccgagaucuaccuguccuucuuccccgggacggagauguuccucgagcccuucaaguucuacccgcuggccaucggcaucuaccgggugaagcacaagaugauggacgcccaguuccugaagaaggcgcuccgccagcgguacgggaagaugaccgccgagaaguggaugagcaccaaggugaaggccaucggcgaggccguccgcaacguggagaagcugaagugggggaagggcggccuguccgacgccgcgcggaacuuccucaagaaguucgacaucgccaugaucuga

SEQ ID NO: 6791 - RNA, 705 nt, Artificial Sequence
  derived and/or modified CDS sequence (opt1) from BWAV(UgAr1888)__KJ867185.1__N
augagcgaccugaucuucuacgacguggacuccgucaacgccaacgaguucgaccccgacaccggcuaccucgacuucaagaacaacuacccgggggcccugaacaccaacacggcgcgcaccuucuuccugaacgccgccaaggccaagaacgugcuccggaacaagcccgacaagaaggugaaccccaaguucggcaacugggaggucgagaucgugaacaaccacuuccccgggaaccgcaacaacccgaucggcaaggacgaccugacccugcaccggaucagcggguaccucgcccgcuggauccuggaggaguacaagcgggacgacgaguccgagaaggagaucaucgagagcaccgugaucaaccccaucgcggaguccaacggcauccgcuggagcgacggcgccgagaucuaccuguccuucuuccccgggacggagauguuccucgagcccuucaaguucuacccgcuggccaucggcaucuaccgggucaagcacaagaugauggacgcccaguuccugaagaaggcgcuccgccagcgguacgggaagaugaccgccgagaaguggaugagcaccaaggugaaggccaucggcgaggccgugcgcaacgucgagaagcugaagugggggaagggcggccuguccgacgccgcgcggaacuuccucaagaaguucgacaucgccaugaucuga

SEQ ID NO: 6792 - RNA, 708 nt, Artificial Sequence
  derived and/or modified CDS sequence (opt1) from BWAV/PGAV(SAAr1)__EU564828.1__N
augagcggcgaccugguguucuacgacgucgacuccgugaacagcaacgccuucgaccccgacgccggguacguggcguucuccaacaaccacccgggcgcccucaacaucaccaccgcccgcacguucuuccugaacgccgccaaggcgaaggggguccugcggaacaagcccgacaagaaggugaagcccaaguucggcgacugggagguggagaucgucaacaaccacuuccccgggaaccgcaacaacaccaucggcgaggacgaccucacccugcaccggaucagcggcuaccuggcccgcugggugcucgaggagcacuccaaggacgacgagagcgagaaggagcugaucgaguccaccaucgugaacccgaucgccgagagcaacgggaucaagugguccgacggcgccgcgaucuaccugagcuucuuccccgggacggagauguuccucgagcccuucaaguucuucccccuggccaucggcaucuaccgggucaagcacaagaugauggacgcccaguuccugaagaaggcccuccgccagcgguacgggaagcugaccgccgagaaguggauggcgaccaaggugaaguccaucggcgaggccgugcgcgccgucgagaagcugaaguggggcaagggcgggaucagcgacgccgcccggaccuuccucaagaaguucgacaucgcgcugaucuga

SEQ ID NO: 6793 - RNA, 708 nt, Artificial Sequence; identical to SEQ ID NO: 6792
  derived and/or modified CDS sequence (opt1) from BWAV/PGAV(191B-07)__KJ867179.1__N

SEQ ID NO: 6794 - RNA, 708 nt, Artificial Sequence
  derived and/or modified CDS sequence (opt1) from CEV(283)__KX817314.1__N
augagcgaccugguguucuacgacgucgccuccaccggcgccaacggguucgaccccgacgcgggcuacguggacuucugcgccaaguacggggagagcaucaaccucgccgccgugcgcaucuucuuccugaacgccgcgaaggccaaggccgcccugucccggaagccggagcgcaaggcgaaccccaaguucggcgaguggcaggucgagguggugaacaaccacuuccccgccaaccggaacaaccccaucgggaacaacgaccucaccauccaccgcaucagcggcuaccuggcccgguggguccuggagcaguacaaggagaacgaggacgagucccagcgcgagcucgugaagacgaccgugaucaacccgaucgccgagagcaacggcauccggugggagaacggggccgagaucuaccuggcguucuuccccggcaccgagauguuccuggagaccuucaaguucuacccccucacgaucgggaucuaccgcgucaagaacggcaugauggacucccaguaccugaagaaggcccugcggcagcgcuacgggagccucaccgccgagaaguggaugucccagaagaccggcaugaucgccaagagccugaaggagguggagcagcugaaguggggccgcgggggccucuccgacaccgcccggacguuccugcagaaguucgggaucaagcugcccuga

SEQ ID NO: 6795 - RNA, 708 nt, Artificial Sequence
  derived and/or modified CDS sequence (opt1) from CEV(BFS-283)__U12797.1__N
augagcgaccugguguucuacgacgucgccuccaccggcgccaacggguucgaccccgacgcgggcuacguggacuucugcgccaagcacggggagagcaucaaccucgccgccgugcgcaucuucuuccugaacgccgcgaaggccaaggccgcccugucccggaagccggagcgcaaggcgaaccccaaguucggcgaguggcaggucgagguggugaacaaccacuuccccgccaaccggaacaaccccaucgggaacaacgaccucaccauccaccgcaucagcggcuaccuggcccgguggguccuggagcaguacaaggagaacgaggacgagucccagcgcgagcucgugaagacgaccgugaucaacccgaucgccgagagcaacggcauccggugggagaacggggccgagaucuaccuggcguucuuccccggcaccgagauguuccuggagaccuucaaguucuacccccucacgaucgggaucuaccgcgucaagaacggcaugauggacucccaguaccugaagaaggcccugcggcagcgcuacgggagccucaccgccgagaaguggaugucccagaagaccggcaugaucgccaagagccugaaggagguggagcagcugaaguggggccgcgggggccucuccgacaccgcccggacguuccugcagaaguucgggaucaagcugcccuga

SEQ ID NO: 6796 - RNA, 708 nt, Artificial Sequence
  derived and/or modified CDS sequence (opt1) from CHATV(Mohko ILO8-3)__KF719221.1__N
augagcgaccugguguucuacgacgucgccuccaccggcgccaacggguucgaccccgacgagggcuacauggcguucugcgugaagcacgccgagagcaucucccucgccgccgugcgcaucuucuuccugaacgccgcgaaggccaaggccgcccuggcgcggaagccggagaagaaggccagccccaaguucggggaguggcaggucgagaucgugaacaaccacuuccccggcaaccgcaacaaccccaucgggaacaacgaccucaccgugcaccggcuguccggcuaccuggcccgcuggguccucgagcaguacaaggagaacgaggacgagagccagcgggagcugaucaagacgaccgugaucaacccgaucgccgaguccaacggcgugcgcugggacagcgggcccgagaucuaccuguccuucuuccccggcaccgagauguuccucgagaccuucaaguucuacccccugacgaucgggaucuaccgggucaagcagggcaugauggacccgcaguaccugaagaaggcccuccgccagcgguacgggacccugaccgcggacaaguggaugagccagaaggugaccgccaucgccaagucccugaaggagguggagcagcucaaguggggccgcggcgggcugagcgacacggcccggaccuuccugcagaaguucggcauccgccuccccuga

SEQ ID NO: 6797 - RNA, 708 nt, Artificial Sequence
  derived and/or modified CDS sequence (opt1) from CHATV(Mohko M07-1)__KF719224.1__N
augagcgaccugguguucuacgacgucgccuccaccggcgccaacggguucgaccccgacgagggcuacauggcguucugcgugaagcacgccgagagcaucaaccucgccgccgugcgcaucuucuuccugaacgccgcgaaggccaaggccgcccuggcgcggaagccggagaagaaggccucccccaaguucggggaguggcaggucgagaucgugaacaaccacuuccccggcaaccgcaacaaccccaucgggaacaacgaccucaccgugcaccggcugagcggcuaccuggcccgcuggguccucgagcaguacaaggagaacgaggacgagucccagcgggagcugaucaagacgaccgugaucaacccgaucgccgagagcaacggcgugcgcugggacuccgggcccgagaucuaccugagcuucuuccccggcaccgagauguuccucgagaccuucaaguucuacccccugacgaucgggaucuaccgggucaagcagggcaugauggacccgcaguaccugaagaaggcccuccgccagcgguacgggacccugaccgcggacaaguggaugucccagaaggugaccgccaucgccaagagccugaaggagguggagcagcucaaguggggccgcggcgggcuguccgacacggcccggaccuuccugcagaaguucggcauccgccuccccuga

SEQ ID NO: 6798 - RNA, 708 nt, Artificial Sequence
  derived and/or modified CDS sequence (opt1) from CHATV(Mohko S07-2)__KF719233.1__N
augagcgaccugguguucuacgacgucgccuccaccggcgccaacggguucgaccccgacgagggcuacauggcguucugcgugaagcacgccgagagcaucaaccucgccgccgugcgcaucuucuuccugaacgccgcgaaggccaaggccgcccuggcgcggaagccggagaagaaggccucccccaaguucggggaguggcaggucgagaucgugaacaaccacuuccccggcaaccgcaacaaccccaucgggaacaacgaccucaccgugcaccggcugagcggcuaccuggcccgcuggguccucgagcaguacaaggagaacgaggacgagucccagcgggagcugaucaagacgaccgugaucaacccgaucgccgagagcaacggcgugcgcugggacuccgggcccgagaucuaccugagcuucuuccccggcaccgagauguuccucgagaccuucaaggucuacccccugacgaccgggaucuaccgggugaagcagggcaugauggacccgcaguaccugaagaaggcccuccgccagcgguacgggacccugaccgcggacaaguggaugucccagaaggugacggccaucgccaagagccugaaggaggucgagcagcucaaguggggccgcggcgggcuguccgacaccgcccggaccuuccugcagaaguucggcauccgccuccccuga

SEQ ID NO: 6799 - RNA, 708 nt, Artificial Sequence
  derived and/or modified CDS sequence (opt1) from CHATV(LEIV-11483)__FJ853592.1__N
augagcgaccugguguucuacgacgucgccuccaccggcgccaacggguucgaccccgacgagggcuacauggcguucugcgugaagcacgggcagagcgugaaccucgccgccguccgcaucuucuuccugaacgccgccaaggcgaaggccgcccuggcccggaagccggagaagaaggcgucccccaaguucggcgaguggcaggucgagaucgugaacaaccacuuccccgggaaccgcaacaaccccaucggcaacaacgaccucaccauccaccggcugagcggcuaccuggcccgcugggugcucgagcaguacaaggagaacgaggacgagucccagcgggagcugaucaagacgaccgugaucaacccgaucgccgagagcaacggggugcgcugggacuccggcgccgagaucuaccugagcuucuuccccgggaccgagauguuccucgagaccuucaaguucuacccccugacgaucggcaucuaccgggucaagcaggggaugauggacccccaguaccugaagaaggcccuccgccagcgguacggcacccugaccgcggacaaguggaugucccagaaggugaccgccaucgccaagagccugaaggagguggagcagcucaaguggggccgcgggggccuguccgacacggcccggaccuuccugcagaaguucgggauccgccucccguga

SEQ ID NO: 6800 - RNA, 708 nt, Artificial Sequence
  derived and/or modified CDS sequence (opt1) from CHATV(LEIV-11552)__EU479702.1__N
augagcgaccugguguucuacgacgucgccuccaccggcgccaacggguucgaccccgacgagggcuacauggcguucugcgugaagcacgggcagagcgugaaccucgccgccguccgcaucuucuuccugaacgccgccaaggcgaaggccgcccuggcccggaagccggagaagaaggcgucccccaaguucggcgaguggcaggucgagaucgugaacaaccacuuccccgggaaccgcaacaaccccaucggcaacaacgaccucaccauccaccggcugagcggcuaccuggcccgcuggauccucgagcaguacaaggagaacgaggacgagucccagcgggagcugaucaagacgaccgugaucaacccgaucgccgagagcaacggggugcgcugggacuccggcgccgagaucuaccugagcuucuuccccgggaccgagauguuccucgagaccuucaaguucuacccccugacgaucggcaucuaccgggugaagcaggggaugauggacccccaguaccugaagaaggcccuccgccagcgguacggcacccugaccgcggacaaguggaugucccagaaggucaccgccaucgccaagagccugaaggagguggagcagcucaaguggggccgcgggggccuguccgacacggcccggaccuuccugcagaaguucgggauccgccucccguga

SEQ ID NO: 6801 - RNA, 708 nt, Artificial Sequence
  derived and/or modified CDS sequence (opt1) from CHATV(LEIV-13107)__FJ946829.1__N
augagcgaccugguguucuacgacgucgccuccaccggcgccaacggguucgaccccgacgagggcuacauggcguucugcgugaagcacgggcagagcgugaaccucgccgccguccgcaucuucuuccugaacgccgccaaggcgaaggccgcccuggcccggaagccggagaagaaggcgaaccccaaguucggcgaguggcaggucgagaucgugaacaaccacuuccccgggaaccgcaacaaccccaucggcaacaacgaccucaccauccaccggcuguccggcuaccuggcccgcugggugcucgagcaguacaaggagaacgaggacgagagccagcgggagcugaucaagacgaccgugaucaacccgaucgccgaguccaacggggugcgcugggacagcggcgccgaggucuaccuguccuucuuccccgggaccgagauguuccucgagaccuucaaguucuacccccugacgaucggcaucuaccgggugaagcaggggaugauggacccccaguaccugaagaaggcccuccgccagcgguacggcacccugaccgcggacaaguggaugagccagaaggugaccgccaucgccaagucccugaaggaggucgagcagcucaaguggggccgcgggggccugagcgacacggcccggaccuuccugcagaaguucgggauccgccucccguga

SEQ ID NO: 6802 - RNA, 708 nt, Artificial Sequence
  derived and/or modified CDS sequence (opt1) from CHATV(LEIV-17794)__FJ913879.1__N
augagcgaccugguguucuacgacgucgccuccaccggcgccaacggguucgaccccgacgagggcuacauggcguucugcgugaagcacgggcagagcgugaaccucgccgccguccgcaucuucuuccugaacgccgccaaggcgaaggccgcccuggcccggaagccggagcgcaaggcgucccccaaguucggcgaguggcaggucgagaucgugaacaaccacuuccccgggaaccggaacaaccccaucggcaacaacgaccucaccauccaccgccugagcggcuaccuggcccggugggugcucgagcaguacaaggagaacgaggacgagucccagcgcgagcugaucaagacgaccgugaucaacccgaucgccgagagcaacggggugcggugggacuccggcgccgagaucuaccugagcuucuuccccgggaccgagauguuccucgagaccuucaaguucuacccccugacgaucggcaucuaccgcgucaagcaggggaugauggacccccaguaccugaagaaggcccuccggcagcgcuacggcacccugaccgcggacaaguggaugucccagaaggugaccgccaucgccaagagccugaaggagguggagcagcucaaguggggccgcgggggccuguccgacacggcccggaccuuccugcagaaguucgggauccggcucccguga

SEQ ID NO: 6803 - RNA, 708 nt, Artificial Sequence
  derived and/or modified CDS sequence (opt1) from CHATV(LEIV-17827)__GQ330475.1__N
augagcgaccugguguucuacgacgucgccuccaccggcgccaacggguucgaccccgacgagggcuacauggcguucugcgugaaguacggggagagcaucaaccucgccgccgugcgcaucuucuuccugaacgccgccaaggcgaaggccgcccuggcccggaagccggagaagaaggcgaaccccaaguucggcgaguggcaggucgagaucgugaacaaccacuuccccgggaaccgcaacaaccccaucggcaacaacgaccucaccauccaccggcuguccggcuaccuggcccgcugggugcucgagcaguacaaggagaacgaggacgagagccagcgggagcugaucaagacgaccaucaucaacccgaucgccgaguccaacgggguccgcugggagagcggcgccgagguguaccuguccuucuuccccgggaccgagauguuccucgagaucuucaaguucuacccccugaccaucggcaucuaccgggugaagcaggggaugauggacccccaguaccugaagaaggcccuccgccagcgguacggcacgcugaccgcggacaaguggaugagccagaaggucaccgccaucgccaagucccugaaggagguggagcagcucaaguggggccgcgggggccugagcgacaccgcccggacguuccugcagaaguucgggauccgccucccguga

SEQ ID NO: 6804 - RNA, 708 nt, Artificial Sequence
  derived and/or modified CDS sequence (opt1) from CHATV(LEIV-17829)__GQ330476.1__N
augagcgaccugguguucuacgacgucgccuccaccggcgccaacggguucgaccccgacgagggcuacauggcguucugcgugaaguacggggagagcaucaaccucgccgccgugcgcaucuucuuccugaacgccgccaaggcgaaggccgcccuggcccggaagccggagaagaaggcgaaccccaaguucggcgaguggcaggucgagaucgugaacaaccacuuccccgggaaccgcaacaaccccaucggcaacaacgaccucaccauccaccggcuguccggcuaccuggcccgcugggugcucgagcaguacaaggagaacgaggacgagagccagcgggagcugaucaagacgaccaucaucaacccgaucgccgaguccaacgggguccgcugggacagcggcgccgagguguaccuguccuucuuccccgggaccgagauguuccucgagaucuucaaguucuacccccugaccaucggcaucuaccgggugaagcaggggaugauggacccccaguaccugaagaaggcccuccgccagcgguacggcacgcugaccgcggacaaguggaugagccagaaggucaccgccaucgccaagucccugaaggagguggagcagcucaaguggggccgcgggggccugagcgacaccgcccggacguuccugcagaaguucgggauccgccucccguga

SEQ ID NO: 6805 - RNA, 708 nt, Artificial Sequence
  derived and/or modified CDS sequence (opt1) from CHATV(LEIV-18733)__HQ734824.1__N
augagcgaccugguguucuacgacgucgccuccaccggcgccaacggguucgaccccgacgagggcuacauggcguucugcgugaaguacggggagagcaucaaccucgccgccgugcgcaucuucuuccugaacgccgccaaggcgaaggccgcccuggcccggaagccggagaagaaggcgaaccccaaguucggcgaguggcaggucgagaucaucaacaaccacuuccccgggaaccgcaacaaccccaucggcaacaacgaccucaccauccaccggcuguccggcuaccuggcccgcugggugcucgagcaguacaaggagaacgaggacgagagccagcgggagcugaucaagacgaccaucaucaacccgaucgccgaguccaacggggugcgcugggacagcggcgccgaggucuaccuguccuucuuccccgggaccgagauguuccucgagaucuucaaguucuacccccugaccaucggcaucuaccgggugaagcaggggaugauggacccccaguaccugaagaaggcccuccgccagcgguacggcacgcugaccgcggacaaguggaugagccagaaggugaccgccaucgccaagucccugaaggaggucgagcagcucaaguggggccgcgggggccugagcgacaccgcccggacguuccugcagaaguucgggauccgccucccguga

SEQ ID NO: 6806 - RNA, 708 nt, Artificial Sequence
  derived and/or modified CDS sequence (opt1) from CHATV(LEIV-18895)__GQ330482.1__N
augagcgaccugguguucuacgacgucgccuccaccggcgccaacggguucgaccccgacgagggcuacauggcguucugcgugaaguacggggagagcaucaaccucgccgccgugcgcaucuucuuccugaacgccgccaaggcgaaggccgcccuggcccggaagccggagcgcaaggcgaaccccaaguucggcgaguggcaggucgagaucgugaacaaccacuuccccgggaaccggaacaaccccaucggcaacaacgaccucaccauccaccgccuguccggcuaccuggcccggugggugcucgagcaguacaaggagaacgaggacgagagccagcgcgagcugaucaagacgaccaucaucaacccgaucgccgaguccaacgggguccggugggacagcggcgccgagguguaccuguccuucuuccccgggaccgagauguuccucgagaucuucaaguucuacccccugaccaucggcaucuaccgcgugaagcaggggcugauggacccccaguaccucaagaaggcccugcggcagcgcuacggcacgcugaccgcggacaaguggaugagccagaaggucaccgccaucgccaagucccucaaggagguggagcagcugaaguggggccgcgggggccugagcgacaccgcccggacguuccuccagaaguucgggauccggcugccguga

SEQ ID NO: 6807 - RNA, 708 nt, Artificial Sequence
  derived and/or modified CDS sequence (opt1) from CHATV(LEIV-22712)__HQ734825.1__N
augagcgaccugguguucuacgacgucgccuccaccggcgccaacggguucgaccccgacgagggcuacauggcguucugcgugaagcacggggagagcaucaaccucgccgccgugcgcaucuucuuccugaacgccgccaaggcgaaggccgcccuggcccggaagccggagaagaaggcgucccccaaguucggcgaguggcaggucgagaucaucaacaaccacuuccccgggaaccgcaacaaccccaucggcaacaacgaccucaccauccaccggcugagcggcuaccuggcccgcugggugcucgagcaguacaaggagaacgaggacgagucccagcgggagcugaucaagacgaccgugaucaacccgaucgccgagagcaacgggguccgcugggacuccggcgccgagaucuaccugagcuucuuccccgggaccgagauguuccucgagaccuucaaguucuacccccugacgaucggcaucuaccgggugaagcaggggaugauggacccccaguaccugaagaaggcccuccgccagcgguacggcacccugaccgcggacaaguggaugucccagaaggugaccgccaucgccaagagccugaaggaggucgagcagcucaaguggggccgcgggggccuguccgacacggcccggaccuuccugcagaaguucgggauccgccucccguga

SEQ ID NO: 6808 - RNA, 708 nt, Artificial Sequence
  derived and/or modified CDS sequence (opt1) from CHATV(LEIV-23500)__EU479701.1__N
augagcgaccugguguucuacgacgucgccuccaccggcgccaacggguucgaccccgacgcgggcuacauggccuucugcgugaagcacggggagagcaucaaccucgccgccgugcgcaucuucuuccugaacgccgcgaaggccaaggccgcccuggcgcggaagccggagaagaaggccaaccccaaguucggcgaguggcaggucgagaucgugaacaaccacuuccccgggaaccgcaacaaccccaucggcaacaacgaccucaccauccaccggcuguccggcuaccuggcccgcugggugcucgagcaguacaaggagaacgaggacgagagccagcgggagcugaucaagacgaccgucaucaacccgaucgccgaguccaacggggugcgcugggagaacggcgccgagguguaccugagcuucuuccccgggaccgagauguuccucgagaccuucaaguucuacccccugacgaucggcaucuaccgggucaagcaggggaugauggacccccaguaccugaagaaggcgcuccgccagcgguacggcacccugaccgccgacaaguggaugucccagaaggugaccgccaucgccaagagccugaaggagguggagcagcucaaguggggccgcgggggccuguccgacacggcccggaccuuccugcagaaguucgggauccgccucccguga

SEQ ID NO: 6809 - RNA, 708 nt, Artificial Sequence
  derived and/or modified CDS sequence (opt1) from INKV__Z68496.1__N
augggcgaccugguguucuacgacgaggccagcaccggggccaacggcuucgaccccgacgcgggguucgucgccuucauggccgaccacggcgaguccaucaaccucgccgccgugcgcaucuucuuccugaacgcggccaaggccaaggccgcgcuggcccggaagccggagcgcaaggccacccccaaguucggggaguggcaggucgagaucgugaacaaccacuuccccggcaaccggaacaaccccaucggcaacaacgaccucacgauccaccgccugagcggguaccuggcccggugggugcucgagcacuucaccgaggacgacgacgagucccagcgcgagcugauccggagcaccaucaucaacccgaucgccgaguccaacggcauccacuggaacaacgggcccgagaucuaccugagcuucuuccccggcaccgagauguuccucgagguguucaaguucuacccccugacgaucgggaucuaccgcgucaagcacggcaugauggacccgcaguaccugaagaaggcgcuccggcagcgcuacggcacccugaccgccgagaaguggauggcccagaagaccgugcugaucgccaagucccucaaggacguggagcagcugaagugggggcggggcgggcugagcgacgccgcgcgcacguuccucaucaaguucggcgucaagcugcccuga

SEQ ID NO: 6810 - RNA, 708 nt, Artificial Sequence
  derived and/or modified CDS sequence (opt1) from INKV(KN3641)__U47137.1__N
augggcgaccugguguucuacgacgucgccagcaccggggccaacggcuucgaccccgacgcgggguucguggccuucauggccgaccacggcgaguccaucaaccucgccgccgugcgcaucuucuuccugaacgcggccaaggccaaggccgcgcuggcccggaagccggagcgcaaggccacccccaaguucggggaguggcaggucgagaucgugaacaaccacuuccccggcaaccggaacaaccccaucggcaacaacgaccucacgauccaccgccugagcggguaccuggcccggugggugcucgagcacuucaccgaggacgacgacgagucccagcgcgagcugauccggagcaccaucaucaacccgaucgccgaguccaacggcauccacuggaacaacgggcccgagaucuaccugagcuucuuccccggcaccgagauguuccucgaggucuucaaguucuacccccugacgaucgggaucuaccgcgugaagcacggcaugauggacccgcaguaccugaagaaggcgcuccggcagcgcuacggcacccugaccgccgagaaguggauggcccagaagaccgugcugaucgccaagucccucaaggacgucgagcagcugaagugggggcggggcgggcugagcgacgccgcgcgcacguuccucaucaaguucggcgugaagcugcccuga

SEQ ID NO: 6811 - RNA, 708 nt, Artificial Sequence
  derived and/or modified CDS sequence (opt1) from INKV(Lovanger)__KU302751.1__N
augggcgaccugguguucuacgacgucgccagcaccggggccaacggcuucgaccccgacgcgggguucguggccuucauggccgaccacggcgaguccaucaaccucgccgccgugcgcaucuucuuccugaacgcggccaaggccaaggccgcgcuggcccggaagccggagcgcaaggccacccccaaguucggggaguggcaggucgagaucgugaacaaccacuuccccggcaaccggaacaaccccaucggcaacaacgaccucacgauccaccgccugagcggguaccuggcccggugggugcucgagcacuucaccgaggacgacgacgagucccagcgcgagcugauccggagcaccaucaucaacccgaucgccgaguccaacggcauccacuggaacaacgggcccgagaucuaccugagcuucuuccccggcaccgagauguuccucgaggucuucaaguucuacccccugacgaucgggaucuaccgcgugaagcacggcaugauggacccgcaguaccugaagaaggcgcuccggcagcgcuacggcacccugaccgccgagaaguggaugacccagaagacggugcugaucgccaagucccucaaggacgucgagcagcugaagugggggcggggcgggcugagcgacgccgcccgcaccuuccucaucaaguucggcgugaagcugcccuga

SEQ ID NO: 6812 - RNA, 708 nt, Artificial Sequence
  derived and/or modified CDS sequence (opt1) from INKV(SW AR 83-161)__U47138.1__N
augggcgaccugguguucuacgacgucgccagcaccggggccaacggcuucgaccccgacgcgggguucguggccuucauggccgaccacggcgaguccaucaaccucgccgccgugcgcaucuucuuccugaacgcggccaaggccaaggccgcgcuggcccggaagccggagcgcaaggccacccccaaguucggggaguggcaggucgagaucgugaacaaccacuuccccggcaaccggaacaaccccaucggcaacaacgaccucacgauccaccgccugagcggguaccuggcccggugggugcucgagcacuucaccgaggacgacgacgagucccagcgcgagcugauccggagcaccaucaucaacccgaucgccgaguccaacggcauccacuggaacaacgggcccgagaucuaccugagcuuccuccccggcaccgagauguuccuggaggucuucaaguucuacccccugacgaucgggaucuaccgcgugaagcacggcaugauggacccgcaguaccucaagaaggcgcugcggcagcgcuacggcacccugaccgccgagaaguggauggcccagaagaccgugcucaucgccaagucccugaaggacgucgagcagcugaagugggggcggggcgggcucagcgacgccgcgcgcacguuccugaucaaguucggcgugaagcugcccuga

SEQ ID NO: 6813 - RNA, 708 nt, Artificial Sequence
  derived and/or modified CDS sequence (opt1) from LUMV__X73468.1__N
augagcgaccugguguucuacgacgucgccuccaccggcgccaacggguucgaccccgacgcgggcuacguggacuucugcgugaagcacggggagagcaucaaccuccacuccguccgcaucuucuuccugaacgccgccaaggccaaggccgcgcuggcccggaagccggagcgcaaggccagccccaaguucggcgaguggcaggucgagaucgugaacaaccacuuccccgggaaccggaacaaccccaucgacaacaacgaccucaccauccaccgccuguccggcuaccuggcccggugggugcucgagcaguucaaggagaacgaggacgcggcccagcgcgagcugaucaagacgaccgugaucaacccgaucgccgagagcaacggcauccggugggacaacggggccgagaucuaccuggccuucuuccccggcaccgagauguuccucgagaccuucaacuucuacccccugacgaucgggaucuaccgcgugaagcacggcaugauggacccccaguaccugaagaaggcgcuccggcgccgguacgggucccugaccgccgacaaguggaugagccagaagaccgucgccaucgccaagucccugaaggacguggagcagcucaaguggggccgcggcgggcugagcgacaccgcccggguguuccugcagaaguucggcaucaagcucccguga

SEQ ID NO: 6814 - RNA, 708 nt, Artificial Sequence
  derived and/or modified CDS sequence (opt1) from LUMV(SAAr 1881)__KX817326.1__N
augagcgaccugguguucuacgacgucgccuccaccggcgccaacggguucgaccccgacgcgggcuacguggacuucugcgugaagcacggggagagcaucaaccuccacuccguccgcaucuucuuccugaacgccgccaaggccaaggccgcgcuggcccggaagccggagcgcaaggccagccccaaguucggcgaguggcaggucgagaucgugaacaaccacuuccccgggaaccggaacaaccccaucgacaacaacgaccucaccauccaccgccuguccggcuaccuggcccggugggugcucgagcaguucaaggagaacgaggacgcggcccagcgcgagcugaucaagacgaccgugaucaacccgaucgccgagagcaacggcauccggugggacaacggggccgagaucuaccuggccuucuuccccggcaccgagauguuccucgagaccuucaacuucuacccccugacgaucgggaucuaccgcgugaagcacggcaugauggacccccaguaccugaagaaggcgcuccggcagcgcuacgggucccugaccgccgacaaguggaugagccagaagaccgucgccaucgccaagucccugaaggacguggagcagcucaaguggggccggggcgggcugagcgacaccgcccgcguguuccugcagaaguucggcaucaagcucccguga

SEQ ID NO: 6815 - RNA, 708 nt, Artificial Sequence
  derived and/or modified CDS sequence (opt1) from MELV(TRVL 9375)__KX817329.1__N
augggcgaccugaucuucuacgacguggccagcaccggggccaacggcuucgaccccgacgcgggguaccucgccuucaccaucgcccacggcgaggccaucaaccuguccgccguccgcaucuucuuccugaacgcggccaaggccaaggccgcgcucagccggaagccggagcgcaaggccacgcccaaguucggggacuggcaggucgagaucgugaacaaccacuuccccggcaaccggaacaaccccaucggcaacaacgaccugaccauccaccgccuguccggguaccucgcccggugggugcuggaccuguucaaggagaacgaggacgagagccagaaggagcucauccaguccaccaucaucaacccgaucgccgagagcaacggcauccacugggccaacgggguggagaucuaccuguccuucuuccccggcaccgagauguuccuggaggcguuccgcuucuacccccucacgaucgggaucuaccgggugaagcacggccugauggacccccaguaccugaagaaggcccuccgccagcgguacggcacccugaccgccgacaaguggauggcccagaagaccacgaugaucgccaagagccugaaggacgucgagcagcucaagugggggaagggcgggcuguccgacgcggcccgcaccuuccugcagaaguucggcgugcggcucccguga

SEQ ID NO: 6816 - RNA, 708 nt, Artificial Sequence
  derived and/or modified CDS sequence (opt1) from MBV__U31989.1__N
augagcgaccugguguucuacgacgucgccuccaccggcgccaacggguucgaccccgacgcgggcuacguggacuucugcgccaagcacggggagagcaucaaccucgccgccgugcgcaucuucuuccugaacgccgcgaaggccaaggccgcccugucccggaagccggagcgcaaggcgaaccccaaguucggcgaguggcaggucgagaucgugaacaaccacuuccccgccaaccggaacaaccccaucgggaacaacgaccucaccauccaccgcaucagcggcuaccuggcccggugggugcuggagcaguaccgcgagaacgaggacgagucccagcgggagcucgucaagacgaccgugaucaacccgaucgccgagagcaacggcauccgcugggagaacgggcccgagaucuaccuggccuucuuccccggcaccgagauguuccuggagaccuucaaguucuacccccucacgaucgggaucuaccgggugaagcacggcaugauggacccgcaguaccugaagaaggcgcugcgccagcgguacgggucccucaccgccgagaaguggaugagccagaagaccggcaugaucgccaagucccugaaggaggucgagcagcugaaguggggccgcgggggccucagcgacaccgcccggacguuccugcagaaguucgggauccgccugcccuga

SEQ ID NO: 6817 - RNA, 708 nt, Artificial Sequence
  derived and/or modified CDS sequence (opt1) from SAV(VR723)__U47139.1__N
augagcgagcugguguucuacgacgucgccuccaccggcgccaacggguucgaccccgacgcgggcuaccucgccuucugcgugaagcacggggagagcaucucccugagcuccgugcgcaucuucuuccugaacgccgccaaggccaaggcggcccucagccggaagccggagcgcaaggccaaccccaaguucggcgaguggcaggucgagaucgugaacaaccacuuccccgggaaccggaacaaccccaucgacaaccuggaccugaccauccaccgccucuccggcuaccuggcccggugggugcuggagcaguucaucgagaacgaggacgagagccagcgcgagcucaucaagacgaccgucaucaacccgaucgcggaguccaacggcaucaagugggagaacggggccgagaucuaccugagcuucuuccccggcaccgagauguuccuggagaucuucaaguucuacccccucaccaucgggaucuaccgggugaagcagggcaugauggacccccaguaccugaagaaggcccugcgccagcgguacgggucccucacggccgacaaguggaugagccagaaggugggcgccaucgcgaagucccugaaggacaucgagcagcugaaguggggcaagggcgggcucagcgacaccgcccgcaccuuccugcagaaguucgggaucaagcugccguga

SEQ ID NO: 6818 - RNA, 708 nt, Artificial Sequence
  derived and/or modified CDS sequence (opt1) from SDNV(BeAr 103645)__U47140.1__N
augggcgaccugguguucuacgacgucgccagcaccggggccaacggcuucgaccccgacgcgggguucguggccuucauggccggccacggggaguccaucaaccucaccgccgugcgcaucuucuuccugaacgccgcgaaggccaaggccgcccugagccggaagccggagcgcaaggcgacgcccaaguucggcgacuggcaggucgagaucgugaacaaccacuuccccggcaaccggaacaaccccaucgggaacaacgaccucaccauccaccgcaucuccggcuaccuggcccgguggacccuggagcacuuccgcgagggcggggacgaggcccagaaggagcucauccggaccacgaucaucaacccgaucgccgagagcaacgggauccacugggccaacggcgcggagaucuaccuguccuucuuccccggcaccgagauguuccuggaggccuucaaguucuacccccucaccaucgggaucuaccgcgugaagcacggcaugauggacgcccaguaccugaagaaggcccugcggcagcgcuacgggacccucacggccgacgaguggauggcgcagaagaccguccugaucaccaagagccugaaggacguggagcagcucaaguggggccggggcgggcuguccgacgccgcccgcaccuuccugagcaaguucggcgugaagcuccccuga

SEQ ID NO: 6819 - RNA, 708 nt, Artificial Sequence
  derived and/or modified CDS sequence (opt1) from SDNV(BeAr 103645)__KX817335.1__N
augggcgaccugguguucuacgacgucgccagcaccggggccaacggcuucgaccccgacgcgggguucguggccuucauggccggccacggggaguccaucaaccucaccgccgugcgcaucuucuuccugaacgccgcgaaggccaaggccgcccugagccggaagccggagcgcaaggcgacgcccaaguucggcgacuggcaggucgagaucgugaacaaccacuuccccggcaaccggaacaaccccaucgggaacaacgaccucaccauccaccgcaucuccggcuaccuggcccgguggacccuggagcacuuccgcgagggggaggacgaggcccagaaggagcucauccggaccacgaucaucaacccgaucgccgagagcaacggcauccacugggccaacggggcggagaucuaccuguccuucuuccccggcaccgagauguuccuggaggccuucaaguucuacccccucaccaucggcaucuaccgcgugaagcacgggaugauggacgcccaguaccugaagaaggcccugcggcagcgcuacggcacccucacggccgacaaguggauggcgcagaagaccguccugaucaccaagagccugaaggacguggagcagcucaagugggggcggggcggccuguccgacgccgcccgcaccuuccugagcaaguucggggugaagcuccccuga

SEQ ID NO: 6820 - RNA, 708 nt, Artificial Sequence
  derived and/or modified CDS sequence (opt1) from SSHV__EU294510.1__N
augagcgaccugguguucuacgacgucgccuccaccggcgccaacggguucgaccccgacgcgggcuacauggccuucugcgugaaguacgccgagagcgugaaccucgccgccguccgcaucuucuuccugaacgcggccaaggccaaggccgcgcugucccggaagccggagcgcaaggccaaccccaaguucggggaguggcaggucgagguggugaacaaccacuuccccggcaaccggaacaaccccaucaacagcgacgaccucaccauccaccgccuguccggguaccuggcccggugggugcucgagcaguacaaggagaacgaggacgagagccgccgggagcugaucaagacgaccaucaucaacccgaucgccgaguccaacggcgugcgcugggacagcggcgccgagaucuaccuguccuucuuccccgggaccgagauguuccucgagaccuucaaguucuacccccugacgaucggcaucuaccgggucaagcaggggaugauggacccccaguaccugaagaaggcgcuccgccagcgguacggcagccugaccgccgacaaguggaugucccagaaggugaccgccaucgccaagagccugaaggagguggagcagcucaagugggggcgcggcggccuguccgacaccgcccggagcuuccugcagaaguucgggauccgccucccguga

SEQ ID NO: 6821 - RNA, 708 nt, Artificial Sequence
  derived and/or modified CDS sequence (opt1) from SSHV(F10838)__KM215563.1__N
augagcgaccugguguucuacgacgucgccuccaccggcgccaacggguucgaccccgacgcgggcuacauggccuucugcgugaaguacgccgagagcgugaaccucgccgccguccgcaucuucuuccugaacgcggccaaggccaaggccgcgcugucccggaagccggagcgcaaggccaaccccaaguucggggaguggcaggucgagguggugaacaaccacuuccccggcaaccggaacaaccccaucaacagcgacgaccucaccauccaccgccuguccggguaccuggcccggugggugcucgagcaguacaaggagaacgaggacgagagccgccgggagcugaucaagacgaccaucaucaacccgaucgccgaguccaacggcgugcgcugggacagcggcgccgagaucuaccuguccuucuuccccgggaccgagauguuccucgagaccuucaaguucuacccccugacgaucggcaucuaccgggucaagcaggggaugauggacccccaguaccugaagaaggcgcuccgccagcgguacggcagccugaccgccgacaaguggaugucccagaaggugaccgccaucgccaagagccugaaggagguggagcagcucaagugggggcgcggcggccuguccgacaccgcccggagccugcuccagaaguucgggauccgccugccguga

SEQ ID NO: 6822 - RNA, 708 nt, Artificial Sequence
  derived and/or modified CDS sequence (opt1) from SORV(SORV-252)__GU018050.2__N
augggcgaccugguguucuacgacgucgccagcaccggggccaacggcuucgaccccgacgcgggguucguggccuucauggccgaccacggcgaguccaucagccucuccgccgugcgcaucuucuuccugaacgccgcgaaggccaaggccgcccuggcgcggaagccggagcgcaaggccaaccccaaguucggggaguggcaggucgagaucgugaacaaccacuuccccggcaaccggaacaaccccaucggcaacaacgaccucaccauccaccgccugagcggguaccuggcccggugggugcucgagcacuucacggaggacgaggacgagucccagcgcgagcugauccggagcaccaucaucaacccgaucgccgaguccaacggcauccgcuggaacaacgggcccgagaucuaccugagcuucuuccccggcaccgagauguuccucgaggccuucaaguucuacccccugaccaucgggaucuaccgggucaagcacggccugauggacccgcaguaccucaagaaggcgcugcgccagcgguacggcacgcugaccgccgagaaguggauggcccagaagaccgugcucaucgccaagucccugaaggacguggagcagcugaagugggggcgcggcgggcucagcgacgccgcgcggaccuuccugaucaaguucggcgucaagcugcccuga

SEQ ID NO: 6823 - RNA, 708 nt, Artificial Sequence
  derived and/or modified CDS sequence (opt1) from SORV(NJO 94F)__U47141.1__N
augggcgaccugguguucuacgacgucgccagcaccggggccaacggcuucgaccccgacgcgggguucguggccuucauggccgaccacggcgaguccaucaaccucagcgccgugcgcaucuucuuccugaacgccgcgaaggccaaggccgcccuggcgcggaagccggagcgcaaggccaaccccaaguucggggaguggcaggucgagaucgugaacaaccacuuccccggcaaccggaacaaccccaucggcaacaacgaccucaccauccaccgccuguccggguaccuggcccggugggugcucgagcacuucacggaggacgaggacgagagccagcgcgagcugauccgguccaccaucaucaacccgaucgccgagagcaacggcauccacuggaacaacgggcccgagaucuaccuguccuucuuccccggcaccgagauguuccucgaggccuucaaguucuacccccugaccaucgggaucuaccgcgucaagcacggcaugauggacccgcaguaccugaagaaggcgcuccggcagcgcuacggcacgcugaccgccgagaaguggauggcccagaagaccgugcugaucgccaagagccucaaggacguggagcagcugaagugggggcggggcgggcuguccgacgccgcgcgcaccuuccucaucaaguucggcgucaagcugcccuga

SEQ ID NO: 6824 - RNA, 708 nt, Artificial Sequence
  derived and/or modified CDS sequence (opt1) from SORV(NJO-94F)__KX817338.1__N
augggcgaccugguguucuacgacgucgccagcaccggggccaacggcuucgaccccgacgcgggguucguggccuucauggccgaccacggcgaguccaucaaccucagcgccgugcgcaucuucuuccugaacgccgcgaaggccaaggccgcccuggcgcggaagccggagcgcaaggccaaccccaaguucggggaguggcaggucgagaucgugaacaaccacuuccccggcaaccggaacaaccccaucggcaacaacgaccucaccauccaccgccuguccggguaccuggcccggugggugcucgagcacuucacggaggacgaggacgagagccagcgcgagcugauccgguccaccaucaucaacccgaucgccgagagcaacggcauccacuggaacaacgggcccgagaucuaccuguccuucuuccccggcaccgagauguuccucgaggccuucaaguucuacccccugaccaucgggaucuaccgcgucaagcacggccugauggacccgcaguaccucaagaaggcgcugcggcagcgcuacggcacgcugaccgccgagaaguggauggcccagaagaccgugcucaucgccaagagccugaaggacguggagcagcugaagugggggcggggcgggcucuccgacgccgcgcgcaccuuccugaucaaguucggcgucaagcugcccuga

SEQ ID NO: 6825 - RNA, 708 nt, Artificial Sequence
  derived and/or modified CDS sequence (opt1) from TAHV__Z68497.1__N
augagcgaccugguguucuacgacgucgccuccaccggcgccaacggguucgaccccgacgcgggcuacguggacuucugcaucaagcacggggaggccaucaaccuccacagcgugcgcaucuucuuccugaacgccgccaaggccaaggcggcccuggcccggaagccggagcgcaaggccucccccaaguucggcgaguggcaggucgagguggugaacuaccacuuccccgggaaccggaacaaccccaucgacaacaacgaccucaccauccaccgccuguacggcuaccuggcgcgguggguccucgagcaguucaaggagaacgaggacgccgcccagcgcgagcugaucaagacgaccgugaucaacccgaucgccgagagcaacggcauccggugggacaacggggccgagaucuaccuggcguucuuccccggcaccgagauguuccucgagaccuucaacuucuacccccugacgaucgggaucuaccgcgugaagcagggcaugauggacccccaguaccugaagaaggcccuccggcagcgcuacgggucccugaccgccgacaaguggaugagccagaagaccaccgccaucgccaagucccugaaggacgucgagcagcucaaguggggccggggcgggcugagcgacacggcgcgcaccuuccugcagaaguucggcauccggcucccguga

SEQ ID NO: 6826 - RNA, 708 nt, Artificial Sequence
  derived and/or modified CDS sequence (opt1) from TAHV(22595-6)__HM036217.1__N
augagcgaccugguguucuacgacgucgccuccaccggcgccaacggguucgaccccgacgcgggcuacguggacuucugcaucaagcacggggaggccaucaaccuccacagcgugcgcaucuucuuccugaacgccgccaaggccaaggcggcccuggcccggaagccggagcgcaaggccucccccaaguucggcgaguggcaggucgagguggugaacaaccacuuccccgggaaccggaacaaccccaucgacaacaacgaccucaccauccaccgccugagcggcuaccuggcgcgguggguccucgagcaguucaaggagaacgaggacgccgcccagcgcgagcugaucaagacgaccgugaucaacccgaucgccgaguccaacggcauccggugggacaacggggccgagaucuaccuggcguucuuccccggcaccgagauguuccucgagaccuucaacuucuacccccugacgaucgggaucuaccgcgugaagcagggcaugauggacccccaguaccugaagaaggcccuccggcagcgcuacgggagccugaccgccgacaaguggaugucccagaagaccaccgccaucgccaagagccugaaggacgucgagcagcucaaguggggccggggcgggcuguccgacacggcgcgcaccuuccugcagaaguucggcauccggcucccguga

SEQ ID NO: 6827 - RNA, 708 nt, Artificial Sequence
  derived and/or modified CDS sequence (opt1) from TAHV(NM08003)__HQ541823.1__N
augagcgaccugguguucuacgacgucgccuccaccggcgccaacggguucgaccccgacgcgggcuacguggacuucugcaucaagcacggggaggccaucaaccuccacagcgugcgcaucuucuuccugaacgccgccaaggccaaggcggcccuggcccggaagccggagcgcaaggccucccccaaguucggcgaguggcaggucgagguggugaacaaccacuuccccgggaaccggaacaaccccaucgacaacaacgaccucaccauccaccgccugagcggcuaccuggcgcgguggguccucgagcaguucaaggagaacgacgacgccgcccagcgcgagcugaucaagacgaccgugaucaacccgaucgccgaguccaacggcauccggugggacaacggggccgagaucuaccuggcguucuuccccggcaccgagauguuccucgagaccuucaacuucuacccccugacgaucgggaucuaccgcgugaagcagggcaugauggacccccaguaccugaagaaggcccuccggcagcgcuacgggagccugaccgccgacaaguggaugucccagaagaccaccgccaucgccaagagccugaaggacgucgagcagcucaaguggggccggggcgggcuguccgacacggcgcgcaccuuccugcagaaguucggcauccggcucccguga

SEQ ID NO: 6828 - RNA, 708 nt, Artificial Sequence
  derived and/or modified CDS sequence (opt1) from TAHV(XJ0625)__EU622820.2__N
augagcgaccugguguucuacgacgucgccuccaccggcgccaacggguucgaccccgacgcgggcuacguggacuucugcgugaaguacggggaggccaucaaccuccacagcguccgcaucuucuuccugaacgccgccaaggccaaggcggcccuggcccggaagccggagcgcaaggccucccccaaguucggcgaguggcaggucgagguggugaacaaccacuuccccgggaaccggaacaaccccaucgacaacaacgaccucaccauccaccgccugagcggcuaccuggcgcggugggugcucgagcaguucaaggagaacgaggacgccgcccagcgcgagcugaucaagacgaccgugaucaacccgaucgccgaguccaacggcauccggugggacaacggggccgagaucuaccuggcguucuuccccggcaccgagauguuccucgagaccuucaacuucuacccccugacgaucgggaucuaccgcgucaagcagggcaugauggacccccaguaccugaagaaggcccuccggcagcgcuacgggccgcugaccgccgacaaguggaugagccagaagaccguggccaucgccaagucccugaaggacguggagcagcucaaguggggccggggcgggcugagcgacaccgcgcgcacguuccugcagaaguucggcauccggcuccccuga

SEQ ID NO: 6829 - RNA, 708 nt, Artificial Sequence
  derived and/or modified CDS sequence (opt1) from TAHV(XJ0708)__HM243139.1__N
augagcgaccugguguucuacgacgucgccuccaccggcgccaacggguucgaccccgacgcgggcuacguggacuucugcgccaaguacggggaggccaucaaccuccacagcgugcgcaucuucuuccugaacgccgccaaggcgaaggccgcccuggcccggaagccggagcgcaaggcgucccccaaguucggcgaguggcaggucgagguggugaacaaccacuuccccgggaaccggaacaaccccaucgacaacaacgaccucaccauccaccgccugagcggcuaccuggcccgguggguccucgagcaguucaaggagaacgaggacgccgcccagcgcgagcugaucaagacgaccgugaucaacccgaucgccgaguccaacggcauccggugggacaacggggcggagaucuaccuggccuucuuccccggcaccgagauguuccucgagaccuucaacuucuacccccugacgaucgggaucuaccgcgugaagcagggcaugauggacccccaguaccugaagaaggcccuccggcagcgcuacgggccgcugaccgccgacaaguggaugagccagaagaccgucgccaucgcgaagucccugaaggacguggagcagcucaaguggggccggggcgggcugagcgacaccgcccgcacguuccugcagaaguucggcauccggcuccccuga

SEQ ID NO: 6830 - RNA, 708 nt, Artificial Sequence
  derived and/or modified CDS sequence (opt1) from TVTV(AR42)__KX891323.1__N
augagcgagcugguguucuacgacgcccccuccaccggcgccaacggguucgacccggacgcgggcuacgucgccuucaucgccgcccacgccgggagcuacgaccucuccgcggugcgcaucuucuuccugaacgccgccaaggccaagaacgcgcugagccggaagcccgagggcaagguguccaucaaguucggggaguggagcgucgagguggugaacaaccacuuccccggcaaccgcaacaaccccaucggcaacaacgaccucaccauccaccggaucuccggguaccuggcccgcuggguccuggaggaguucaagggccaggacgacgaggcccagaaggacaucauccggagcacgaucgugaacccgaucgccgaguccaacgggauccacugggacagcggcgccgacgcguaccucuccuucuuccccgggaccgagauguuccuggagagcuucgacuuccugccccucgccaucggcaucuaccgcgugaagaacggcaugauggacguccaguaccugaagaaggcccugcggcagcgcuacgggaccaugaccgccgacaaguggauguccacgaagaccaccgugaucgccaagacccucaagcggguggagagcuucaaguggggcaagggcgggcuguccgaggcggcccgcgccuuccugagcaaguucaacgucaagauccccuga

SEQ ID NO: 6831 - RNA, 708 nt, Artificial Sequence
  derived and/or modified CDS sequence (opt1) from TVTV(ND3374)__KM215564.1__N
augagcgagcugguguucuacgacgcccccuccaccggcgccaacggguucgacccggacgcgggcuacgucgccuucaucgccgcccacgccgggagcuacgaccucuccgcggugcgcaucuucuuccugaacgccgccaaggccaagaacgcgcugagccggcgccccgagggcaagguguccaucaaguucggggaguggagcgucgagguggugaacaaccacuuccccggcaaccggaacaaccccaucggcaacaacgaccucaccauccaccgcaucuccggguaccuggcccgguggguccuggaggaguucaagggccaggacgacgaggcccagaaggacaucauccgcagcacgaucgugaacccgaucgccgaguccaacgggauccacugggacagcggcgccgacgcguaccucuccuucuuccccgggaccgagauguuccuggagagcuucgacuuccugccccucgccaucggcaucuaccgggugaagaacggcaugauggacguccaguaccugaagaaggcccugcgccagcgguacgggaccaugaccgccgacaaguggauguccacgaagaccaccgugaucgccaagacccucaagcgcguggagagcuucaaguggggcaagggcgggcuguccgaggcggcccgggccuuccugagcaaguucaacgucaagauccccuga

SEQ ID NO: 6832 - RNA, 708 nt, Artificial Sequence
  derived and/or modified CDS sequence (opt1) from JCV(3324-04)__HM007356.1__N
augggcgaccugguguucuacgacgucgccagcaccggggccaacggcuucgaccccgacgcgggguucguggccuucauggccgaccacggcgaguccgugagccucuccgccguccgcaucuucuuccugaacgccgcgaaggccaaggccgcccuggcgcggaagccggagcgcaaggccacccccaaguucggggaguggcaggucgagaucgugaacaaccacuuccccggcaaccggaacaaccccaucggcaacaacgaccucacgauccaccgccugagcggguaccuggcccggugggugcucgagcacuucaccaccgacgacgacgagucccagcgcgagcugauccggagcaccaucaucaacccgaucgccgaguccaacggcauccacuggaacaacgggcccgagaucuaccugagcuucuuccccggcacggagauguuccucgagaucuucaaguucuacccccugaccaucgggaucuaccgcgugaagcacggcaugauggacccgcaguaccugaagaaggcccuccggcagcgcuacggcacccugaccgcggagaaguggauggcccagaagacggugcugaucgccaagucccucaaggacgucgagcagcugaagugggggcggggcgggcugagcgacgccgcccgcaccuuccucaucaaguucggcgugaagcugcccuga

SEQ ID NO: 6833 - RNA, 708 nt, Artificial Sequence
  derived and/or modified CDS sequence (opt1) from JCV(61v2235)__U12796.1__N
augggcgaccugguguucuacgacgucgccagcaccggggccaacggcuucgaccccgacgcgggguucguggccuucauggccgaccacggcgaguccaucaaccucagcgccgugcgcaucuucuuccugaacgccgcgaaggccaaggccgcccuggcgcggaagccggagcgcaaggccacccccaaguucggggaguggcaggucgagaucgugaacaaccacuucuccggcaaccggaacaaccccaucggcaacaacgaccucacgauccaccgccugagcggguaccuggcccggugggugcucgagcacuucaacuccgacgacgacgagagccagcgcgagcugauccgguccaccaucaucaaccccaucgccgagagcaacggcauccacuggaacaacgggccggagaucuaccuguccuucuuccccggcaccgagauguuccucgagaucuucaaguucuacccccugaccaucgggaucuaccgcgucaagcacggcaugauggacccccaguaccugaagaaggcccuccggcagcgcuacggcacgcugaccgcggagaaguggauggcccagaagaccgugcugaucgccaagagccucaaggacguggagcagcugaagugggggcggggcgggcuguccgacgccgcccgcaccuuccucaucaaguucggcgucaagcugccguga

SEQ ID NO: 6834 - RNA, 708 nt, Artificial Sequence
  derived and/or modified CDS sequence (opt1) from JCV(1064-03)__EF681816.1__N
augggcgaccugguguucuacgacgucgccagcaccggggccaacggcuucgaccccgacgcgggguucguggccuucauggccgaccacggcgaggccaucaaccucgccgcggugcgcaucuucuuccugaacgccgccaaggccaaggcggcccuggcccggaagccggagcgcaaggccacccccaaguucggggaguggcaggucgagaucgugaacaaccacuuccccggcaaccggaacaaccccaucggcaacaacgaccucacgauccaccgccuguccggguaccuggcccggugggugcucgagcacuucaccgaggacgacgacgagagccagcgcgagcugauccgguccaccaucaucaacccgaucgcggagagcaacggcauccacuggaacaacgggcccgagaucuaccuguccuucuuccccggcaccgagauguuccucgaggucuucaaguucuacccccugacgaucgggaucuaccgcgugaagcacggcaugauggacccgcaguaccugaagaaggcccuccggcagcgcuacggcacccugaccgccgagaaguggauggcccagaagaccgugcugaucgccaagagccucaaggacgucgagcagcugaagugggggcggggcgggcuguccgacgcggcccgcacguuccucaucaaguucggcgugaagcugcccuga

SEQ ID NO: 6835 - RNA, 708 nt, Artificial Sequence
  derived and/or modified CDS sequence (opt1) from JCV(33909)__EF681853.1__N
augggcgaccugguguucuacgacgucgccagcaccggggccaacggcuucgaccccgacgcgggguucguggccuucauggccgaccacggcgaggugaucaaccucgccgccguccgcaucuucuuccugaacgcggccaaggccaaggccgcgcuggcccggaagccggagcgcaaggccacccccaaguucggggaguggcaggucgagaucgugaacaaccacuuccccggcaaccggaacaaccccaucggcaacaacgaccucacgauccaccgccuguccggguaccuggcccggugggugcucgagcacuucaccgaggacgacgacgagagccagcgcgagcugauccgguccaccaucaucaacccgaucgccgagagcaacggcauccacuggaacaacgggcccgagaucuaccuguccuucuuccccggcaccgagauguuccucgagguguucaaguucuacccccugacgaucgggaucuaccgcgugaagcacggcaugauggacccgcaguaccugaagaaggcgcuccggcagcgcuacggcacccugaccgccgagaaguggauggcccagaagaccguccugaucgccaagagccucaaggacguggagcagcugaagugggggcggggcgggcuguccgacgccgcgcgcacguuccucaucaaguucggcgugaagcugcccuga

SEQ ID NO: 6836 - RNA, 708 nt, Artificial Sequence
  derived and/or modified CDS sequence (opt1) from JCV(2179-00)__EF681808.1__N
augggcgaccugguguucuacgacgucgccagcaccggggccaacggcuucgaccccgacgcgggguucguggccuucauggccgaccacggcgaguccgugagccucuccgccguccgcaucuucuuccugaacgccgcgaaggccaaggccgcccuggcgcggaagccggagcgcaaggccacccccaaguucggggaguggcaggucgagaucgugaacaaccacuuccccggcaaccggaacaaccccaucggcaacaacgaccucacgauccaccgccugagcggguaccuggcccggugggugcucgagcacuucaccaccgacgacgacgagucccagcgcgagcugauccggagcaccaucaucaacccgaucgccgaguccaacggcauccacuggaacaacgggcccgagaucuaccugagcuucuuccccggcacggagauguuccucgagaucuucaaguucuacccccugaccaucgggaucuaccgcgugaagcacggcaugauggacccgcaguaccugaagaaggcccuccggcagcgcuacggcauccugaccgcggagaaguggauggcccagaagaccgugcugaucgccaagucccucaaggacgucgagcagcugaagugggggcggggcgggcugagcgacgccgcccgcacguuccucaucaaguucggcgugaagcugcccuga

SEQ ID NO: 6837 - RNA, 708 nt, Artificial Sequence
  derived and/or modified CDS sequence (opt1) from JCV(2989-06)__EF681849.1__N
augggcgaccugaucuucuacgacguggccagcaccggggccaacggcuucgaccccgacgcgggguucgucgccuucauggccgaccacggcgaguccgugagccucuccgccgugcgcaucuucuuccugaacgccgcgaaggccaaggccgcccuggcgcggaagccggagcgcaaggccacccccaaguucggggaguggcaggucgagaucgugaacaaccacuuccccggcaaccggaacaaccccaucggcaacaacgaccucacgauccaccgccugagcggguaccuggcccggugggugcucgagcacuucaccaccgacgacgacgagucccagcgcgagcugauccggagcaccaucaucaacccgaucgccgaguccaacggcauccacuggaacaacgggcccgagaucuaccugagcuucuuccccggcacggagauguuccucgagaucuucaaguucuacccccugaccaucgggaucuaccgcgucaagcacggcaugauggacccgcaguaccugaagaaggcccuccggcagcgcuacggcacccugaccgcggagaaguggauggcccagaagacggugcugaucgccaagucccucaaggacguggagcagcugaagugggggcggggcgggcugagcgacgccgcccgcaccuuccucaucaaguucggcgucaagcugcccuga

SEQ ID NO: 6838 - RNA, 708 nt, Artificial Sequence
  derived and/or modified CDS sequence (opt1) from JCV(5592-02)__EF681804.1__N
augggcgaccugguguucuacgacgucgccagcaccggggccaacggcuucgaccccgacgcgggguucguggccuucauggccgaccacggcgaguccgugagccucuccgccguccgcaucuucuuccugaacgccgcgaaggccaaggccgcccuggcgcggaagccggagcgcaaggccacccccaaguucggggaguggcaggucgagaucgugaacaaccacuuccccggcaaccggaacagccccaucggcaacaacgaccucacgauccaccgccuguccggguaccuggcccggugggugcucgagcacuucaccaccgacgacgacgagagccagcgcgagcugauccgguccaccaucaucaacccgaucgccgagagcaacggcauccacuggaacaacgggcccgagaucuaccuguccuucuuccccggcacggagauguuccucgagaucuucaaguucuacccccugaccaucgggaucuaccgcgugaagcacggcaugauggacccgcaguaccugaagaaggcccuccggcagcgcuacggcacccugaccgcggagaaguggauggcccagaagacggugcugaucgccaagagccucaaggacgucgagcagcugaagugggggcggggcgggcuguccgacgccgcccgcaccuuccucaucaaguucggcgugaagcugcccuga

SEQ ID NO: 6839 - RNA, 708 nt, Artificial Sequence
  derived and/or modified CDS sequence (opt1) from JCV(F5609)__KM215546.1__N
augggcgaccugguguucuacgacgucgccagcaccggggccaacggcuucgaccccgacgcgggguucguggccuucauggccgaccacggcgaguccgugagccucuccgccguccgcaucuucuuccugaacgccgcgaaggccaaggccgcccuggcgcggaagccggagcgcaaggccacccccaaguucggggaguggcaggucgagaucgugaacaaccacuuccccggcaaccggaacaaccccaucggcaacaacgaccucacgauccaccgccugagcggguaccuggcccggugggugcucgagcacuucaccaccgacgacgacgagucccagcgcgagcugauccggagcaccaucaucaacccgaucgccgaguccaacggcauccacuggaacaacgggcccgagaucuaccugagcuucuuccccggcacggagauguuccucgagaucuucaaguucuacccccugaccaucgggaucuaccgcgugaagcacggcaugauggacccgcaguaccugaagaaggcccuccggcagcgcuacggcacccugaccgcggagaaguggauggcccagaagacggugcugaucgccaagucccucaaggacgucgagcagcugaagugggggcggggcgggcugagcgacgccgcccgcaccuuccucaccaaguucggcgugaagcugcccuga

SEQ ID NO: 6840 - RNA, 708 nt, Artificial Sequence
  derived and/or modified CDS sequence (opt1) from JCV(F6577)__KM215557.1__N
augggcgaccugguguucuacgacgucgccagcaccggggccaacggcuucgaccccgacgcgggguucguggccuucauggccgaccacggcgaguccgugagccucuccgccguccgcaucuucuuccugaacgccgcgaaggccaaggccgcccugagccggaagccggagcgcaaggcgacccccaaguucggggaguggcaggucgagaucgugaacaaccacuuccccggcaaccggaacaaccccaucggcaacaacgaccucacgauccaccgccuguccggguaccuggcccggugggugcucgagcacuucaccaccgacgacgacgagagccagcgcgagcugauccgguccaccaucaucaacccgaucgccgagagcaacggcauccacuggaacaacgggcccgagaucuaccuguccuucuuccccggcacggagauguuccucgagaucuucaaguucuacccccugaccaucgggaucuaccgcgugaagcacggcaugauggacccgcaguaccugaagaaggcccuccggcagcgcuacggcacccugaccgccgagaaguggauggcgcagaagacggugcugaucgccaagagccucaaggacgucgagcagcugaagugggggcggggcgggcuguccgacgccgcccgcaccuuccucaucaaguucggcgugaagcugcccuga

SEQ ID NO: 6841 - RNA, 708 nt, Artificial Sequence
  derived and/or modified CDS sequence (opt1) from JCV(W13135)__KM215552.1__N
augggcgaccugguguucuacgacgucgccagcaccggggccaacggcuucgaccccgacgcgggguucguggccuucauggccgaccacggcgaguccgugaaccucagcgccguccgcaucuucuuccugaacgccgcgaaggccaaggccgcccuggcgcggaagccggagcgcaaggccacccccaaguucggggaguggcaggucgagaucgugaacaaccacuuccccggcaaccggaacaaccccaucggcaacaacgaccucacgauccaccgccuguccggguaccuggcccggugggugcucgagcacuucaccaccgacgacgacgagagccagcgcgagcugauccgguccaccaucaucaacccgaucgccgagagcaacggcauccacuggaacaacgggcccgagaucuaccuguccuucuuccccggcacggagauguuccucgagaucuucaaguucuacccccugaccaucgggaucuaccgcgugaagcacggcaugauggacccgcaguaccugaagaaggcccuccggcagcgcuacggcacccugaccgcggagaaguggauggcccagaagacggugcugaucgccaagagccucaaggacgucgagcagcugaagugggggcggggcgggcuguccgacgccgcccgcaccuuccucaucaaguucggcgugaagcugcccuga

SEQ ID NO: 6842 - RNA, 708 nt, Artificial Sequence
  derived and/or modified CDS sequence (opt1) from JCV(W18393)__KM215559.1__N
augggcgaccugguguucuacgacgucgccagcaccggggccaacggcuucgaccccgacgcgggguucguggccuucauggccgaccacggcgaguccaucaaccucagcgccgugcgcaucuucuuccugaacgccgcgaaggccaaggccgcccuggcgcggaagccggagcgcaaggccacccccaaguucggggaguggcaggucgagaucaucaacaaccacuuccccggcaaccggaacaaccccaucggcaacaacgaccucacgauccaccgccuguccggguaccuggcccggugggugcucgagcacuucaccgccgacgacgacgagagccagcgcgagcugauccgguccaccaucaucaacccgaucgccgagagcaacggcauccacuggaacaacgggcccgagaucuaccuguccuucuuccccggcaccgagauguuccucgagaucuucaaguucuacccccugacgaucgggaucuaccgcgugaagcacggcaugauggacccgcaguaccugaagaaggcgcuccggcagcgcuacggcacccugaccgccgagaaguggauggcccagaagaccguccugaucgccaagagccucaaggacguggagcagcugaagugggggcggggcgggcuguccgacgccgcgcgcacguuccucaucaaguucggcgugaagcugcccuga

SEQ ID NO: 6843 - RNA, 708 nt, Artificial Sequence
  derived and/or modified CDS sequence (opt1) from KEYV(KEYV/Ochlerotatus atlanticus/USA/KEYVLK01/2005)__KT630290.1__N
augggcgaccugguguucuacgacgucgccagcaccggggccaacggcuucgaccccgacgcgggguacguggccuucauggccaaccacggcgaguccaucagccucuccaccgugcgcaucuucuuccugaacgccgccaaggcgaaggccgcccugacgcggaagccggagcgcaaggccacccccaaguucggggaguggcaggucgagaucgugaacaaccacuuccccggcaaccggaacaaccccaucggcaacaacgaccucacccugcaccgcaucagcggguaccuggcgcggugggugcucgagcacuucggcgagggggaggacgagucccagaaggagcugaucaagagcaccgucaucaacccgaucgccgaguccaacggcauccgcugggggaacggcguggagaucuaccugagcuucuuccccggcacggagauguuccucgagcuguucaaguucuacccccugaccaucgggaucuaccgggugaagcacggcaugauggacgcccaguaccucaagaaggcccugcgccagcgguacgggacccugaccgccgacaaguggauggcgcagaagacguccaugaucaccaagagccucaaggacgucgagcagcugaaguggggcaagggcgggcuguccgacaccgcccgcgccuuccucgccaaguucggcgugcggcugcccuga

SEQ ID NO: 6844 - RNA, 708 nt, Artificial Sequence
  derived and/or modified CDS sequence (opt1) from KEYV(KEYV/Ochlerotatus atlanticus/USA/KEYVLK02/2005)__KT630293.1__N
augggcgaccugguguucuacgacgucgccagcaccggggccaacggcuucgaccccgacgcgggguacguggccuucauggccaaccacggcgaguccaucagccucuccaccgugcgcaucuucuuccugaacgccgccaaggcgaaggccgcccugacgcgcaagagcgagcggaaggccaccccgaaguucggggaguggcaggucgagaucgugaacaaccacuuccccggcaaccggaacaaccccaucggcaacaacgaccucacccugcaccgcaucuccggguaccuggcgcggugggugcucgagcacuucggcgagggggaggacgagagccagaaggagcugaucaaguccaccgucaucaaccccaucgccgagagcaacggcauccgcugggggaacggcguggagaucuaccuguccuucuucccgggcacggagauguuccucgagcuguucaaguucuacccccugaccaucgggaucuaccgggugaagcacggcaugauggacgcccaguaccucaagaaggcccugcgccagcgguacgggacccugaccgccgacaaguggauggcgcagaagacgagcaugaucaccaagucccucaaggacgucgagcagcugaaguggggcaagggcgggcugagcgacaccgcccgcgccuuccucgccaaguucggcgugcggcugcccuga

SEQ ID NO: 6845 - RNA, 708 nt, Artificial Sequence; identical to SEQ ID NO: 6843
  derived and/or modified CDS sequence (opt1) from KEYV(C14031-33)__U12801.1__N

SEQ ID NO: 6846 - RNA, 708 nt, Artificial Sequence
  derived and/or modified CDS sequence (opt1) from LACV(Human/78)__NC_004110.1__N
augagcgaccugguguucuacgacgucgccuccaccggcgccaacggguucgaccccgacgcgggcuacauggacuucugcgugaagaacgccgagcuccugaaccuggccgccgugcgcaucuucuuccucaacgccgcgaaggccaaggccgcccugagccggaagccggagcgcaaggcgaaccccaaguucggggaguggcaggucgaggugaucaacaaccacuuccccggcaaccggaacaaccccaucgggaacaacgaccugaccauccaccgccucuccggcuaccuggcccggugggugcuggaccaguacaacgagaacgacgacgagagccagcacgagcucauccgcacgaccaucaucaacccgaucgccgaguccaacggcgucgggugggacagcggccccgagaucuaccuguccuucuuccccgggaccgagauguuccuggagaccuucaaguucuacccccucacgaucggcauccaccgggugaagcaggggaugauggacccgcaguaccugaagaaggcccugcgccagcgguacggcacccucaccgccgacaaguggaugagccagaagguggcggccaucgccaagucccugaaggacgucgagcagcugaaguggggcaagggcgggcucagcgacaccgccaagacguuccugcagaaguucgggauccgccugcccuga

SEQ ID NO: 6847 - RNA, 708 nt, Artificial Sequence
  derived and/or modified CDS sequence (opt1) from LACV__KP271107.1__N
augagcgaccugguguucuacgacgucgccuccaccggcgccaacggguucgaccccgacaccggcuacauggacuucugcgugaagaacgcggagagccucaaccuggccgccgugcgcaucuucuuccugaacgccgccaaggcgaaggccgcccucucccggaagccggagcgcaaggccaaccccaaguucggggaguggcaggucgaggugaucaacaaccacuuccccggcaaccggaacaaccccaucgggaacaacgaccugacgauccaccgccugagcggcuaccucgcgcggugggugcuggaccaguacaacgagaacgacgacgagucccagcacgagcugauccgcaccaccaucaucaacccgaucgccgagagcaacggcgucgggugggacuccggccccgagaucuaccucagcuucuuccccgggaccgagauguuccuggagacguucaaguucuacccccugaccaucggcauccaccgggugaagcaggggaugauggacccgcaguaccucaagaaggcccugcgccagcgguacggcacccugaccgccgacaaguggaugucccagaagguggccgcgaucgccaagagccucaaggacgucgagcagcugaaguggggcaagggcgggcuguccgacacggccaagaccuuccuccagaaguucgggauccgccugcccuga

SEQ ID NO: 6848 - RNA, 708 nt, Artificial Sequence
  derived and/or modified CDS sequence (opt1) from LACV(BEN2_Lafayette_WI_2007)__GU596386.1__N
augagcgaccugguguucuacgacgucgccuccaccggcgccaacggguucgaccccgacgcgggcuacauggacuucugcgugaagaacgccgagagccucaaccuggccgccgugcgcaucuucuuccugaacgccgcgaaggccaaggccgcccucucccggaagccggagcgcaaggcgaaccccaaguucggggaguggcaggucgaggugaucaacaaccacuuccccggcaaccggaacaaccccaucgggaacaacgaccugaccauccaccgccugagcggcuaccucgcccggugggugcuggaccaguacaacgagaacgacgacgagucccagcacgagcugauccgcacgaccaucaucaacccgaucgccgagagcaacggcgucgggugggacuccggccccgagaucuaccucagcuucuuccccgggaccgagauguuccuggagaccuucaaguucuacccccugacgaucggcauccaccgggugaagcaggggaugauggacccgcaguaccucaagaaggcccugcgccagcgguacggcacccugaccgccgacaaguggaugucccagaagguggcggccaucgccaagagccucaaggacgucgagcagcugaaguggggcaagggcgggcuguccgacaccgccaagacguuccuccagaaguucgggauccgccugcccuga

SEQ ID NO: 6849 - RNA, 708 nt, Artificial Sequence
  derived and/or modified CDS sequence (opt1) from LACV(Dallas/TX/2009)__GU591164.1__N
augagcgaccugguguucuacgacgucgccuccaccggcgccaacggguucgaccccgacgcgggcuacauggacuucugcgugaagaacgccgagagccucaaccuggccgccgugcgcaucuucuuccugaacgccgcgaaggccaaggccgcccucucccggaagccggagcgcaaggcgaaccccaaguucggggaguggcaggucgagguggugaacaaccacuuccccggcaaccggaacaaccccaucgggaacaacgaccugaccauccaccgccugagcggcuaccucgcccgguggguccuggaccaguacaacgagaacgacgacgagucccagcgcgagcugauccggacgaccaucaucaacccgaucgccgagagcaacggcgugcgcugggacuccgggcccgagaucuaccucagcuucuuccccggcaccgagauguuccuggagaccuucaaguucuacccccugacgaucgggauccaccgggugaagcagggcaugauggacccgcaguaccucaagaaggcccugcgccagcgguacgggacccugaccgccgacaaguggaugucccagaaggucgcggccaucgccaagagccucaaggacguggagcagcugaaguggggcaagggcgggcuguccgacaccgccaagacguuccuccagaaguucggcauccgccugcccuga

SEQ ID NO: 6850 - RNA, 708 nt, Artificial Sequence
  derived and/or modified CDS sequence (opt1) from LACV(Fort Bend County/TX/2009)__GU591167.1__N
augagcgaccugguguucuacgacgucgccuccaccggcgccaacggguucgaccccgacgcgggcuacauggacuucugcgugaagaacgccgagagccucaaccuggccgccgugcgcaucuucuuccugaacgccgcgaaggccaaggccgcccucucccggaagccggagcgcaaggcgaaccccaaguucggggaguggcaggucgaggugaucaacaaccacuuccccggcaaccggaacaaccccaucgggaacaacgaccugaccauccaccgccugagcggcuaccucgcccggugggugcuggaccaguacaacgagaacgacgacgagucccagcgcgagcugauccggacgaccaucaucaacccgaucgccgagagcaacggcguccgcugggacuccgggcccgagaucuaccucagcuucuuccccggcaccgagauguuccuggagaccuucaaguucuacccccugacgaucgggauccaccgggugaagcagggcaugauggacccgcaguaccucaagaaggcccugcgccagcgguacgggacccugaccgccgacaaguggaugucccagaagguggcggccaucgccaagagccucaaggacgucgagcagcugaaguggggcaagggcgggcuguccgacaccgccaagacguuccuccagaaguucggcauccgccugcccuga

SEQ ID NO: 6851 - RNA, 708 nt, Artificial Sequence
  derived and/or modified CDS sequence (opt1) from LACV(LACV/95/OH-H (CCH-MB96))__GU206135.1__N
augagcgaccugguguucuacgacgucgccuccaccggcgccaacggguucgaccccgacgcgggcuacauggacuucugcgugaagaacgccgagagccucaaccuggccgccgugcgcaucuucuuccugaacgccgcgaaggccaaggccgcccucucccggaagccggagcgcaaggcgaaccccaaguucggggaguggcaggucgagguggugaacaaccacuuccccggcaaccggaacaaccccaucgggaacaacgaccugaccauccaccgccugagcggcuaccucgcccgguggguccuggaccaguacaacgagaacgacgacgagucccagcacgagcugaucaagacgaccaucaucaacccgaucgccgagagcaacggcguggggugggacuccggccccgagaucuaccucagcuucuuccccgggaccgagauguuccuggagaccuucaaguucuacccccugacgaucggcauccaccgcgugaagcaggggaugauggacccgcaguaccucaagaaggcccugcggcagcgcuacggcacccugaccgccgacaaguggaugucccagaaggucgcggccaucgccaagagccucaaggacguggagcagcugaaguggggcaagggcgggcuguccgacaccgccaagacguuccuccagaaguucgggauccggcugcccuga

SEQ ID NO: 6852 - RNA, 696 nt, Artificial Sequence
  derived and/or modified CDS sequence (opt1) from OROV(BeAn19991)__NC_005777.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaaggacgggauggacgugaacuucaugaagaaggugcuccgccagcgguacggccagaagaccgcggagcaguggaugcgcgaggagaucgucgccgugcgggccgccuucgaggccguggggacccuggcgugggcccgcaccggcuucagcccggccgcccgggacuuccugcgccaguucggcaucgacaucuga

SEQ ID NO: 6853 - RNA, 696 nt, Artificial Sequence
  derived and/or modified CDS sequence (opt1) from OROV(AR136921)__HQ830443.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaaggacgggauggacgugaacuucaugaagaaggugcuccgccagcgguacggccagaagaccgcggagcaguggaugcgcgaggagaucgucgccgugcgggccgccuucgaggccguggggacccuggcgugggcccgcaccggcuucagcccggccgcccgggacuuccugcgccaguucggcaucgggaucuga

SEQ ID NO: 6854 - RNA, 696 nt, Artificial Sequence
  derived and/or modified CDS sequence (opt1) from OROV(AR366927)__HQ830448.1__N
augagcgaguucuucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaaggacgggauggacgugaacuucaugaagaaggugcuccgccagaaguacggccagaagaccgcggagcaguggaugcgggaggagaucgucgccgugcgcgccgccuucgaggccguggggacccuggcgugggcccggaccggcuucagcccggccgcccgcgacuuccugcggcaguucggcaucgggaucuga

SEQ ID NO: 6855 - RNA, 696 nt, Artificial Sequence
  derived and/or modified CDS sequence (opt1) from OROV(BeAn 206119)__AY993909.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcgccgcggugguggucccccugguggaggugaagggcugcaccuggaacgacggcgacgccauguaccugggguucgccgccggcgccgagauguuccuccagaccuucaccuucuucccccuggucaucgagaugcaccgggugcugaaggacgggauggacgugaacuucaugaagaagguccuccgccagcgguacggccagaagacggcggagcaguggaugcgcgaggagaucguggccgugcgggccgccuucgagaccgucgggaccuucgccugggcgcgcaccggcuucagcccggccgcccgggacuuccugcgccaguucggcaucgggaucuga

SEQ ID NO: 6856 - RNA, 696 nt, Artificial Sequence
  derived and/or modified CDS sequence (opt1) from OROV(BeAn 208819)__AY993911.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcgccaccgugguggucccccugguggaggugaagggcugcaccuggaacgacggcgacgcgauguaccugggguucgccgccggcgccgagauguuccuccagaccuucacguucuucccccuggucaucgagaugcaccgggugcugaaggacgggauggacgugaacuucaugaagaagguccuccgccagcgguacggccagaagaccgccgagcaguggaugcgcgaggagaucguggcggugcgggccgccuucgaggccgucgggacccuggccugggcgcgcaccggcuucagcccggccgcccgggacuuccugcgccaguucggcaucgggaucuga

SEQ ID NO: 6857 - RNA, 696 nt, Artificial Sequence
  derived and/or modified CDS sequence (opt1) from OROV(BeAn 208823)__AY993912.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcgccaccgugguggucccccugguggaggugaagggcugcaccuggaacgacggcgacgcgauguaccugggguucgccgccggcgccgagauguuccuccagaccuucacguucuucccccuggucaucgagaugcaccgggugcugaaggacgggauggacgugaacuucaugaagaagguccuccgccagcgguacggccagaagaccgccgagcgcuggaugcgggaggagaucguggcggugcgcgccgccuucgaggccgucgggacccuggccugggcgcggaccggcuucagcccggccgcccgcgacuuccugcggcaguucggcaucgggaucuga

SEQ ID NO: 6858 - RNA, 696 nt, Artificial Sequence
  derived and/or modified CDS sequence (opt1) from OROV(H244576)__HQ830444.1__N
augagcgaguucuucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucaccuuccaccggcugagcggguaccuggcgcgcugggccuucacgcagaugcggucccccaucaagcaggccgaguuccgcgccaccgugguggucccccucgcggaggugaagggcugcaccuggaacgacggcgacgccauguaccugggguucgccgccggcgccgagauguuccugcagaccuucacguucuucccccucgugaucgagaugcaccggguccugaaggacgggauggacgugaacuucaugaagaaggugcugcgccagaaguacggccagaagaccgcggagcaguggaugcgggaggagaucgucgccgugcgcgccgccuucgaggccguggggacccucgcgugggcccggaccggcuucagcccggccgcccgcgacuuccugcggcaguucggcaucgggaucuga

SEQ ID NO: 6859 - RNA, 696 nt, Artificial Sequence
  derived and/or modified CDS sequence (opt1) from OROV(H355186)__HQ830446.1__N
augagcgaguucaucuucuccgacgugccccagcgcaccaccagcacguucgacccggaggccgccuacgucgcguucgaggcccgguacggccaggugcugaacgccggggugguccgcguguucuuccucaaccagaagaaggccaaggacgugcugcggaagaccucccgccccauggucgaccugaccuucggcggggugcaguucgccauggugaacaaccacuucccccaguuccagagcaaccccgucccggacaacggccucacccugcaccggcuguccggguaccucgcgcgcugggccuucacgcagaugcggagccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaaggacgggauggacgugaacuucaugaagaaggugcuccgccagcgguacggccagaagaccgcggagcaguggaugcgcgaggagaucgucgccgugcgggccgccuucgaggccguggggacccuggcgugggcccgcaccggcuucuccccggccgcccgggacuuccugcgccaguucggcaucgggaucuga

SEQ ID NO: 6860 - RNA, 696 nt, Artificial Sequence
  derived and/or modified CDS sequence (opt1) from OROV(H356898)__HQ830447.1__N
augagcgaguucaucuucaacgacgugccccagcgcaccaccuccacguucgacccggaggccgccuacgucagcuucgaggcgcgguacggccaggugcugaacgccggggugguccgcguguucuuccucaaccagaagaaggccaaggacgugcugcggaagaccucccgccccauggucgaccugaccuucggcggggugcaguucgccauggugaacaaccacuucccccaguuccagagcaaccccgucccggacaacggccucacccugcaccggcuguccggguaccucgcccgcugggcguucacgcagaugcggagccccaucaagcaggccgaguuccgcgccaccgugguggucccccuggccgaggugaagggcugcaccuggaacgacggcgacgcgauguaccugggguucgccgccggcgccgagauguuccuccagaccuucacguucuucccccuggugaucgagaugcaccggguccugaaggacgggauggacgugaacuucaugaagaaggugcuccgccagcgguacggccagaagaccgccgagcaguggaugcgcgaggagaucgucgcggugcgggccgccuucgaggccguggggacccuggccugggcgcgcaccggcuucuccccggccgcccgggacuuccugcgccaguucggcaucgggaucuga

SEQ ID NO: 6861 - RNA, 696 nt, Artificial Sequence
  derived and/or modified CDS sequence (opt1) from OROV(H389865)__HQ830453.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcacaugcggucccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaaggacgggauggacgugaacuucaugaagaaguuccuccgccagcgguacggccagaagaccgcggagcaguggaugcgcgaggagauccuggccgugaaggccgccuucgagagcgucgggacccuggccugggcgcggaccggcuucuccccggccgcccgcgacuuccuccggcaguucgccaucggcaucuga

SEQ ID NO: 6862 - RNA, 696 nt, Artificial Sequence
  derived and/or modified CDS sequence (opt1) from OROV(H472433)__HQ830455.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucuccggcgugcaguucgccauggugaacaaccacuucccccaguuccagagcaaccccgucccggacaacgggcucacccugcaccggcuguccggcuaccucgcgcgcugggccuucacgcagaugcggagccccaucaagcaggccgaguuccgcgccaccgugguggucccccuggcggaggugaaggggugcaccuggaacgacggcgacgccauguaccugggcuucgccgccggggccgagauguuccuccagaccuucacguucuucccccuggugaucgagaugcaccggguccugaaggacggcauggacgugaacuucaugaagaaggugcuccgccagcgguacgggcagaagaccgcggagcaguggaugcgcgaggagaucgucgccgugcgggccgccuucgaggccgugggcacccuggcgugggcccgcaccggguucuccccggccgcccgggacuuccugcgccaguucggcaucggcaucuga

SEQ ID NO: 6863 - RNA, 696 nt, Artificial Sequence
  derived and/or modified CDS sequence (opt1) from OROV(H532490)__HQ830463.1__N
augagcgaguucaucuucaacgacgugccccagcgcaccaccuccacguucgacccggaggccgccuacgucagcuucgaggcgcgguacggccaggugcugaacgccggggugguccgcguguucuuccucaaccagaagaaggccaaggacgugcugcggaagaccuccagccccauggucgaccugaccuucggcggggugcaguucgccauggugaacaaccacuucccccaguuccaguccaaccccgucccggacaacggccucacccugcaccgccugagcggguaccucgcccggugggcguucacgcagaugcgcucccccaucaagcaggccgaguuccgggccaccgugguggucccccuggccgaggugaagggcugcaccuggaacgacggcgacgcgauguaccugggguucgccgccggcgccgagauguuccuccagaccuucacguucuucccccuggugaucgagaugcaccgcguccugaaggacgggauggacgugaacuucaugaagaaggugcuccggcagcgcuacggccagaagaccgccgagcaguggaugcgggaggagaucgucgcggugcgcgccgccuucgaggccguggggacccuggccugggcgcggaccggcuucagcccggccgcccgcgacuuccugcggcaguucggcaucgggaucuga

SEQ ID NO: 6864 - RNA, 696 nt, Artificial Sequence
  derived and/or modified CDS sequence (opt1) from OROV(H543629)__HQ830467.1__N
augagcgaguuccuguucaacgacgugccccagcgcaccaccuccacguucgacccggaggccgccuacgucgcguucgaggcccgguacggccaggugcucaacgccggggugguccgcguguucuuccugaaccagaagaaggccaaggacgugcugcggaagaccagccgccccauggucgaccucaccuucggcggggugcaguucgccauggugaacaaccacuucccccaguuccaguccaaccccgucccggacaacggccugacccugcaccggcucagcggguaccuggcgcgcugggccuucacgcagaugcggucccccaucaagcaggccgaguuccgcgccaccgugguggucccccuggcggaggugaagggcugcaccuggaacgacggcgacgccauguaccucggguucgccgccggcgccgagauguuccugcagaccuucacguucuucccccuggugaucgagaugcaccggguccucaaggacgggauggacgugaacuucaugaagaaggugcugcgccagcgguacggccagaagaccgcggagcaguggaugcgcgaggagaucgucgccgugcgggccgccuucgaggccguggggacccuggcgugggcccgcaccggcuucagcccggccggccgggacuuccuccgccaguucgggaucggcaucuga

SEQ ID NO: 6865 - RNA, 696 nt, Artificial Sequence
  derived and/or modified CDS sequence (opt1) from OROV(H543638)__HQ830468.1__N
augagcgaguuccuguucaacgacgugccccagcgcaccaccuccacguucgacccggaggccgccuacgucgcguucgaggcccgguacggccaggugcucaacgccggggugguccgcguguucuuccugaaccagaagaaggccaagaacgugcugcggaagaccagccgccccauggucgaccucaccuucggcggggugcaguucgccauggugaacaaccacuucccccaguuccaguccaaccccgucccggacaacggccugacccugcaccggcucagcggguaccuggcgcgcugggccuucacgcagaugcggucccccaucaagcaggccgaguuccgcgccaccgugguggucccccuggcggaggugaagggcugcaccuggaacgacggcgacgccauguaccucggguucgccgccggcgccgagauguuccugcagaccuucacguucuucccccuggugaucgagaugcaccggguccucaaggacgggauggacgugaacuucaugaagaaggugcugcgccagcgguacggccagaagaccgcggagcaguggaugcgcgaggagaucgucgccgugcgggccgccuucgaggccguggggacccuggcgugggcccgcaccggcuucagcccggccggccgggacuuccuccgccaguucgggaucggcaucuga

SEQ ID NO: 6866 - RNA, 696 nt, Artificial Sequence
  derived and/or modified CDS sequence (opt1) from OROV(H706890)__HQ830473.1__N
auggccgaguucaucuucaacgacgugccccagcgcaccaccagcacguucgacccggaggccgcguacgucgccuucgaggcccgguacggccaggugcugaacgccggggugguccgcguguucuuccucaaccagaagaaggccaaggacgugcugcggaagaccucccgccccauggucgaccugaccuucggcggggugcaguucgcgauggugaacaaccacuucccccaguuccagagcaaccccgucccggacaacggccucacccugcaccggcuguccggguaccucgcccgcugggccuucacgcagaugcggagccccaucaagcaggccgaguuccgcgcgaccgugguggucccccuggccgaggugaagggcugcaccuggaacgacggcgacgccauguaccugggguucgccgccggcgcggagauguuccuccagaccuucacguucuucccccuggugaucgagaugcaccggguccugaaggacgggauggacgugaacuucaugaagaaggugcuccgccagcgguacggccagaagaccgccgagcaguggaugcgcgaggagaucgucgccgugcgggccgccuucgaggcgguggggacccuggccugggcccgcaccggcuucuccccggccgcccgggacuuccugcgccaguucggcaucgggaucuga

SEQ ID NO: 6867 - RNA, 696 nt, Artificial Sequence
  derived and/or modified CDS sequence (opt1) from OROV(H758669)__HQ830479.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauccucaacaaccacuucccccaguuccaguccaaccccgugccggacaacggccugacccugcaccggcucagcggguaccuggcgcgcugggccuucacgcagaugcggucccccaucaagcaggccgaguuccgcgccaccgucguggugccccuggcggaggucaagggcugcaccuggaacgacggcgacgccauguaccucggguucgccgccggcgccgagauguuccugcagaccuucacguucuucccccuggugaucgagaugcaccgggugcucaaggacgggauggacgucaacuucaugaagaaggugcugcgccagcgguacggccagaagaccgcggagcaguggaugcgcgaggagaucguggccguccgggccgccuucgaggccguggggacccuggcgugggcccgcaccggcuucagcccggccgcccgggacuuccuccgccaguucggcaucgggaucuga

SEQ ID NO: 6868 - RNA, 696 nt, Artificial Sequence
  derived and/or modified CDS sequence (opt1) from OROV(H758687)__HQ830478.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcgccaccgugguggucccccuggcggaggugaagggcugcaccuggaacgacggcgacgccauguaccugggguucgccgccggcgccgagauguuccuccagaccuucacguucuuccccuucgugaucgagaugcaccggguccugaaggacgggauggacgugaacuucaugaagaaggugcugcgccagcgguacggccagaagaccgcggagcaguggaugcgcgaggagaucgucgccgugcgggccgccuucgaggccguggggacccucgcgugggcccgcaccggcuucagcccggccgcccgggacuuccugcgccaguucggcaucgggaucuga

SEQ ID NO: 6869 - RNA, 696 nt, Artificial Sequence
  derived and/or modified CDS sequence (opt1) from OROV(H759041)__HQ830488.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaacgacgggauggacgugaacuucaugaagaaggugcuccgccagcgguacggccagaagaccgcggagcaguggaugcgcgaggagaucgucgccgugcgggccgccuucgaggccguggggacccuggcgugggcccgcaccggcuucagcccggccgcccgggacuuccugcgccaguucggcaucgggaucuga

SEQ ID NO: 6870 - RNA, 696 nt, Artificial Sequence
  derived and/or modified CDS sequence (opt1) from OROV(BeAr473358)__AF164539.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcacaugcggucccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaaggacgggauggacgugaacuucaugaagaagauccuccgccagcgguacggccagaagaccgcggagcaguggaugcgcgaggagaucaucgccgugaagaccgccuucgagaccgucgggacgcuggccugggccaucaccggcuucagcccggcggcccggaacuuccugcgccaguucgagaucgacaucuga

SEQ ID NO: 6871 - RNA, 696 nt, Artificial Sequence
  derived and/or modified CDS sequence (opt1) from OROV(BeH 521086)__AY704559.1__N
augagcgaguuccuguucaacgacgugccccagcgcaccaccuccacguucgacccggaggccgccuacgucgcguucgagagccgguacggccaggugcucaacgccggggugguccgcguguucuuccugaaccagaagaaggccaaggacgugcugcggaagaccucccgccccauggucgaccucaccuucggcggggugcaguucaccauggugaacaaccacuucccccaguuccagagcaaccccgucccggacaacggccugacgcugcaccggcucuccggguaccuggcccgcugggccuucacccagaugcggagccccaucaagcaggcggaguuccgcgccaccgugguggucccccuggccgaggugaagggcugcaccuggaacgacggcgacgccauguaccucggguucgcggccggcgccgagauguuccugcagacguucaccuucuucccccuggugaucgagaugcaccggguccucaaggacgggauggacgugaacuucaugaagaaggugcugcgccagcgguacggccagaagaccgccgagcaguggaugcgcgaggagaucgucgccgugcgggcggccuucgaggccguggggacccuggccugggcccgcacgggcuucuccccggcggcccgggacuuccuccgccagagcggcaucgggaucuga

SEQ ID NO: 6872 - RNA, 696 nt, Artificial Sequence
  derived and/or modified CDS sequence (opt1) from OROV(BeH121923)__HM470110.1__N
augagcgaguucaucuucaacgacgugccccagcgcaccaccuccagcuucgacccggaggccgccuacgucgcguucgaggcccgguacggccaggugcugaacgccugcgugguccgcguguucuuccucaaccagaagaaggccaaggacgugcugcggaagacguccuggcccauggucgaccugaccuucgggcgcgugcaguucgccauggugaacaaccacuucccccaguuccagagcaaccccgucccggacaacggccucgcgcugcaccggcuguccggguaccucgcccgcugggccuucacccagaugcggagccccaucaagcaggccgaguuccgcgcgaccgugguggucccccuggccgaggugaagggcugcacguggaacgacggggacgccauguaccugggcuucgccgccggcgcggagauguuccuccagaccuucaccuucuucccccuggugaucgagaugcaccggguccugaaggacgggauggacgugaacuucaugaagaaggugcuccgccagcgguacggccagaagaccgccgagcaguggaugcgcgaggagaucgucgccgugcgggccgccuucgaggcgguggggacgcuggccugggcccgcaccggcuucuccccggccgcccgggacuuccugcgccaguucgggaucgacaucuga

SEQ ID NO: 6873 - RNA, 696 nt, Artificial Sequence
  derived and/or modified CDS sequence (opt1) from OROV(BeH379693)__AF164534.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggcgcaccagccggcccauggucgaccugaccuucggcggggugcaguucgccauggugaacaaccacuucccccaguuccaguccaaccccgucccggacaacggccucacccugcaccgccugagcggguaccucgcgcggugggccuucacgcagaugcgcucccccaucaagcaggccgaguuccgggccaccgugguggucccccuggcggaggugaagggcugcaccuggaacgacggcgacgccauguaccugggguucgccgccggcgccgagauguuccuccagaccuucacguucuucccccuggugaucgagaugcaccgcguccugaaggacgggauggacgugaacuucaugaagaaggugcuccggcagcgcuacggccagaagaccgcggagcaguggaugcgggaggagaucgucgccgugcgcgccgccuucgaggccguggggacccuggcgugggcccggaccggcuucagcccggccgcccgcgacuuccugcggcaguucggcaucgggaucuga

SEQ ID NO: 6874 - RNA, 696 nt, Artificial Sequence
  derived and/or modified CDS sequence (opt1) from OROV(BeH381114)__AF164535.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaaggacgggauggacgugaacuucaugaagaaggugcuccgccagcgguacggccagaagaccgcggagcaguggaugcgcgaggagaucgucgccgugcgggccgccuucgaggccguggggacccuggcgugggcccgcaccggcuucagcccggccgcccgggacuuccugcgccaguucggcaucugcaucuga

SEQ ID NO: 6875 - RNA, 696 nt, Artificial Sequence
  derived and/or modified CDS sequence (opt1) from OROV(BeH390233)__AF164536.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaaggacgggauggacgugaacuucaugaagaaggugcuccgccagcgguacggccagaagaccgcggagcaguggaugcgcgaggagaucgucgccgugcgggccgccuucgaggccguggggacccuggcgugggcccgcaccggcuucagcccggccgcccgggacuuccugggccaguucgggaucggcaucuga

SEQ ID NO: 6876 - RNA, 696 nt, Artificial Sequence
  derived and/or modified CDS sequence (opt1) from OROV(BeH472204)__AF164538.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaaggacgggauggacgugaacuucaugaagaaggugcuccgccagcgguacguccagaagaccgcggagcaguggaugcgcgaggagaucguggccgugcgggccgccuucgaggccgucggcacccuggcgugggcccgcaccggguucagcccggccgcccgggacuuccugcgccaguucggcaucggcaucuga

SEQ ID NO: 6877 - RNA, 696 nt, Artificial Sequence
  derived and/or modified CDS sequence (opt1) from OROV(BeH505442)__AF164542.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcgccaccgugguggucccccuggcggaggugaagggcugcaccuggaacgacggcgacgccauguaccugggguucgccgccggcgccgagauguuccuccaggcguucaccuucuucccccuggugaucgagaugcaccggguccugaaggacgggauggacgugaacuucaugaagaaggugcuccgccagcgguacggccagaagacggccgagcaguggaugcgcgaggagaucgucgccgugcgggccgccuucgaggcgguggggacccuggccugggcccgcaccggcuucagcccggccgcccgggacuuccugcgccaguucggcaucgacaucuga

SEQ ID NO: 6878 - RNA, 696 nt, Artificial Sequence
  derived and/or modified CDS sequence (opt1) from OROV(BeH541863)__AF164544.1__N
augagcgaguucaucuucuccgacgugccccagcgcaccaccagcacguucgacccggaggccgccuacgucgcguucgaggcccgguacggccaggugcugaacgccggggugguccgcguguucuuccucaaccagaagaaggccaaggacgugcugcggaagaccucccgccccauggucgaccugaccuucggcggggugcaguucgccauggugaacaaccacuucccccaguuccagagcaaccccgucccggacaacggccucacccugcaccggcuguccggguaccucgcgcgcugggccuucacgcagaugcggagccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaaggacgggauggacgugaacuucaugaagaaggugcuccgccagcgguacggccagaagaccgcggagcaguggaugcgcgaggagaucgucgccgugcgggccgccuucgaggccguggggacccuggcgugggcccgcaccggcuucuccccggccgcccggaacuuccugcgccaguucggcaucgggaucuga

SEQ ID NO: 6879 - RNA, 696 nt, Artificial Sequence
  derived and/or modified CDS sequence (opt1) from OROV(BeH543033)__AF164545.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaaggacgggauggacgugaacuucaugaagaaggugcuccgccagcgguacggccagaagaccgcggagcaguggaugcgcgaggagaucgucgccgugcgggccgccuucgaggccguggggacccuggcgugggcccgcaccggcuucagcccggccgcccgggaguuccugcgccaguucggcaucgggaucuga

SEQ ID NO: 6880 - RNA, 696 nt, Artificial Sequence
  derived and/or modified CDS sequence (opt1) from OROV(BeH543618)__AF164548.1__N
augcaggaguucaucuucaacgacgugccccagcgcaccaccagcacguucgacccggaggccgccuacgucgcguucgaggcccgguacggccaggugcugaacgccggggugguccgcguguucuuccucaaccagaagaaggccaaggacgugcugcggaagaccucccgccccauggucgaccugaccuucggcggggugcaguucgccauggugaacaaccacuucccccaguuccagagcaaccccgucccggacaacggccucacccugcaccggcuguccggguaccucgcgcgcugggccuucacgcagaugcggagccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaaggacgggauggacgugaacuucaugaagaaggugcuccgccagcgguacggccagaagaccgcggagcaguggaugcgcgaggagaucgucgccgugcgggccgccuucgaggccguggggacccuggcgugggcccgcaccggcuucuccccggccgcccgggacuuccugcgccaguucggcaucgggaucuga

SEQ ID NO: 6881 - RNA, 696 nt, Artificial Sequence
  derived and/or modified CDS sequence (opt1) from OROV(BeH544552)__AF164546.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaaggacgggauggacgugaacuucaugaagaaggugcuccgccagcgguacggccagaagaccgcggagcaguggaugcgcgaggagaucgucgccgugcgggccgccuucgaggccguggggacccuggcgugggcccgcaccggcuucagcccggccgcccgggacuuccugcgccagaucggcaucgggaucuga

SEQ ID NO: 6882 - RNA, 696 nt, Artificial Sequence
  derived and/or modified CDS sequence (opt1) from OROV(GML444911)__AF164556.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaaggacgggauggacgugaacuucaugaagaaggugcuccgccagcgguacggccagaagaccgcggagcaguggaugcgcgaggagaucgucgccgugcgggccgccuucgaggccguggggacccuggcgugggcccgcaccggcuucagcccggccgcccgggacuuccugcgccaguucggcaucuacaucuga

SEQ ID NO: 6883 - RNA, 696 nt, Artificial Sequence
  derived and/or modified CDS sequence (opt1) from OROV(IQT4083)__AF164552.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaaggacgggauggacgugaacuucaugaagaaggugcuccgccagcgguacggcaagaagaccgcggagcaguggaugcgcgaggagaucgucgccgugcgggccgccuucgaggccguggggacccuggcgugggcccgcaccggcuucagcccggccgcccgggacuuccugcgccaguucggcaucgacaucuga

SEQ ID NO: 6884 - RNA, 696 nt, Artificial Sequence
  derived and/or modified CDS sequence (opt1) from OROV(PPS 522 H 669314)__EF467370.1__N
augagcgaguucaucuccaacgacgugccccaccgcaccaccagcacguucgacccggaggccgccuacgucgcguucgaggcccgguacggccaggugcugaacgccggggugguccgcguguucuuccucaaccagaagaaggccaaggacgugcugcggaagaccucccgccccauggucgaccugaccuucggcggggugcaguucgccauggugaacaaccacuucccccaguuccagagcaaccccgucccggacaacggccucacccugcaccggcuguccggguaccucgcgcgcugggccuucacgcagaugcggagccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaaggacgggauggacgugaacuucaugaagaaggugcuccgccagcgguacggccagaagaccgcggagcaguggaugcgcgaggagaucgucgccgugcgggccgccuucgaggccguggggacccuggcgugggcccgcaccggcuucuccccggccgcccgggacuuccugcgccaguucggcaucugcaucuga

SEQ ID NO: 6885 - RNA, 696 nt, Artificial Sequence
  derived and/or modified CDS sequence (opt1) from OROV(TVP-19254/GML-480914)__KP795083.1__N
augagcgaguucaucuucaacgacgugccccagcgcaccaccuccacguucgacccggaggccgccuacgucgcguucgaggcccgguacggccaggugcugagcgccggggugguccgcguguucuuccucaaccagaagaaggccaaggacgugcugcggaagaccucccgccccauggucgaccugaccuucggcggggugcaguucgccauggugaacaaccacuucccccaguuccagagcaaccccgucccggacaacggccucacccugcaccggcuguccggguaccucgcgcgcugggccuucacgcagaugcggagccccaucaagcaggccgaguuccgcgccaccgugguggucccccuggcggaggugaagggcugcaccuggaacgacggcgacgccauguaccugggguucgccgccggcgccgagauguuccuccagaccuucacguucuucccccuggugaucgagaugcaccggguccugaaggacgggauggacgugaacuucaugaagaaggugcuccgccagcgguacggccagaagaccgcggagcaguggaugcgcgaggagaucgucgccgugcgggccgccuucgaggccguggggacccuggcgugggcccgcaccggcuucuccccggccgcccgggacuuccugcgccaguucggcaucgacaucuga

SEQ ID NO: 6886 - RNA, 696 nt, Artificial Sequence
  derived and/or modified CDS sequence (opt1) from OROV(TVP-19256/IQE-7894)__KP795086.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucaccauggugaacaaccacuucccccaguuccaguccaaccccgucccggacaacggccucacgcugcaccggcugagcggguaccucgcccgcugggcguucacccagaugcggucccccaucaagcaggccgaguuccgcgccaccgugguggucccccuggccgaggugaagggcugcaccuggaacgacggcgacgcgauguaccugggguucgccgccggcgccgagauguuccuccagacguucaccuucuucccccuggugaucgagaugcaccggguccugaaggacgggauggacgugaacuucaugaagaaggugcuccgccagcgguacggccagaagaccgccgagcaguggaugcgcgaggagaucgucgcggugcgggccgccuucgaggccguggggacccuggccugggcgcgcacgggcuucagcccggccgcccgggacuuccugcgccaguucggcaucgacaucuga

SEQ ID NO: 6887 - RNA, 696 nt, Artificial Sequence
  derived and/or modified CDS sequence (opt1) from OROV(TVP-19258/IQT-4083)__KP795092.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcggcaccgugguggucccccuggccgaggugaagggcugcaccuggaacgacggggacgcgauguaccugggcuucgccgccggggccgagauguuccuccagaccuucacguucuucccccuggugaucgagaugcaccggguccugaaggacggcauggacgugaacuucaugaagaaggugcuccgccagcgguacgggcagaagaccgccgagcaguggaugcgcgaggagaucgucgcggugcgggccgccuucgaggccgugggcacccuggccugggcgcgcaccggcuucagcccggccgcccgggacuuccugcgccaguucgggaucgacaucuga

SEQ ID NO: 6888 - RNA, 699 nt, Artificial Sequence
  derived and/or modified CDS sequence (opt1) from OROV/FPV(Aus Ch 16129)__AF362400.1__N
augaccgacuucguguucaacgacgucccccagcgcgccaccagcacguucgacccggaggccgcguacguggccuucgagaaccgguuccgcgccaaccugaccguggacgucgcccggaucuucuuccucaaccagaagaaggccaaggaccgccuggcgaagaccgcccgggccaccguggacaucacguucggcgggguggucuuccccguggugaacaaccacuaccccgaguaccagcgcaaccccgucccggacgacggccugacccuccaccggcuguccggguaccuggcccgcuggcucaucgaccagugcaacgcgagccccgugcggaugaccgagauccgcaccaaggugaucaucccccuggccgaggucaagggcugcacguggaacgacggggccuccauguaccugggcuucgccgccggcgcggagauguuccuccagagcuucaccuucuacccccuggugaucgagaugcagcgggugcugaaggacgggauggacgucaacuucaugcgcaaggugcuccggcagcgcuacggcaccaagaccgccgagcaguggaugcgggacgacaucguggccgucaagacggccuucgaggccaucaacaccaucuccugggcgcgcagcggguucuccccggccgcccgggaguuccugcgccaguucggcaucaacaucuga

SEQ ID NO: 6889 - RNA, 696 nt, Artificial Sequence
  derived and/or modified CDS sequence (opt1) from OROV/IQTV(IQE3728/PER/06)__KF150535.1__N
augagcgaguucaucuucaacgacgugccccagcgcaccaccuccacguucgacccggaggccgccuacgucgcguucgaggcccgguacggccaggugcugaacgccggggugguccgcguguucuuccucaaccagaagaaggccaaggacgugcugcggaagaccagccgccccauggucgaccugaccuucggcggggugcaguucgccauggugaacaaccacuucccccaguuccaguccaaccccgucccggacaacggccucacccugcaccggcugagcggguaccucgcgcgcugggccuucacgcagaugcggucccccaucaagcaggccgaguuccgcgccaccgugguggucccccuggcggaggugaagggcugcaccuggaacgacggcgacgccauguaccugggguucgccgccggcaccgagauguuccuccagacguucaccuucuucccccuggugaucgagaugcaccggguccugaaggacgggauggacgugaacuucaugaagaaggugcuccgccagcgguacggccagaagaccgccgagcaguggaugcgcgaggagaucgucgcggugcgggccgccuucgaggccguggggacccuggccugggcgcgcacgggcuucagcccggccgcccgggacuuccugcgccaguucggcaucgggaucuga

SEQ ID NO: 6890 - RNA, 699 nt, Artificial Sequence
  derived and/or modified CDS sequence (opt1) from OROV/UTIV(Be An 84785)__KF697156.1__N
auggccgaguucguguucaacgacgucccccagcgcagcaccuccaccuucgacccggagguggccuacgcgacguucgaggccgccuuccggcagacccugaacgugaacgucgugcgcguguucuuccucaaccagaagaacgccaagaacguccugcggaagaccagccgccccaacguggaccugaccuucggcggggccacguuccccaucgugaacaaccacuucccccaguuccaguccaacccgguccccgacaacggccucacccugcaccggcugagcggguaccucgcgcgcugguccauggaccagaugcggaccaaccccauccgccaggccgaguuccgggccgccgugguggucccccuggcggagaucaagggcugcaccuggaacgacggggacgccauguaccuggccuucgccgccggcgcggagauguuccucaacacguucaccuucuucccgcuggugaucgagaugcaccgcgugcugaaggacggcauggacgucaacuucaugcggaaggugcuccgccagcgguacgggaccaagaccgccgagcaguggaugaaggacgagaucauccccaucaaggccgccuucgaggccgugggcaugcugagcugggcgcgcacgggguucucccccgccgcccgggacuuccugcgccaguucggcaucaacgucuga

SEQ ID NO: 6891 - RNA, 738 nt, Artificial Sequence
  derived and/or modified CDS sequence (opt1) from HRTV(TN)__KJ740146.1__N
augaccgacuggagcgccaucgccguggagaucggcaacgagccccuggacgucccggcgcucguggaguucgccaaggagaucgccuacgaggggcuggaccccgccgugauccugggccuccugcgcgagcgcgggggcgagaacuggcggaacgacgucaaguacaucaucguguucgcccugacccgggggaacaagaucgugaaggcgugcggcaagauguccaagaagggcgccgagcgcaugacgaaccucgcccgggucuacgagcugaaggagaacgccguggaccgcauggcggugacccccguccggguggcccagugccugcccaccuggaccugcgccgccgccgcggccaucaaggaguaccucccgguggggcccgccaucaugcacaacaagauccagggcuacccccuggagaugaugugcauggccuucgggagccugaucccccaggccgacgucuccaucgaggugaucaaggacuucauggacgcguacagccucuggcaggacacguucgcccgcaccaucaacguggaccagcggaagaugaccaaggccgaggucuacgccaaguuccgcgacccgcugcacgccgcggugaacucccuguucuuccccaacgccacccggaucagcuggcuccaggccaagggccugcugacggccaccaaggaggccuccgggagcgugaaggcggccgccgccgcguaccgcaacauguga

SEQ ID NO: 6892 - RNA, 738 nt, Artificial Sequence
  derived and/or modified CDS sequence (opt1) from HRTV(Patient1)__JX005842.1__N
augaccgacuggagcgccaucgccguggagaucggcaacgagccccuggacgucccggcgcucguggaguucgccaaggagaucgccuacgaggggcuggaccccgccgugaucuucggccugcuccgcgagcgcgggggcgagaacuggcggaacgacgucaaguacaucaucguguucgcccugacccgggggaacaagaucgugaaggcgugcggcaagauguccaagaagggcgccgagcgcaugacgaaccuggcccgggucuacgagcucaaggagaacgccguggaccgcauggcggugacccccguccggguggcccagugccugcccaccuggaccugcgccgccgccgcggccaucaaggaguaccugccgguggggcccgccaucaugcacaacaagauccagggcuacccccucgagaugaugugcauggccuucgggagccugaucccccaggccgacgucuccaucgaggugaucaaggacuucauggacgcguacagccuguggcaggacacguucgcccgcaccaucaacguggaccagcggaagaugaccaaggccgaggucuacgccaaguuccgcgacccgcuccacgccgcggugaacucccuguucuuccccaacgccacccggaucagcuggcugcaggccaagggccuccugacggccaccaaggaggccuccgggagcgugaaggcggccgccgccgcguaccgcaacauguga

SEQ ID NO: 6893 - RNA, 738 nt, Artificial Sequence; identical to SEQ ID NO: 6891
  derived and/or modified CDS sequence (opt1) from HRTV(Patient2)__JX005843.1__N

SEQ ID NO: 6894 - RNA, 732 nt, Artificial Sequence
  derived and/or modified CDS sequence (opt1) from PTV(PAN472868)__NC_027202.1__N
augagcuacgaggagaucgccgugcaguucgccuccgagagcaucgacgagcaggcggucgccggcugggugaccgacuucgccuaccagggguucgacgccaagcgcgugaucgcccuggucaaggaccggggcggggaggacuggaagcaggacgugaagaagaugaucgugcucucccugacccgcggcaacaagcccaacaagaugguccugaagaugagcgacaaggggaaggcgauggugaacgagcucgugcugaaguacaagcugaaguccggcaacccgagccgggacgaccucacgcugucccgcaucaccgccgccuucgccggcuggaccugccaggcggccgacuacguccaggaguaccugcccgugaccgggcgggccauggacgccaucagcuccagcuacccccgcgccaugaugcaccccuccuucgcgggccucaucgaccaggagcugccggccgacgugcugagcgagaucacgcaggcccacugccucuucaugauccaguucuccaagaccaucaaccccagccugcgggggcuguccaaggacgagaucgucagcuccuucgagcgccccaugcaggccgccaucagcuccaccuuccucaccagcgcgaaccggcgcgccaugcugaagacgcugggcaucaucaacgacaaccucaagcccagcuccagcaccguguccgccgccaagguguuccggagccuguga

SEQ ID NO: 6895 - RNA, 732 nt, Artificial Sequence
  derived and/or modified CDS sequence (opt1) from PTV(Adames)__KR912210.1__N
augagcuacgaggagaucgccgugcaguucgccuccgagagcaucgacgagcaggcggucgccggcugggugaccgacuucgccuaccagggguucgacgccaagcgcgugaucgcccuggucaaggagcggggcggggaggacuggaagcaggacgugaagaagaugaucgugcucucccugacccgcggcaacaagcccaacaagaugguccugaagaugagcgacaaggggaaggcgauggugaacgagcucgugcugaaguacaagcugaaguccggcaacccgagccgggacgaccucacgcugucccgcaucaccgccgccuucgccggcuggaccugccaggcggccgacuacguccaggaguaccugcccgugaccgggcgggccauggacacgaucagcuccggcuacccccgcgccaugaugcaccccagcuucgccgggcucaucgaccaggagcugccggcggacgugcuguccgagaucacccaggcccacugccucuucaugauccaguucagcaagaccaucaaccccucccugcggggccugagcaaggacgagaucgucuccagcuucgagcgccccaugcaggccgccaucuccagcaccuuccucacguccgccaaccggcgcgcgaugcugaagacccuggggaucaucaacgacaaccucaagcccagcagcuccaccgugagcgccgccaagguguuccggucccuguga

SEQ ID NO: 6896 - RNA, 732 nt, Artificial Sequence
  derived and/or modified CDS sequence (opt1) from PTV(Balliet)__KR912211.1__N
augagcuacgaggagaucgccgugcaguucgccuccgagagcaucgacgagcagaccgucgcgggcugggugaccgacuucgccuaccagggguucgacgccaagcgcgugaucgcccuggucaaggaccggggcggggaggacuggaagcaggacgugaagaagaugaucgugcucucccugacgcgcggcaacaagcccaacaagaugauccugaagaugagcgacaaggggaaggccauggucaacgagcucgugcugaaguacaagcugaaguccggcaacccgagccgggacgaccucacccugucccgcaucaccgcggccuucgccggcuggaccugccaggccgcggacuacgugcaggaguaccugcccgucacggggcgggccauggacgccaucagcuccagcuacccccgcgccaugaugcaccccuccuucgccggccucaucgaccaggagcugccggcggacguguucagcgagaucacccaggcccacugccuguucaugauccaguucuccaagaccaucaaccccagccuccgggggcuguccaaggacgagaucgugagcuccuucgagcgccccaugcaggccgccaucagcuccaccuuccugacgagcgccaaccggcgcgcgaugcucaagacccugggcaucaucaacgacaaccugaagcccagcuccagcaccgucuccgccgccaagguguuccggagccucuga

SEQ ID NO: 6897 - RNA, 732 nt, Artificial Sequence
  derived and/or modified CDS sequence (opt1) from PTV(PaAR2381)__KP272006.1__N
augagcuacgaggagaucgccgugcaguucgccuccgagagcaucgacgagcaggcggucgccggcugggugaccgacuucgccuaccagggguucgacgccaagcgcgugaucgcccuggucaaggaccggggcggggacgacuggaagcaggacgugaagaagaugaucgugcucucccugacccgcggcaacaagcccaacaagaugguccugaagaugagcgacaaggggaaggcgauggugaacgagcucgugcugaaguacaagcugaaguccggcaacccgagccgggacgaccucacgcugucccgcaucaccgccgccuucgccggcuggaccugccaggcggccgacuacguccaggaguaccugcccgugaccgggcgggccauggacgccaucagcuccagcuacccccgcgccaugaugcaccccuccuucgcgggccucaucgaccaggagcugccggccgacgugcugagcgagaucacgcaggcccacugccucuucaugauccaguucuccaagaccaucaaccccagccugcgggggcuguccaaggacgagaucgucagcuccuucgagcgccccaugcaggccgccaucagcuccaccuuccucaccagcgcgaaccggcgcgccaugcugaagacgcugggcaucaucaacgacaaccucaagcccagcuccagcaccguguccgccgccaagguguuccggagccuguga

SEQ ID NO: 6898 - RNA, 732 nt, Artificial Sequence
  derived and/or modified CDS sequence (opt1) from PTV(GML902876)__KP272012.1__N
augagcuacgaggagaucgccgugcaguucgccuccgagagcaucgacgagcaggcggucgccggcugggugaccgacuucgccuaccagggguucgacgccaagcgcgugaucgcccuggucaaggaccggggcggggacgacuggaagcaggacgugaagaagaugaucgugcucucccugacccgcggcaacaagcccaacaagaugguccugaagaugagcgacaaggggaaggcgauggugaacgagcucgugcugaaguacaagcugaaguccggcaacccgagccgggacgaccucacgcugucccgcaucaccgccgccuucgccggcuggaccugccaggcggccgacuacguccaggaguaccugcccgugaccgggcgggccauggacgccaucagcuccagcuacccccgcgccaugaugcaccccuccuucgcgggccucaucgaccaggagcugccggccgacgugcugagcgagaucacgcaggcccacugccucuucaugauccaguucuccaagaccaucaaccccagccugcgggggcuguccaaggacgagaucgucagcuccuucgagcgccccaugcaggccgccaucagcuccaccuuccucaccagcgcgaaccggcgcgccaugcugaagacgcugggcaucaucaacgacaaccucaagcccagcuccagcaccgccuccgccgccaagguguuccggagccuguga

SEQ ID NO: 6899 - RNA, 732 nt, Artificial Sequence
  derived and/or modified CDS sequence (opt1) from PTV(Adames)__KP272030.1__N
augagcuacgaggagaucgccgugcaguucgccuccgagagcaucgacgagcaggcggucgccggcugggugacccacuucgccuaccagggguucgacgccaagcgcgugaucgcccuggucaaggagcggggcggggaggacuggaagcaggacgugaagaagaugaucgugcucucccugacccgcggcaacaagcccaacaagaugguccugaagaugagcgacaaggggaaggcgauggugaacgagcucgugcugaaguacaagcugaaguccggcaacccgagccgggacgaccucacgcugucccgcaucaccgccgccuucgccggcuggaccugccaggcggccgacuacguccaggaguaccugcccgugaccgggcgggccauggacacgaucagcuccggcuacccccgcgccaugaugcaccccagcuucgccgggcucaucgaccaggagcugccggcggacgugcuguccgagaucacccaggcccacugccucuucaugauccaguucagcaagaccaucaaccccucccugcggggccugagcaaggacgagaucgucuccagcuucgagcgccccaugcaggccgccaucuccagcaccuuccucacguccgccaaccggcgcgcgaugcugaagacccuggggaucaucaacgacaaccucaagcccagcagcuccaccgugagcgccgccaagguguuccggucccuguga

SEQ ID NO: 6900 - RNA, 735 nt, Artificial Sequence
  derived and/or modified CDS sequence (opt1) from Phlebovirus(CoAr171616)__HM566153.1__N
augagcuacgaggagaucgccgugaacuucgccuccgagagcaucgacgaguccaccaucagcgcgugggucuccgacuucgccuaccagggcuucgacgccaagcgcgugaucgcccugaucaaggagcgcgggggcgagaacuggaaggaggacgugaagaagaugaucguccucagccugacccgggggaacaagcccgccaagaugauccugaagauguccgacaagggcaagaaggaggugaacgaccucaucacgcgguacaagcucaagagcgggaacccgucccgcgacgaccugacccugagccggguggcggccgccuucgccggcuggaccugccaggcggccgaguacguccaggaguaccugcccgugaccggccgcgccauggacgccuucuccgccgacuucccccgggcgcugaugcaccccagcuucgccgggcucaucgaccaggagcugccguccagcgccaugacggacaucgugcacgcccacugccuguucaugauccaguucuccaagaccaucaaccccaccauccgcagcgccuccaaggacgagaucgucgcgagcuucgaccggcccaugcaggccgccaucaacuccaccuuccucacgagcgcccagcgccgggccaugcugaagacccugggcgugaucaacgacaaccucaaggugagcaccgcggucuccagcgccgccaaggccuucaagaagcugcaguga

SEQ ID NO: 6901 - RNA, 735 nt, Artificial Sequence
  derived and/or modified CDS sequence (opt1) from Phlebovirus(CoAr171616)__EF201836.1__N
augagcuacgaggagaucgccauccacuucgccuccgagagcaucgacgaguccaccaucagcgcguggguguccgacuucgccuaccagggcuucgacgccaagcgcgucaucgcccugaucaaggagcgcgggggcgagaacuggaaggaggacgugaagaagaugaucgugcucagccugacccgggggaacaagcccgccaagaugauccugaagauguccgacaagggcaagaaggaggucaacgaccucaucacgcgguacaagcucaagagcgggaacccgucccgcgacgaccugacccugagccggguggcggccgccuucgccggcuggaccugccaggcggccgaguacgugcaggaguaccugcccgucaccggccgcgccauggacgccuucuccgccgacuucccccgggcgcugaugcaccccagcuucgccgggcucaucgaccaggagcugccguccagcgccaugacggacaucgugcacgcccacugccuguucaugauccaguucuccaagaccaucaaccccaccauccgcagcgccuccaaggacgagaucguggcgagcuucgaccggcccaugcaggccgccaucaacuccaccuuccucacgagcgcccagcgccgggccaugcugaagacccugggcgucaucaacgacaaccucaaggugagcaccgcgguguccagcgccgccaaggccuucaagaagcugcaguga

SEQ ID NO: 6902 - RNA, 732 nt, Artificial Sequence
  derived and/or modified CDS sequence (opt1) from Phlebovirus(CoAr170255)__EF201840.1__N
augagcuacgaggagaucgccauccaguucgccuccgagagcguggacgcgaccaccaucgccgccugggucuccgaguucgccuaccagggcuucgacgcccgccaggugaucaaccuggugaagcagcgcgggggcgacgacuggaaggaggacgucaagaagaugaucgugcucagccugacgcgggggaacaagcccuccaagaugcugaacaagaugagcgaguccggccagaagaucgugaacgaccucaucagcaaguacaagcugaaguccgggaacccgggccggaacgaccugacccucagccgcaucgcggccgccuucgccggcuggaccugccaggcggccgaggucgugcaggacuaccugcccgugaccgggcgggccauggacgccaucuccgacaaguucccccgcgcccugaugcaccccagcuucgcgggccucgucgacccgacgcugcccgagggggugguggaggacaucguccacgcccacugccuguucaugauccaguucuccaagaccaucaaccccagccuccgguccagcuccaagagcgaggugguguccagcuucgaccgccccaugcaggccgccaucaacagcccguuccugaccgccggcaaccggcgcgacauccugaugucccucgggcugaucaacagcaaccugaagcccucccccgcggucaucgccgccgccaagguguaccggaagcucuga

SEQ ID NO: 6903 - RNA, 732 nt, Artificial Sequence
  derived and/or modified CDS sequence (opt1) from Buenaventura virus(CoAr3319)__KP272003.1__N
augagcuacgaggagaucgccauccaguucgccuccgagagcguggacgcgaccaccaucgccgccugggucuccgaguucgccuaccagggcuucgacgcccgccaggugaucaaccuggugaagcagcgcgggggcgacgacuggaaggaggacgucaagaagaugaucgugcucagccugacgcgggggaacaagcccuccaagaugcugaacaagaugagcgaguccggccagaagaucgugaacgaccucaucagcaaguacaagcugaaguccgggaacccgggccggaacgaccugacccucagccgcaucgcggccgccuucgccggcuggaccugccaggcggccgaggucgugcaggacuaccugcccgugaccgggcgggccauggacgccaucuccgacaaguucccccgcgcccugaugcaccccagcuucgcgggccucgucgacccgacgcugcccgagggggugguggaggacaucguccacgcccacugccuguucaugauccaguucuccaagaccaucaaccccagccuccgguccagcuccaagagcgaggugguguccagcuucgaccgccccaugcaggccgccaucaacagcccguuccugaccgccggcaaccggcgcgacauccugaugucccucgggcugaucaacagcaaccugaagcccucccccaccgucguggcggccgccaagguguaccggaagcucuga

SEQ ID NO: 6904 - RNA, 732 nt, Artificial Sequence
  derived and/or modified CDS sequence (opt1) from Cocle virus(GML244915)__KP272035.1__N
augagcuacgaggagaucgccgugcaguucgccuccgagagcaucgacgagcaggcggucgccggcugggugaccgacuucgccuaccagggguucgacgcccgccgggugaucgcccuggucaaggaccgcggcggggaggacuggaagcaggacgugaagaagaugaucgugcucucccugacccggggcaacaagcccaacaagaugguccugaagaugagcgacaaggggaaggcgauggugaacgagcucgugcugaaguacaagcugaaguccggcaacccgagccgcgacgaccucacgcugucccggaucaccgccgccuucgccggcuggaccugccaggcggccgacuacguccaggaguaccugcccgugaccgggcgcgccauggacgccaucagcuccggcuacccccgggccaugaugcaccccagcuucgcggggcucaucgaccaggagcugccggccgacgugcuguccgagaucacgcaggcccacugccucuucaugauccaguucagcaagaccaucaaccccucccugcgcggccuggggaaggacgagaucgucagcuccuucgagcggcccaugcaggccgccaucagcuccaccuuccucaccagcgcgaaccgccgggccaugcugaagacgcugggcaucaucaacgacaaccucaagcccuccagcagcaccguguccgccgccaagguguuccgcagccuguga

SEQ ID NO: 6905 - RNA, 732 nt, Artificial Sequence
  derived and/or modified CDS sequence (opt1) from Capira virus(VP-366G)__KP272044.1__N
augagcuacgaggagaucgccauccaguucgccuccgagagcaucgacgaguccaccaucgcggccugggugagcgacuucgccuaccagggcuucgacgccaagcaggucaucauccugaucaagaagcgcgggggcgagaacuggaaggaggacgugaagaagaugaucgugcucucccugacccgggggaacaagcccagcaagauggucaacaagauguccgacgagggcaagaagguggugaacgagcugaucagcaaguacaagcucaagacggggaacccggcccgcgacgaccugacccugucccggaucgcggccgccuucgccggcuggaccugccaggcggccgaguacguccaggacuaccuccccgugaccggccgcgccauggacgcccugagcgacaaguacccccgggcccugaugcaccccuccuucgcggggcucaucgacccgacgcugcccgacgacgccgugaaggacaucguccacgcccacugccuguucaugauccaguucagcaagaccaucaaccccucccuccgcagcuccaccaagaccgagaucgugaacagcuucgaccggcccaugcaggccgccaucaacuccccguuccugacggcggagaaccgccgggccaugcugaccacccucggcgugaucaacagcaaccugaagcccuccgccgccgucguggccgcggccaaggccuaccgcaagcuguga

SEQ ID NO: 6906 - RNA, 732 nt, Artificial Sequence
  derived and/or modified CDS sequence (opt1) from Campana virus(VP-334K)__KP272042.1__N
augagcuacgaggagaucgccauccaguucgccuccgagagcguggacgcgaccaccaucgccgccugggucuccgaguucgccuaccagggcuucgacgcccgccaggugaucaaccuggugaagcagcgcgggggcgacgacuggaaggaggacgucaagaagaugaucgugcucagccugacgcgggggaacaagcccucccggauggugaccaagaugagcgaguccggccagaagaucgucaacgaccugaucagcaaguacaagcucaaguccgggaacccgggccgcaacgaccugacccugagccggguggcggccgccuucgccggcuggaccugccaggcggccgaggugguccaggacuaccuccccgugacggggcgcgccauggacgcccuguccgacaaguucccccgggccaucaugcaccccagcuucgcgggccugaucgacccgacccuccccgagaacguggucgaggacaucgugcacgcccacugccuguucaugauccaguucuccaagaccaucaaccccagccugcgcuccagcuccaagagcgagguggucuccagcuucgaccggcccaugcaggccgccaucaacagcccguuccucaccgccgcgaaccgccgggacaugcugaugucccuggggcucaucagcuccaaccugaagcccagcgccgccgugacggccgccgcgaaggccuaccgcaagcuguga

SEQ ID NO: 6907 - RNA, 738 nt, Artificial Sequence
  derived and/or modified CDS sequence (opt1) from RVFV(ZH-548)__DQ380151.1__N
auggacaacuaccaggagcuggccauccaguucgccgcgcaggccguggaccgcaacgagaucgagcaguggguccgggaguucgccuaccagggcuucgacgcccgccgggugaucgagcuccugaagcaguacgggggcgccgacugggagaaggacgcgaagaagaugaucgugcuggcccucacccgcgggaacaagccccggcgcaugaugaugaagaugagcaaggagggcaaggccaccgucgaggcccugaucaacaaguacaagcugaaggaggggaacccgucccgggacgagcucacgcugagccgcguggcggccgcccuggccggcuggaccugccaggcccucgugguccuguccgaguggcugcccgugaccggcaccacgauggacgggcucagccccgcguacccccggcacaugaugcacccguccuucgccggcaugguggaccccagccugcccggggacuaccugcgcgccauccucgacgcccacucccuguaccugcuccaguucagccgggucaucaaccccaaccugcgcggccggaccaaggaggagguggccgcgaccuucacccagccgaugaacgccgccgugaacuccaacuucaucagccacgagaagcgccgggaguuccugaaggccuucgggcucgucgacuccaacggcaagcccagcgccgcggugauggccgccgcccaggccuacaagacggcggccuga

SEQ ID NO: 6908 - RNA, 738 nt, Artificial Sequence
  derived and/or modified CDS sequence (opt1) from RVFV(OV 35/74)__EF530207.1__N
auggacaacuaccaggagcuggccauccaguucgccgcgcaggccguggaccgcaacgagaucgagcaguggguccgggaguucgccuaccagggcuucgacgcccgccgggugaucgagcuccugaagcaguacgggggcgccgacugggagaaggacgcgaagaagaugaucgugcuggcccucacccgcgggaacaagccccggcgcaugaugaugaagaugagcaaggagggcaaggccaccgucgaggcccugaucaacaaguacaagcugaaggaggggaacccgucccgggacgagcucacgcugagccgcguggcggccgcccuggccggcuggaccugccaggcccucgugguccuguccgaguggcugcccgugaccggcaccacgauggacgggcucagccccgcguacccccggcacaugaugcacccguccuucgccggcaugguggaccccagccugcccgaggacuaccugcgcgccauccucgacgcccacucccuguaccugcuccaguucagccgggucaucaaccccaaccugcgcgggcggaccaaggaggagguggccgcgaccuucacccagccgaugaacgccgccgugaacuccaacuucaucagccacgagaagcgccgggaguuccugaaggccuucggccucgucgacuccaacgggaagcccagcgccgcggugauggccgccgcccaggccuacaagacggcggccuga

SEQ ID NO: 6909 - RNA, 762 nt, Artificial Sequence
  derived and/or modified CDS sequence (opt1) from SFNV(Toscana)__NC_006318.1__N
augagcgacgagaacuaccgcgacaucgcccuggccuuccucgacgaguccgcggacagcggcaccaucaacgccugggugaacgaguucgccuaccagggguucgaccccaagcggaucguccagcuggugaaggagcgcggcaccgccaaggggcgggacuggaagaaggacgugaagaugaugaucguccugaaccucgugcgcggcaacaagccggaggccaugaugaagaagauguccgagaagggggcgagcaucguggccaaccugaucuccgucuaccagcugaaggagggcaaccccggccgggacacgaucacccucagccgcguguccgccgccuucgugcccuggaccguccaggcgcugcgggugcugagcgagucccuccccgugagcgggaccacgauggacgccaucgccggcgucaccuacccgcgcgccaugaugcaccccuccuucgccgggaucaucgaccuggaccugcccaacggcgcgggggccaccaucgccgacgcccacggccucuucaugaucgaguucagcaagaccaucaaccccucccugcggacgaagcaggccaacgagguggcggccaccuucgagaagccgaacauggccgccaugagcggccgcuucuucacccgggaggacaagaagaagcugcucaucgccguggggaucaucgacgaggaccugguccuggcguccgccguggugcgcagcgccgagaaguaccgggccaaggucggcaaguga

SEQ ID NO: 6910 - RNA, 762 nt, Artificial Sequence
  derived and/or modified CDS sequence (opt1) from SFNV__HM566170.1__N
augagcgaggagaacuaccgcgagaucgcccuggccuuccucgacgaggcggccgacuccggcaccaucaccgccugggugaacgaguucgccuaccagggguucgaccccaagcggaucguccagcuggugaaggagcgcggcacggccaaggggcgggacuggaagaaggacgugaagaugaugaucguccugaaccucgugcgcggcaacaagccggaggcgaugaugaagaagaugagcgagaagggggccggcaucguggcccagcugaucuccgucuaccagcugaaggagggcaaccccgggcgggacaccaucacccucagccgcguguccgccgcguucgugcccuggaccauccaggcccugcggguccugagcgacucccuccccgugacgggcaccaccauggacgccaucgccggggugaccuacccgcgcgccaugaugcaccccagcuucgcgggcaucaucgaccuggaccugcccaaccgggccggggaggucaucgccgacgcccacggccucuucaugcuggaguucuccaagacgaucaaccccagccugcgcaccaagcagccgaacgagaucgccgcgaccuucgagaagcccaacauggccgccauguccggccgguucuucacccgcgaggacaagaagaagcuccugauggccguggggauccugaacgaggaccucgugcugacgcccgccaucgucaagugcgcggagaaguacugcagcaaggugggcaaguga

SEQ ID NO: 6911 - RNA, 735 nt, Artificial Sequence; identical to SEQ ID NO: 6900
  derived and/or modified CDS sequence (opt1) from SFNV(Namru)__HM566168.1__N

SEQ ID NO: 6912 - RNA, 762 nt, Artificial Sequence
  derived and/or modified CDS sequence (opt1) from SFNV(NAMRU 840055)__EF201828.1__N
augagcgaggagaacuaccgcgagaucgcccuggccuuccucgacgaggcggccgacuccggcaccaucaccgccugggugaacgaguucgccuaccagggguucgaccccaagcggaucguccagcuggugaaggagcgcggcacggccaaggggcgggacuggaagaaggacgugaagaugaugaucguccugaaccucgugcgcggcaacaagccggaggcgaugaugaagaagaugagcgagaagggggccggcaucguggcccagcugaucuccgucuaccagcugcgggagggcaaccccgggcgcgacaccaucacccucagccggguguccgccgcguucgugcccuggaccauccaggcccugaagguccugagcgacucccuccccgugacgggcaccaccauggacgccaucgccgggguggucuacccgcgcgccaugaugcaccccagcuucgcgggcaucaucgaccuggaccugcccaaccgggccggggaggccaucgccgacgcccacggccucuucaugcuggaguucuccaagaccaucaaccccagccugcgcacgaagcagccgaacgagaucgcggccaccuucgagaagcccaacauggccgccauguccggccgguucuucacccgcgaggacaagaagaagcuccugauggccguggggauccugaacgaggaccucgugcugacccccgcgaucgucaagugcgccgagaaguaccggagcaaggugggcaaguga

SEQ ID NO: 6913 - RNA, 762 nt, Artificial Sequence
  derived and/or modified CDS sequence (opt1) from SFNV(NAMRU 840055)__EF201829.1__N
augagcgaggagaacuaccgcgagaucgcccuggccuuccucgacgaggcggccgacuccggcaccaucaccgccugggugaacgaguucgccuaccagggguucgaccccaagcggaucguccagcuggugaaggagcgcggcacggccaaggggcgggacuggaagaaggacgugaagaugaugaucguccugaaccucgugcgcggcaacaagccggaggcgaugaugaagaagaugagcgagaagggggccggcaucguggcccagcugaucuccgucuaccagcugaaggagggcaaccccgggcgggacaccaucacccucagccgcguguccgccgcguucgugcccuggaccauccaggcccugcggguccugagcgacucccuccccgugacgggcaccaccauggacgccaucgccggggugaccuacccgcgcgccaugaugcaccccagcuucgcgggcaucaucgaccuggaccugcccaaccgggccggggaggccaucgccgacgcccacggccucuucaugcuggaguucuccaagacgaucaaccccagccugcgcaccaagcagccgaacgagaucgcggccaccuucgagaagcccaacauggccgccauguccggccgguucuucacccgcgaggacaagaagaagcuccugauggccgucgggauccugaacgaggaccucgugcugacgcccgcgaucgugaagugcgccgagaaguacugcagcaaggucggcaaguga

SEQ ID NO: 6914 - RNA, 762 nt, Artificial Sequence
  derived and/or modified CDS sequence (opt1) from SFNV(P-7101795)__EF201830.1__N
augagcgaggagaacuaccgcgagaucgcccuggccuuccucaacgaggcggccgacuccggcaccaucaccgccugggugaacgaguucgccuaccagggguucgaccccaagcggaucguccagcuggugaaggagcgcggcacggccaaggggcgggacuggaagaaggacgugaagaugaugaucguccugaaccucgugcgcggcaacaagccggagaccaugaugaagaagaugagcgagaagggggcgggcaucguggcccagcugaucuccgucuaccagcugaaggagggcaaccccgggcgggacaccaucacccucagccgcguguccgccgccuucgugcccuggacgguccaggcgcugcgggugcugagcgacucccuccccgugaccggcaccaccauggacgccaucgccggggucacguacccgcgcgccaugaugcaccccagcuucgccggcaucaucgaccuggaccugcccaaccgggcgggggagaccaucgccgacgcccacggccucuucaugcuggaguucuccaagaccaucaaccccagccugcgcaccaagcagccgaacgagaucgccgccacguucgagaagcccaacauggcggccauguccggccgguucuucacccgcgaggacaagaagaagcuccugauggccgugggggugcugaacgaggaccucguccugacccccgccaucgugaagugcgccgagaaguaccggagcaaggugggcaaguga

SEQ ID NO: 6915 - RNA, 762 nt, Artificial Sequence
  derived and/or modified CDS sequence (opt1) from SFNV(P-7101795)__EF201832.1__N
augagcgaggagaacuaccgcgagaucgcccuggccuuccucgacgaggcggccgacuccggcaccaucaccgccugggugaacgaguucgccuaccagggguucgaccccaagcggaucguccagcuggugaaggagcgcggcacggccaaggggcgggacuggaagaaggacgugaagaugaugaucguccugaaccucgugcgcggcaacaagccggaggcgaugaugaagaagaugagcgagaagggggccggcaucguggcccagcugaucuccgucuaccagcugcgggagggcaaccccgggcgcgacaccaucacccucagccggguguccgccgcguucgugcccuggaccauccaggcccugaagguccugagcgacucccuccccgugacgggcaccaccauggacgccaucgccggggugauguacccgcgcgccaugaugcaccccagcuucgcgggcaucaucgaccuggaccugcccaaccgggccggggaggccaucgccgacgcccacggccucuucaugcuggaguucuccaagaccaucaaccccagccugcgcacgaagcagccgaacgagaucgcggccaccuucgagaagcccaacauggccgccauguccggccgguucuucacccgcgaggacaagaagaagcuccugauggccgucgggauccugaacgaggaccucgugcugacccccgcgaucaucaagugcgccgagaaguaccggagcaaggugggcaaguga

SEQ ID NO: 6916 - RNA, 762 nt, Artificial Sequence
  derived and/or modified CDS sequence (opt1) from Arrabida virus(PoSFPhlebV/126/2008)__KP863801.1__N
augagcgaggacaacuaccgcaccaucgcccuggccuuccucgacgaguccgcggacagcaccacgaucaacgccugggugaacgaguucgccuaccagggcuucgaccccaagcggaucguccagcuggugaaggagcgcgggaccgccaagggccgggacuggaagaaggacgugaagaugaugaucguccugaaccucgugcgcgggaacaagccggaguccaugaugaagaagaugagcgagaagggcgccgcgaucgugacccagcugaucuccaccuaccagcugaaggaggggaaccccggccgggacacgaucacccucagccgcgucuccgccgccuucgugcccuggaccgugcaggcccugaagacccugagcgagucccuccccgucacgggcaccaccauggacagcaucgcggggaccacguacccgcggugcaugaugcaccccuccuucgccggcaucaucgaccuggagcugcccaacaacaccggggccaugcucgccgacgcccacggccuguucaugcuggaguucagcaagaccaucaaccccucccuccgcaccaagcagccgaacgagaucgcggccacguucgagaagcccaacauggccgccaugaccgggcgguucuucacccgcgacgacaagaagaagcugcugaucgccaucggcgugcucgacgaggaccuggugcccaaccccgcgaucgagaagugcgccgagaaguacaaggccaaggucggcaaguga

SEQ ID NO: 6917 - RNA, 765 nt, Artificial Sequence
  derived and/or modified CDS sequence (opt1) from Gordil virus(Dak ANBr 496d)__KF297902.1__N
augagcgaggagaacuaccgcgagaucgccauggccuucgcgaacgacuccgccgacuucaacaugaucagcgugugggccaacgacuucgccuaccagggcuucgaccccaagcggaucgucgagcuggugcgccagcgggggcucgccaaggcgcgcaacuggaagcaggacgugaagaugaugaucguccugaaccugaugcggggcaacaagccggaggccauggugcgcaagaugcaggagaaggggcagcggaucgugcucgagcugaucuccgucuacgagcugaaggagggcaaccccgggcgcgacaccaucacccucagccggguguccgccgccuucgugcccuggacgaucauggcgcugcgccagcuggccgagaacauccccgucaccggcagcaucauggacuccauccucgacggcgccguguacccgcgggccaugaugcaccccagcuucgccgggaucaucgaccuggagcugcccgagggccgcggggcggagcucgccgacgcccacggccuguucaugaucgaguucuccaagaccaucaaccccagccugcggaccaaguccgccaucgagaucgccgcgagcuucgagaagccgaacauggccgccaugacggggaacuucuucaccaaggacgacaagcgcaagcuccugaagcagaucggcauccuggacuccgaccucaagcugacccccgugaucgagaaggccgccgcgcuguaccggagcaagaccaacaaguga

SEQ ID NO: 6918 - RNA, 762 nt, Artificial Sequence
  derived and/or modified CDS sequence (opt1) from Granada virus(GR25)__GU135608.1__N
augagcgaggacaacuaccgcaccaucgcccuggccuuccucgacgaguccgcggacagcaccacgaucaacgccugggugaacgaguucgccuaccagggcuucgaccccaagcggaucguccagcuggugaaggagcgcgggaccgccaagggccgggacuggaagaaggacgugaagaugaugaucguccugaaccucgugcgcgggaacaagccggaguccaugaugaagaagaugagcgagaagggcgccgcgaucgugacccagcugaucuccaccuaccagcugaaggaggggaaccccggccgggacacgaucacccucagccgcgucuccgccgccuucgugcccuggaccgugcaggcccugaagacccugagcgagucccuccccgucacgggcaccaccauggacagcaucgcggggaccacguacccgcggugcaugaugcaccccuccuucgccggcaucaucgaccuggagcugcccaacaacaccggggccaugcucgccgacgcccacggccuguucaugcuggaguucagcaagaccaucaaccccucccuccgcaccaagcagccgaacgagaucgcggccacguucgagaagcccaacauggccgccaugaccgggcgguucuucacccgcgacgacaagaagaagcugcugaucgccaucggcgugcucaacgaggaccuggugcccaaccccgcgaucgagaagugcgccgagaaguacaaggccaaggucggcaaguga

SEQ ID NO: 6919 - RNA, 762 nt, Artificial Sequence
  derived and/or modified CDS sequence (opt1) from Massilia virus(127)__KT906102.1__N
augagcgaggacaacuaccgcaccaucgcccuguccuuccucgacgagaccgccgugagcacguccaucaacgcgugcgucaacgaguucgccuaccagggcuucgaccccaagcggaucgugcagcuggugaaggagcgcgggaccgccaagggccgggacuggaagaaggacgucaagaugaugaucgugcugaaccucgugcgcgggaacaagccggagagcaugaugaagaagauguccgagaagggcgccgccaucgucacccagcugaucagcaccuaccagcugaaggaggggaaccccggccgggacacgaucacccucucccgcgugagcgcggccuucgugcccuggaccguccaggcccugaagacccuguccgagagccuccccgugacgggcaccaccauggacuccaucgccgggaccacguacccgcggugcaugaugcaccccagcuucgcgggcaucaucgaccuggagcugcccaacaacaccggggccaugcucgccgacgcccacggccuguucaugcuggaguucuccaagaccaucaaccccagccuccgcaccaagcagccgaacgagaucgccgcgacguucgagaagcccaacauggccgccaugaccgggcgguucuucacccgcgacgacaagaagaagcugcugaucgccaucggcgugcucgacgaggaccugguccccaaccccgccaucgagaagugcgcggagaaguacaaggccaaggugggcaaguga

SEQ ID NO: 6920 - RNA, 762 nt, Artificial Sequence
  derived and/or modified CDS sequence (opt1) from Massilia virus(130)__KT906103.1__N
augagcgaggacaacuaccgcaccaucgcccuguccuuccucgacgagaccgccgacagcacguccaucaacgcgugcgugaacgaguucgccuaccagggcuucgaccccaagcggaucguccagcuggugaaggagcgcgggaccgccaagggccgggacuggaagaaggacgugaagaugaugaucguccugaaccucgugcgcgggaacaagccggagagcaugaugaagaagauguccgagaagggcgccgccaucgugacccagcugaucagcaccuaccagcugaaggaggggaaccccggccgggacacgaucacccucucccgcgucagcgcggccuucgugcccuggaccgugcaggcccugaagacccuguccgagagccuccccgucacgggcaccaccauggacuccaucgccgggaccacguacccgcggugcaugaugcaccccagcuucgcgggcaucaucgaccuggagcugcccaacaacaccggggccaugcucgccgacgcccacggccuguucaugcuggaguucuccaagaccaucaaccccagccuccgcaccaagcagccgaacgagaucgccgcgacguucgagaagcccaacauggccgccaugaccgggcgguucuucacccgcgacgacaagaagaagcugcugaucgccaucggcgugcucgacgaggaccuggugcccaaccccgccaucgagaagugcgcggagaaguacaaggccaaggucggcaaguga

SEQ ID NO: 6921 - RNA, 762 nt, Artificial Sequence
  derived and/or modified CDS sequence (opt1) from Naples virus(Yu 8/76)__JF920141.1__N
augagcgaggacgacuaccacaagaucgcccuggccuucgcggaggaguccgccgacgugagcaccaucgaguccugggucaacgacuucgccuaccagggcuucgacccccgccggaucgugcagcucgugaaggagcgcgggaccgccaagggccgggacuggaagaaggacgucaagaugaugaucgugcugaaccuggugcgcgggaacaagccggaggccaugaugaagaagaugagcgagaagggcgcggccaucgucgcccagcucaucuccguguaccagcugaaggaggggaaccccggccgggacacgaucacccugagccgcguguccgccgcguucguccccuggaccgugcaggcccuccgggugcugagcgaccaccuccccgucaccggcacgaccauggacgccaucgccggggugaccuacccgcgcgccaugaugcaccccuccuucgcgggcaucguggaccuggagcugccccggaagaccggggagaugaucgccgacgcccacggccuguucaugcucgaguucagcaagacgaucaaccccucccugcgcaccaagcagccgaacgagaucgccaccaccuucgagaagcccaacauggccgcgaugagcgggaaguucuucucccgggaggacaagaagaagcugcucaugagcgucggcaucaucaacgacgaccugcugcucacggccuccguggugaagugcgccgagaaguaccgcgccaagaccggcaaguga

SEQ ID NO: 6922 - RNA, 762 nt, Artificial Sequence
  derived and/or modified CDS sequence (opt1) from Punique virus(P1_B4_2008)__FJ848987.1__N
augagcgaggagaacuaccgcgagaucgcccuggccuuccucgacgaguccgcggacagcggcaccaucuccaccugggugaacgacuucgccuaccagggguucgaccccaagcggaucguccagcuggugaaggagcgcggcacggccaaggggcgggacuggaagaaggacgugaagaugaugaucguccugaaccucgugcgcggcaacaagccggagagcaugaugaagaagauguccgagaagggggccgccaucguggcgcagcugaucgccgccuaccagcugaaggagggcaaccccggccgggacaccaucacccucagccgcgucuccgccgcguucgugcccuggaccgugcaggcccugcggagccuguccgacagccuccccgucacggggaccaccauggacuccaucgccggcgugaccuacccgcgcugcaugaugcaccccagcuucgccgggaucaucgaccuggaccugcccaacgacacgggcgccaugcucgcggacgcccacgggcuguucaugcuggaguucuccaagaccaucaaccccagccuccggaccaagcaggccaacgagaucgccgccaccuucgagaagccgaacauggcggccaugaacggccgcuucuucacgcgggaggacaagaagaagcugcugaucgccaucggcgugcucaacgaggaccugauccccgucuccgccaucgccaagugcgcggagaaguaccgcgccaagguggggaaguga

SEQ ID NO: 6923 - RNA, 762 nt, Artificial Sequence
  derived and/or modified CDS sequence (opt1) from Saint Floris virus(Dak ANB512)__JF920138.1__N
augagcgaggagaccuacgcccagcuggccauggcguuccucgccgagcccgccgacugguccacccugagcgugugggucaacgaguucgccuaccagggcuucgacccgaagcgcaucguggagcugaucauggagcgggggaagaaguucaaccgcgaguggaagaaggacgugaagaugaugaucacgcucaaccugauccggggcaacaagcccgaggccaugaugcgcaagauguccgacaaggggcggagcaucgucuccgagcugaucagcguguacgagcucaaggagggcaaccccgggcgcgacaccaucacccugucccgggugagcgcggccuucguccccuggaccgugcgcgcccugguggcccuccagaacgaccugccggucacgggcgcggccauggacuccaucugcggcgugaccuacccccgggccaugaugcaccccagcuucgccggggugaucgaccuggagcuccccaacggcgucggggcccagcuggcggacgcccacggccuguucaugcucgaguucuccaagaccaucaacccggggcugcgcaccaagcagcccaacgagaucgccgccacguucgagaagcccaaccuggccgcgaugaccggcaaguucuucaccaaggaggacaagcggaaggugcucaucagcgugggcgucaucaacuccgaccugcagcccaacagcguggugaagaccugcgccgagcuguaccgcgcccgggucaugaaguga

SEQ ID NO: 6924 - RNA, 762 nt, Artificial Sequence
  derived and/or modified CDS sequence (opt1) from Tehran virus(I-47)__JF939848.1__N
augagcgaggaggacuaccgcgccaucgcccuguccuucagcgacgaguccgcggacgugggcaucaucaccaccugggucaacgaguucgccuaccagggguucgaccccaagcggaucgugcagcucgugaaggagcgcggccaggccaaggggcgggacuggaagaaggacgucaagaugaugaucgugcugaaccugauccgcggcaacaagccggacgccaugaugaagaagaugagcgagaagggggccgcgacgguggcccagcucgucuccguguaccagcugaaggagggcaaccccggccgggacaccaucacccugagccgcguguccgccgccuucguccccuggaccgugcaggcgcucaaggugcugagcgagucccugcccgucacggggaccaccauggacaccguggccggcgugacguacccgcgggccaugaugcaccccagcuucgccgggaucaucgaccucgagcugcccggccgcgccggggaggcgaucgccgacgcccacggccuguucaugcucgaguucuccaagaccaucaaccccagccugcggaccaagcagccgaacgagaucgccgccaccuucgagaagcccaacauggcggccaugacgggccgcuucuucacccgggaggacaagaagaagcugcucaucgccgucgggaucaucaacgacgaccugcugcucacccccuccaucgccaagugcgccgagaaguaccgcgcgaaggugggcaaguga

SEQ ID NO: 6925 - RNA, 762 nt, Artificial Sequence
  derived and/or modified CDS sequence (opt1) from Zerdali virus(37)__KP966618.1__N
augagcgaggaggacuaccgcgccaucgcccuguccuucagcgacgaggcggccgacgugggcaccaucaccgccugggucaacgaguucgccuaccagggguucgaccccaagcggaucgugcagcucgugcgcgagcggggcaucgccaaggggcgcgacuggaagaaggacgucaagaugaugaucgugcugaaccugauccggggcaacaagccggacgcgaugaugaagaagauguccgagaagggggccgccacgguggcccagcucgucagcguguaccagcugaaggagggcaaccccggccgcgacaccaucacccccucccgggugagcgcggccuucguccccuggaccgugcaggcccugaaggugcucuccgagagccugccggucacggggaccaccauggacaccaucgccggcguguccuacccccgcgccaugaugcaccccagcuucgcggggaucaucgaccuggagcucccccggcgcgccggcgaggugaucgccgacgcccacgggcuguucaugcuggaguucuccaagacgaucaacccgagccuccggaccaagcagcccaacgagaucgccgcgaccuucgagaagcccaacauggccgccaugaccggccgcuucuucacgcgggaggacaagaagaagcugcugaucgccgucggcaucaucaacgacgaccuccugcuggcccccuccguggcgaagugcgccgagaaguaccgcgccaagguggggaaguga

SEQ ID NO: 6926 - RNA, 762 nt, Artificial Sequence; identical to SEQ ID NO: 6909
  derived and/or modified CDS sequence (opt1) from TOSV(9028)__KU904263.1__N

SEQ ID NO: 6927 - RNA, 762 nt, Artificial Sequence
  derived and/or modified CDS sequence (opt1) from TOSV(SI-121283)__JF330274.1__N
augagcgacgagaacuaccgcgacaucgcccuggccuuccucgacgaguccgcggacagcggcaccaucaacgccugggugaacgaguucgccuaccagggguucgaccccaagcggaucguccagcuggugaaggagcgcggcaccgccaaggggcgggacuggaagaaggacgugaagaugaugaucguccugaaccucgugcgcggcaacaagccggaggccaugaugaagaagauguccgagaagggggcgagcaucguggccaaccugaucuccgucuaccagcugaaggagggcaaccccggccgggacacgaucacccucagccgcguguccgccgccuucgugcccuggaccguccaggcgcugcgggugcugagcgagucccuccccgugagcgggaccacgauggacgccaucgccggcgucaccuacccgcgcgccaugaugcaccccuccuucgccgggaucaucgaccuggaccugcccaacggcgcgggggccaccaucgccgacgcccacggccucuucaugaucgaguucagcaagaccaucaaccccucccugcggacgaagcaggccaacgagguggcggccaccuucgagaacccgaacauggccgccaugagcggccgcuucuucacccgggaggacaagaagaagcugcucaucgccguggggaucaucgacgaggaccugguccuggcguccgccguggugcgcagcgccgagaaguaccgggccaaggucggcaaguga

SEQ ID NO: 6928 - RNA, 762 nt, Artificial Sequence
  derived and/or modified CDS sequence (opt1) from TOSV(5963930705)__KU935733.1__N
augagcgacgagaacuaccgcgacaucgcccuggccuuccucgacgaguccgcggacagcggcaccaucaacgccugggugaacgaguucgccuaccagggguucgaccccaagcggaucguccagcuggugaaggagcgcggcaccgccaaggggcgggacuggaagaaggacgugaagaugaugaucguccugaaccucgugcgcggcaacaagccggaggccaugaugaagaagauguccgagaagggggcgagcaucguggccaaccugaucuccgucuaccagcugaaggagggcaaccccggccgggacacgaucacccucagccgcguguccgccgccuucgugcccuggaccguccaggcgcugcgggugcugagcgagucccuccccgugagcgggaccacgauggacgccaucgccggcgucaccuacccgcgcgccaugaugcaccccuccuucgccgggaucaucgaccuggaccugcccaacggcgcgggggccaccaucgccgacgcccacggccucuucaugguggaguucagcaagaccaucaaccccucccugcggacgaagcaggccaacgagguggcggccaccuucgagaagccgaacauggccgccaugagcggccgcuucuucacccgggaggacaagaagaagcugcucaucgccgucgggaucaucgacgaggaccuggugcuggcguccgccgugguccgcagcgccgagaaguaccgggccaaggugggcaaguga

SEQ ID NO: 6929 - RNA, 762 nt, Artificial Sequence
  derived and/or modified CDS sequence (opt1) from TOSV(MRS2010-4319501)__KC776214.1__N
augagcgacgagaacuaccgcgacaucgcccuggccuuccucgacgaguccgcggacagcggcaccaucaacgccugggugaacgaguucgccuaccagggguucgaccccaagcggaucguccagcuggugaaggagcgcggcaccgccaaggggcgggacuggaagaaggacgugaagaugaugaucguccugaaccucgugcgcggcaacaagccggaggccaugaugaagaagauguccgagaagggggcgagcaucguggccaaccugaucuccgucuaccagcugaaggagggcaaccccggccgggacacgaucacccucagccgcguguccgccgccuucgugcccuggaccguccaggcgcugcgggugcugagcgagucccuccccgugagcgggaccacgauggacgccaucgccggcgucaccuacccgcgcgccaugaugcaccccuccuucgccgggaucaucgaccugcaccuccccaacggcgcgggggccaccaucgccgacgcccacggccuguucaugaucgaguucagcaagaccaucaaccccucccugcggacgaagcaggccaacgagguggcggccaccuucgagaagccgaacauggccgccaugagcggccgcuucuucacccgggaggacaagaagaagcugcucaucgccguggggaucaucgacgaggaccugguccuggcguccgccguggugcgcagcgccgagaaguaccgggccaaggucggcaaguga

SEQ ID NO: 6930 - RNA, 762 nt, Artificial Sequence
  derived and/or modified CDS sequence (opt1) from TOSV(TOSV/Firenze.ITA/1983/2)__KM275765.1__N
augagcgacgagaacuaccgcgacaucgcccuggccuuccucgacgagugcgcggacuccggcaccaucaacgccugggugaacgaguucgccuaccagggguucgaccccaagcggaucguccagcuggugaaggagcgcggcaccgccaaggggcgggacuggaagaaggacgugaagaugaugaucguccugaaccucgugcgcggcaacaagccggaggccaugaugaagaagaugagcgagaagggggcguccaucguggccaaccugaucagcgucuaccagcugaaggagggcaaccccggccgggacacgaucacccucucccgcgugagcgccgccuucgugcccuggaccguccaggcgcugcgggugcuguccgagagccuccccguguccgggaccacgauggacgccaucgccggcgucaccuacccgcgcgccaugaugcaccccagcuucgccgggaucaucgaccuggaccugcccaacggcgcgggggccaccaucgccgacgcccacggccucuucaugaucgaguucuccaagaccaucaaccccagccugcggacgaagcaggccaacgagguggcggccaccuucgagaagccgaacauggccgccauguccggccgcuucuucacccgggaggacaagaagaagcugcucaucgccguggggaucaucgacgaggaccugguccuggcgagcgccguggugcgcuccgccgagaaguaccgggccaaggucggcaaguga

SEQ ID NO: 6931 - RNA, 738 nt, Artificial Sequence
  derived and/or modified CDS sequence (opt1) from SFTSV(HB29)__NC_018137.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcggggcgccuccaagacggagguguacaacagcuuccgcgacccccuccacgcggccgucaacuccguguucuucccgaacgacgugcgggucaaguggcugaaggccaaggggauccugggccccgacggcgugcccagccgcgccgccgagguggcggccgccgccuaccggaaccucuga

SEQ ID NO: 6932 - RNA, 738 nt, Artificial Sequence
  derived and/or modified CDS sequence (opt1) from SFTSV(111S)__KP339904.1__N
augagcgaguggucccgcaucgccguggaguucggcgagcagcagcugaaccucaccgagcuggaggacuucgcccgggagcuggcguacgaggggcucgaccgcgcccugaucaucaagaagcugaaggagaccggcggggacgacugggucaaggacacgaaguucaucaucguguucgcccucacccggggcaacaagaucgugaaggccagcgggaagauguccaacagcggcuccaagcgccugauggcccugcaggagaaguacggccucgucgagcgggcggagacccgccugagcaucacccccgugcggguggcccagucccugccgacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcgcggcgccuccaagacggagguguacaacagcuuccgggacccccuccacgcggccgucaacuccguguucuuccccaacgacgugcgcgucaaguggcugaaggccaaggggauccugggcccggacggcgugcccagccgggccgccgagguggcggccgccgccuaccgcaaccucuga

SEQ ID NO: 6933 - RNA, 738 nt, Artificial Sequence
  derived and/or modified CDS sequence (opt1) from SFTSV(116S)__KP339905.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcggggcgccuccaagacggagaucuacaacagcuuccgcgacccccuccacgcggccgugaacuccgucuucuucccgaacgacgugcgggugaaguggcugaaggccaaggggauccugggccccgacggcguccccagccgcgccgccgagguggcggccgccgccuaccggaaccucuga

SEQ ID NO: 6934 - RNA, 738 nt, Artificial Sequence
  derived and/or modified CDS sequence (opt1) from SFTSV(132S)__KP339912.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucagcguguucgcccucacccgcggcaacaagaucgugaaggccuccgggaagaugagcaacuccggcagcaagcggcugauggcccugcaggagaaguacggccucgucgagcgcgcggagacccggcuguccaucaccccggugcgcguggcccagagccugcccacguggaccugcgccgccgcggccgcccucaaggaguaccugcccgucgggcccgccgugaugaaccugaagguggagaacuacccgcccgagaugaugugcauggccuucggcucccucauccccaccgcgggggucagcgaggccaccacgaagacccugauggaggccuacucccuguggcaggacgccuucaccaagaccaucaacgugaagaugcggggcgccagcaagacggagguguacaacuccuuccgcgacccccuccacgcggccgucaacagcguguucuucccgaacgacgugcgggucaaguggcugaaggccaaggggauccugggccccgacggcgugcccucccgcgccgccgagguggcggccgccgccuaccggaaccucuga

SEQ ID NO: 6935 - RNA, 738 nt, Artificial Sequence
  derived and/or modified CDS sequence (opt1) from SFTSV(2014045S)__KR075923.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcggggcgccuccaagacggagguguacaacagcuuccgcgacccccuccacgcggccgucaacuccguguucuucccgaacgacgugcgggucaaguggcugaaggccaaggggauccugggccccgacggcgcccccagccgcgccgcggagguggccgccgccgccuaccggaaccucuga

SEQ ID NO: 6936 - RNA, 738 nt, Artificial Sequence
  derived and/or modified CDS sequence (opt1) from SFTSV(2014193S)__KR075916.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcgugaccccggugcgcgucgcccagucccugcccacguggaccugcgccgccgcggccgcccucaaggaguaccugcccguggggcccgccgugaugaaccugaaggucgagaacuacccgcccgagaugaugugcauggccuucggcagccucauccccaccgcggggguguccgaggccaccacgaagacccugauggaggccuacagccuguggcaggacgccuucaccaagaccaucaacgugaagaugcggggcgccuccaagacggaggucuacaacagcuuccgcgacccccuccacgcggccgugaacuccguguucuucccgaacgacguccgggugaaguggcugaaggccaaggggauccugggccccgacggcgugcccagccgcgccgccgaggucgcggccgccgccuaccggaaccucuga

SEQ ID NO: 6937 - RNA, 738 nt, Artificial Sequence
  derived and/or modified CDS sequence (opt1) from SFTSV(2015SH232S)__KT736097.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcggggcgccuccaagacggagguguacaacagcuuccgcgacccccuccacgcggccgucaacuccguguucuucccgaacgacgugcggguccgcuggcugaaggccaaggggauccugggccccgacggcgugcccagccgggccgccgagguggcggccgccgccuaccgcaaccucuga

SEQ ID NO: 6938 - RNA, 738 nt, Artificial Sequence
  derived and/or modified CDS sequence (opt1) from SFTSV(2015SYSH33)__KT380653.1__N
augagcgaguggucccgcaucgccguggaguucggcgagcagcagcucaaccugaccgagcuggaggacuucgcccgggagcucgcguacgaggggcuggaccccgcccugaucaucaagaagcucaaggagaccggcggggacgacugggucaaggacacgaaguucaucaucguguucgcccugacccgcggcaacaagaucgugaaggccagcgggaagauguccaacagcggcuccaagcggcugauggcccuccaggagaaguacggccuggucgagcgcgcggagacccggcugagcaucaccccggugcgcguggcccagucccuccccacguggaccugcgccgccgcggccgcccugaaggaguaccugcccgucgggcccgccgugaugaaccucaagguggagaacuacccgcccgagaugaugugcauggccuucggcagccugauccccaccgcgggggucuccgaggccaccacgaagacccugauggaggccuacagccucuggcaggacgccuucaccaagaccaucaacgugaagaugcggggcgccuccaagacggagguguacaacagcuuccgcgacccccugcacgcggccgucaacuccguguucuucccgaacgacgugcgggucaaguggcugaaggccaaggggauccucggccccgacggcgugcccagccgcgccgccgagguggcggccgccgccuaccggaaccuguga

SEQ ID NO: 6939 - RNA, 738 nt, Artificial Sequence
  derived and/or modified CDS sequence (opt1) from SFTSV(2015SYSH86)__KT380657.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucaucaaggccagcgggaagauguccaacagcggcuccaagcggcugauggcccugcaggagaaguacggccucguggagcgcgcggagacccggcugagcaucaccccgguccgcguggcccagucccugcccacguggaccugcgccgccgcggccgcccucaaggaguaccugcccguggggcccgccgucaugaaccugaagguggagaacuacccgcccgagaugaugugcauggccuucggcagccucauccccaccgcggggguguccgaggccaccacgaagacccugauggaggccuacagccuguggcaggacgccuucaccaagaccaucaacgucaagaugcggggcgccuccaagacggagguguacaacagcuuccgcgacccccuccacgcggccgugaacuccgucuucuucccgaacgacgugcgggugaaguggcugaaggccaaggggauccugggccccgacggcguccccagccgcgccgccgagguggcggccgccgccuaccggaaccucuga

SEQ ID NO: 6940 - RNA, 738 nt, Artificial Sequence
  derived and/or modified CDS sequence (opt1) from SFTSV(67S)__KP339890.1__N
augagcgaguggucccgcaucgccguggaguucgccgagcagcagcugaaccucaccgagcuggaggacuucgcgcgggagcuggccuacgagggccucgaccccgcccugaucaucaagaagcugaaggagaccgggggcgacgacugggucaaggacacgaaguucaucaucguguucgcccucacccgcgggaacaagaucgugaaggccagcggcaagauguccaacagcggguccaagcggcugauggcgcugcaggagaaguacggccucgucgagcgcgccgagacccggcugagcaucaccccggugcgcguggcccagucccugcccacguggaccugcgccgcggccgccgcccucaaggaguaccugcccgucggccccgccgugaugaaccugaagguggagaacuacccgcccgagaugaugugcauggcguucgggagccucauccccaccgccggcgucuccgaggccaccacgaagacccugauggaggccuacagccuguggcaggacgccuucaccaagaccaucaacgugaagaugcgcggggcguccaagacggagguguacaacagcuuccgggacccccuccacgccgccgucaacuccguguucuucccgaacgacgugcgggucaaguggcugaaggccaagggcauccuggggcccgacggcgugcccagccgcgccgcggagguggccgccgccgccuaccggaaccucuga

SEQ ID NO: 6941 - RNA, 738 nt, Artificial Sequence
  derived and/or modified CDS sequence (opt1) from SFTSV(6S)__KP339927.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccgguucagcaucaccccggugcgcguggcccagucccugcccacguggaccugcgccgccgcggccgcccugaaggaguaccuccccgucgggcccgccgugaugaaccugaagguggagaacuacccgcccgagaugaugugcauggccuucggcagccugauccccaccgcgggggucuccgaggccaccacgaagacccucauggaggccuacagccuguggcaggacgccuucaccaagaccaucaacgugaagaugcggggcgccuccaagacggagguguacaacagcuuccgcgacccccugcacgcggccgucaacuccguguucuucccgaacgacgugcgggucaaguggcucaaggccaaggggauccugggccccgacggcgugcccagccgcgccgccgagguggcggccgccgccuaccggaaccuguga

SEQ ID NO: 6942 - RNA, 738 nt, Artificial Sequence
  derived and/or modified CDS sequence (opt1) from SFTSV(72S)__KP339891.1__N
augagcgaguggucccgcaucgccguggaguucggcgagcagcagcugacccucaccgagcuggaggacuucgcccgggagcuggcguacgaggggcucgaccccgcccugaucaucaagaagcugaaggagacgggcggggacgacugggucaaggacaccaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucacgccggugcgcguggcccagucccugcccaccuggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccacgaccaagacccugauggaggccuacagccuguggcaggacgccuucaccaagacgaucaacgugaagaugcggggcgccuccaagaccgagguguacaacagcuuccgcgacccccuccacgcggccgucaacuccguguucuucccgaacgacgugcggguccgcuggcugaaggccaaggggauccugggccccgacggcgugcccagccgggccgccgagguggcggccgccgccuaccgcaaccucuga

SEQ ID NO: 6943 - RNA, 738 nt, Artificial Sequence
  derived and/or modified CDS sequence (opt1) from SFTSV(AP01-Korea-13)__KR612072.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacuggguccgcgacacgaaguucaucaucguguucgcccucacccggggcaacaagaucgugaaggccagcgggaagauguccaacagcggcuccaagcgccugauggcccugcaggagaaguacggccucgucgagcgggcggagacccgccugagcaucaccccggugcggguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcgcggcgccuccaagacggagguguacaacagcuuccgggacccccuccacgcggccgucaacuccguguucuucccgaacgacgugcgcgucaaguggcugaaggccaaggggauccugggccccgacggcgugcccagccgggccgccgagguggcggccgccgccuaccgcaaccucuga

SEQ ID NO: 6944 - RNA, 738 nt, Artificial Sequence
  derived and/or modified CDS sequence (opt1) from SFTSV(JP03-Korea-13)__KR612079.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacuggguccgcgacacgaaguucaucaucguguucgcccucacccggggcaacaagaucgugaaggccagcgggaagauguccaacagcggcuccaagcgccugauggcccugcaggagaaguacggccucgucgagcgggcggagacccgccugagcaucaccccggugcggguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcgcggcgccuccaagacggagguguacaacagcuuccgggacccccuccacgcggccgucaacuccguguucuucccgaacgacgugcgcgucaaguggcugaaggccaaggggauccugggccccgacggcauccccagccgggccgccgagguggcggccgccgccuaccgcaaccucuga

SEQ ID NO: 6945 - RNA, 738 nt, Artificial Sequence
  derived and/or modified CDS sequence (opt1) from SFTSV(JP07-Korea-13)__KR612088.1__N
augagcgaguggucccgcaucgccguggaguucggcgagcaccagcugaaccucaccgagcuggaggacuucgcccgggagcuggcguacgaggggcucgaccccgcccugaucaucaagaagcugaaggagaccggcggggacgacuggguccgcgacacgaaguucaucaucguguucgcccucacccggggcaacaagaucgugaaggccagcgggaagauguccaacagcggcuccaagcgccugauggcccugcaggagaaguacggccucgucgagcgggcggagacccgccugagcaucaccccggugcggguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcgcggcgccuccaagacggagguguacaacagcuuccgggacccccuccacgcggccgucaacuccguguucuucccgaacgacgugcgcgucaaguggcugaaggccaaggggauccugggccccgacggcgugcccagccgggccgccgagguggcggccgccgccuaccgcaaccucuga

SEQ ID NO: 6946 - RNA, 738 nt, Artificial Sequence
  derived and/or modified CDS sequence (opt1) from SFTSV(JS2011-13-2)__KR230790.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccagcuccggcagcaagcggcugauggcccugcaggagaaguacggccucgucgagcgcgcggagacccggcuguccaucaccccggugcgcguggcccagagccugcccacguggaccugcgccgccgcggccgcccucaaggaguaccugcccgucgggcccgccgugaugaaccugaagguggagaacuacccgcccgagaugaugugcauggccuucggcucccucauccccaccgcgggggucagcgaggccaccacgaagacccugauggaggccuacucccuguggcaggacgccuucaccaagaccaucaacgugaagaugcggggcgccagcaagacggagguguacaacuccuuccgcgacccccuccacgcggccgucaacagcguguucuucccgaacgacgugcgggucaaguggcugaaggccaaggggauccugggccccgacggcgugcccucccgcgccgccgagguggcggccgccgccuaccggaaccucuga

SEQ ID NO: 6947 - RNA, 738 nt, Artificial Sequence
  derived and/or modified CDS sequence (opt1) from SFTSV(JS2014-15)__KR230799.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucaccccggugcgcguggcccagucccugcccacguggaccugcgccgccgcggccgcccucaaggaguaccugcuggucgggcccgccgugaugaaccucaagguggagaacuacccgcccgagaugaugugcauggccuucggcagccugauccccaccgcgggggucuccgaggccaccacgaagacccugauggaggccuacagccucuggcaggacgccuucaccaagaccaucaacgugaagaugcggggcgccuccaagacggagguguacaacagcuuccgcgacccccugcacgcggccgucaacuccguguucuuccccaacgacgugcgggucaaguggcugaaggccaaggggauccucggcccggacggcgugcccagccgcgccgccgagguggcggccgccgccuaccggaaccuguga

SEQ ID NO: 6948 - RNA, 738 nt, Artificial Sequence
  derived and/or modified CDS sequence (opt1) from SFTSV(KASJH)__KP663733.1__N
augagcgaguggucccgcaucgccguggaguucggcgagcagcagcugaaccucagcgagcuggaggacuucgcccgggagcuggcguacgaggggcucgaccccgcccugaucaucaagaagcugaaggagaccggcggggacgacugggucaaggacaccaaguucaucaucguguucgcccucacgcgcggcaacaagaucgugaaggccuccgggaagaugagcaacuccggcagcaagcggcugauggcccugcaggagaaguacggccucgucgagcgcgcggagacccggcuguccaucaccccggugcgcguggcccagagccugcccaccuggacgugcgccgccgcggccgcccucaaggaguaccugcccgucgggcccgccgugaugaaccugaagguggagaacuacccgcccgagaugaugugcauggccuucggcucccucauccccaccgcgggggucagcgaggccaccaccaagacgcugauggaggccuacucccuguggcaggacgccuucaccaagaccaucaacgugaagaugcggggcgccagcaagaccgagguguacaacuccuuccgcgacccccuccacgcggccgucaacagcguguucuucccgaacgacgugcgggucaaguggcugaaggccaaggggauccugggccccgacggcgugcccucccgcgccgccgagguggcggccgccgccuaccggaaccucuga

SEQ ID NO: 6949 - RNA, 738 nt, Artificial Sequence
  derived and/or modified CDS sequence (opt1) from SFTSV(YSH116)__KT721303.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacguguucaccaagaccaucaacgugaagaugcggggcgccuccaagacggaggucuacaacagcuuccgcgacccccuccacgccgcggugaacuccguguucuucccgaacgacguccgggugaaguggcugaaggccaaggggauccugggccccgacggcgugcccagccgcgccgccgaggucgccgcggccgccuaccggaaccucuga

SEQ ID NO: 6950 - RNA, 738 nt, Artificial Sequence
  derived and/or modified CDS sequence (opt1) from SFTSV(AH-YTY/China/05/2012)__KR017811.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccaccggggucuccgaggcgacgaccaagacccugauggaggccuacagccuguggcaggacgccuucaccaagacgaucaacgugaagaugcggggcgccuccaagaccgagguguacaacagcuuccgcgacccccuccacgccgcggucaacuccguguucuucccgaacgacgugcgggucaaguggcugaaggccaaggggauccugggccccgacggcgugcccagccgcgccgccgagguggccgcggccgccuaccggaaccucuga

SEQ ID NO: 6951 - RNA, 738 nt, Artificial Sequence
  derived and/or modified CDS sequence (opt1) from SFTSV(DS02/CHN/2013)__KR698319.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacuggguccgcgacacgaaguucaucaucguguucgcccucacccggggcaacaagaucgugaaggccagcgggaagauguccaacagcggcuccaagcgccugauggcccugcaggagaaguacggccucgucgagaaggcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcggggcgccuccaagacggagguguacaacagcuuccgcgacccccuccacgcggccgucaacuccguguucuucccgaacgacgugcgggucaaguggcugaaggccaaggggauccugggccccgacggcgugcccagccgcgccgccgagguggcggccgccgccuaccggaaccucuga

SEQ ID NO: 6952 - RNA, 738 nt, Artificial Sequence
  derived and/or modified CDS sequence (opt1) from SFTSV(HB2014-13)__KU738908.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccaccggggucuccgaggcgacgaccaagacccugauggaggccuacagccuguggcaggacgccuucaccaagacgaucaacgugaagaugcggggcgccuccaagaccgagguguacaacagcuuccgcgacccccuccacgccgcggucaacuccguguucuucccgaacgacgugcggguccgcuggcugaaggccaaggggauccugggccccgacggcgugcccagccgggccgccgagguggccgcggccgccuaccgcaaccucuga

SEQ ID NO: 6953 - RNA, 738 nt, Artificial Sequence
  derived and/or modified CDS sequence (opt1) from SFTSV(HB2014-20)__KU738910.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugaugacccugcaggagaaguacggccucgucgagcgcgccgagacccggcugagcaucacgccggugcgcguggcgcagucccugcccaccuggaccugcgccgccgccgcggcccucaaggaguaccugcccgucgggcccgccgugaugaaccugaagguggagaacuacccgcccgagaugaugugcauggccuucggcagccucauccccaccgccggggucuccgaggcgacgaccaagacccugauggaggccuacagccuguggcaggacgccuucaccaagacgaucaacgugaagaugcggggcgccuccaagaccgagguguacaacagcuuccgcgacccccuccacgccgcggucaacuccguguucuucccgaacgacgugcgggucaaguggcugaaggccaaggggauccugggccccgacggcgugcccagccgcgccgccgagguggccgcggccgccuaccggaaccucuga

SEQ ID NO: 6954 - RNA, 738 nt, Artificial Sequence
  derived and/or modified CDS sequence (opt1) from SFTSV(LN2012-14)__KF887431.1__N
augagcgagcgcucccggaucgccguggaguucggcgagcagcagcugaaccucaccgggcuggaggacuucgcccgcgagcuggcguacgagggccucgaccccgcccugaucaucaagaagcugaaggagaccgggggcgacgacugggucaaggacacgaaguucaucaucguguucgcccucacccgggggaacaagaucgugaaggccagcggcaagauguccaacagcggcuccaagcgccugauggcccugcaggagaaguacgggcucgucgagcgggcggagacccgccugagcaucaccccggugcggguggcccagucccugcccacguggaccugcgccgccgcggccgcccucaaggaguaccugcccgucggccccgccgugaugaaccugaagguggagaacuacccgcccgagaugaugugcauggccuucgggagccucauccccaccgcgggcgucuccgaggccaccacgcgcacccugauggaggccuacagccuguggcaggacgccuucaccaagaccaucaacgugaagaugcgcggggccuccaagacggagguguacaacagcuuccgggacccccuccacgcggccgucaacuccguguucuucccgaacgacgugcgggucaaguggcugaaggccaagggcauccugggccccgacggggugcccagccgcgccgccgagguggcggccgccgccuaccggaaccucuga

SEQ ID NO: 6955 - RNA, 738 nt, Artificial Sequence
  derived and/or modified CDS sequence (opt1) from SFTSV(NB31/CHN/2013)__KR698325.1__N
augagcgaguggucccgcaucgccguggaguucggcgagcagcagcugaaccucaucgagcuggaggacuucgcccgggagcuggcguacgaggggcucgaccccgcccugaucaucaagaagcugaaggagaccggcggggacgacuggguccgcgacaccaaguucaucaucguguucgcccucacgcggggcaacaagaucgugaaggccagcgggaagauguccaacagcggcuccaagcgccugauggcccugcaggagaaguacggccucgucgagaaggcggagacccggcugagcaucaccccggugcgcguggcccagucccugcccaccuggacgugcgccgccgcggccgcccucaaggaguaccugcccgucgggcccgccgugaugaaccugaagguggagaacuacccgcccgagaugaugugcauggccuucggcagccucauccccaccgcgggggucuccaagcccaccaccaagacgcugauggaggccuacagccuguggcaggacgccuucaccaagaccaucaacgugaagaugcggggcgccuccaagaccgagguguacaacagcuuccgcgacccgcuccacgccgcggucaacuccguguucuuccccaacgacgugcgggucaaguggcugaaggccaaggggauccugggccccgacggcgugcccagccgcgccgccgagguggccgcggccgccuaccggaaccucuga

SEQ ID NO: 6956 - RNA, 738 nt, Artificial Sequence
  derived and/or modified CDS sequence (opt1) from SFTSV(QD7)__KR706565.1__N
augagcgaguggucccgcaucgccguggaguucggcguccagcagcugaaccucaccgagcuggaggacuucgcccgggagcuggcguacgaggggcucgaccccgcccugaucaucaagaagcugaaggagaccggcggggacgacugggugaaggacacgaaguucaucaucguguucgcccucacccgcggcaacaagaucgucaaggccagcgggaagauguccaacagcggcuccaagcggcugauggcccugcaggagaaguacggccucguggagcgcgcggagacccggcugagcaucaccccggugcgcgucgcccagucccugcccacguggaccugcgccgccgcggccgcccucaaggaguaccugcccguggggcccgccgugaugaaccugaaggucgagaacuacccgcccgagaugaugugcauggccuucggcagccucauccccaccgcggggguguccgaggccaccacgaagacccugauggaggccuacagccuguggcaggacgccuucaccaagaccaucaacgugaagaugcggggcgccuccaagacggaggucuacaacagcuuccgcgacccccuccacgcggccgugaacuccguguucuucccgaacgacguccgggugaaguggcugaaggccaaggggauccugggccccgacggcgugcccagccgcgccgccgaggucgcggccgccgccuaccggaaccucuga

SEQ ID NO: 6957 - RNA, 738 nt, Artificial Sequence
  derived and/or modified CDS sequence (opt1) from SFTSV(SDLZP06/2011)__JQ693009.1__N
augagcgaguggucccgcaccgccguggaguucggcgagcagcagcugaaccucaccgagcuggaggacuucgcccgggagcuggcguacgaggggcucgaccccgcccugaucaucaagaagcugaaggagacgggcggggacgacugggucaaggacaccaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucacgccggugcgcguggcccagucccugcccaccuggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccacgaccaagacccugauggaggccuacagccuguggcaggacgccuucaccaagacgaucaacgugaagaugcggggcgccuccaagaccgagguguacaacagcuuccgcgacccccuccacgcggccgucaacuccguguucuucccgaacgacgugcgggucaaguggcugaaggccaaggggauccugggccccgacggcgugcccagccgcgccgccgagguggcggccgccgccuaccggaaccucuga

SEQ ID NO: 6958 - RNA, 738 nt, Artificial Sequence
  derived and/or modified CDS sequence (opt1) from SFTSV(ZJZHSH-FDE/China/06/2012)__KR017821.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacuggguccgcgacacgaaguucaucaucguguucgcccucacccggggcaacaagaucgugaaggccagcgggaagauguccaacagcggcuccaagcgccugauggcccugcaggagaaguacggccucgucgagaaggcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcggggcgccuccaagacggagguguacaacagcuuccgcgacccccuccacgcggccgucaacuccgugcuguucccgaacgacgugcgggucaaguggcugaaggccaaggggauccucggccccgacggcgugcccagccgcgccgccgagguggcggccgccgccuaccggaaccuguga

SEQ ID NO: 6959 - RNA, 738 nt, Artificial Sequence
  derived and/or modified CDS sequence (opt1) from SFTSV(ZJZHSH-FZHR/China/07/2013)__KR017824.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacuggaugaaggacacgaaguucaucaucgucuucgcccucacccgcggcaacaagaucgugaaggccagcgggaagauguccaacagcggcuccaagcggcugauggcccugcaggagaaguacggccucguggagcgcgcggagacccggcugagcaucaccccgguccgcguggcccagucccugcccacguggaccugcgccgccgcggccgcccucaaggaguaccugcccguggggcccgccgucaugaaccugaagguggagaacuacccgcccgagaugaugugcauggccuucggcagccucauccccaccgcggggguguccgaggccaccacgaagacccugauggaggccuacagccuguggcaggacgccuucaccaagaccaucaacgucaagaugcggggcgccuccaagacggagguguacaacagcuuccgcgacccccuccacgcggccgugaacuccgucuucuucccgaacgacgugcgggugaaguggcugaaggccaaggggauccugggccccgacggcguccccagccgcgccgccgagguggcggccgccgccuaccggaaccucuga

SEQ ID NO: 6960 - RNA, 738 nt, Artificial Sequence
  derived and/or modified CDS sequence (opt1) from SFTSV(ZJZHSH-HYC/China/05/2012)__KR017809.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacuggguccgcgacacgaaguucaucaucguguucgcccucacccggggcaacaagaucgugaaggccagcgggaagauguccaacagcggcuccaagcgccugauggcccugcaggagaaguacggccucgucgagaaggcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgucgggguguccgaggcgaccacgaagacccugauggaggccuacagccuguggcaggacgccuucaccaagaccaucaacgugaagaugcggggcgccuccaagacggaggucuacaacagcuuccgcgacccccuccacgccgcggugaacuccguguucuucccgaacgacguccgggugaaguggcugaaggccaaggggauccugggccccgacggcgugcccagccgcgccgccgaggucgccgcggccgccuaccggaaccucuga

SEQ ID NO: 6961 - RNA, 738 nt, Artificial Sequence
  derived and/or modified CDS sequence (opt1) from SFTSV(SPL003A)__AB817996.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacuggguccgcgacacgaaguucaucaucguguucgcccucacccggggcaacaagaucgugaaggccagcgggaagauguccaacagcggcuccaagcgccugauggcccugcaggagaaguacggccucgucgagcgggcggagacccgccugagcaucaccccggugcggguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcgcggcgccuccaagacggagguguacaacagcuuccgggacccccuccacgcggccgucaacuccguguucuucccgaacgacgugcgcgucaaguggcugaaggccaaggggauccugggccccgacggcgcccccagccgggccgcggagguggccgccgccgccuaccgcaaccucuga

SEQ ID NO: 6962 - RNA, 738 nt, Artificial Sequence
  derived and/or modified CDS sequence (opt1) from SFTSV(SPL077A)__AB985536.1__N
augagcgaguggccccgcaucgccguggaguucggcgagcagcagcugaaccucaccgagcuggaggacuucgcccgggagcuggcguacgaggggcucgacccggcccugaucaucaagaagcugaaggagaccggcggggacgacuggguccgcgacacgaaguucaucaucguguucgcccucacccggggcaacaagaucgugaaggccuccgggaagaugagcaacuccggcagcaagcgccugauggcccugcaggagaaguacggccucgucgagcgggcggagacccgccuguccaucacccccgugcggguggcccagagccugcccacguggaccugcgccgccgcggccgcccucaaggaguaccugcccgucgggccggccgugaugaaccugaagguggagaacuacccgcccgagaugaugugcauggccuucggcucccucauccccaccgcgggggucagcgaggccaccacgaagacccugauggaggccuacucccuguggcaggacgccuucaccaagaccaucaacgugaagaugcgcggcgccagcaagacggagguguacaacuccuuccgggacccccuccacgcggccgucaacagcguguucuuccccaacgacgugcgcgucaaguggcugaaggccaaggggauccugggccccgacggcgugcccucccgggccgccgagguggcggccgccgccuaccgcaaccucuga

SEQ ID NO: 6963 - RNA, 738 nt, Artificial Sequence
  derived and/or modified CDS sequence (opt1) from SFTSV(SPL106A)__AB985548.1__N
augagcgacuggucccgcaucgccguggaguucggcgagcagcagcugaaccucaccgagcuggaggacuucgcccgggagcuggcguacgaggggcucgaccccgcccugaucaucaagaagcugaaggagaccggcggggacgacuggguccgcgacacgaaguucaucaucguguucgcccucacccggggcaacaagaucgugaaggccagcgggaagauguccaacagcggcuccaagcgccugauggcccugcaggagaaguacggccucgucgagcgggcggagacccgccugagcaucaccccggugcggguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcgcggcgccuccaagacggagguguacaacagcuuccgggacccccuccacgcggccgucaacuccguguucuucccgaacgacgugcgcgucaaguggcugaaggccaaggggauccugggccccgacggcgugcccagccgggccgccgagguggcggccgccgccuaccgcaaccucuga

SEQ ID NO: 6964 - RNA, 738 nt, Artificial Sequence
  derived and/or modified CDS sequence (opt1) from SFTSV(SPL114A)__AB985552.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacuggguccgcgacacgaaguucaucaucguguucgcccucacccggggcaacaagaucgugaaggccccggggaagaugagcaacuccggcagcaagcgccugauggcccugcaggagaaguacggccucgucgagcgggcggagacccgccuguccaucacccccgugcggguggcccagagccugcccacguggaccugcgccgccgcggccgcccucaaggaguaccugcccgucgggccggccgugaugaaccugaagguggagaacuacccgcccgagaugaugugcauggccuucggcucccucauccccaccgcgggggucagcgaggccaccacgaagacccugauggaggccuacucccuguggcaggacgccuucaccaagaccaucaacgugaagaugcgcggcgccagcaagacggagguguacaacuccuuccgggacccccuccacgcggccgucaacagcguguucuuccccaacgacgugcgcgucaaguggcugaaggccaaggggauccugggccccgacggcgugcccucccgggccgccgagguggcggccgccgccuaccgcaaccucuga

SEQ ID NO: 6965 - RNA, 738 nt, Artificial Sequence
  derived and/or modified CDS sequence (opt1) from SFTSV(SPL125A)__AB985557.1__N
augagcgagugguccggcguggccgucgaguucggggagcagcagcugaaccucaccgagcuggaggacuucgcccgcgagcuggcguacgagggccucgaccccgcccugaucaucaagaagcugaaggagaccgggggcgacgacugggugcgggacacgaaguucaucaucguguucgcccucacccgcgggaacaagaucgucaaggccagcggcaagauguccaacagcggcuccaagcggcugauggcccugcaggagaaguacgggcucguggagcgcgcggagacccggcugagcaucaccccggugcgcgucgcccagucccugcccacguggaccugcgccgccgcggccgcccucaaggaguaccugcccgugggccccgccgugaugaaccugaaggucgagaacuacccgcccgagaugaugugcauggccuucgggagccucauccccaccgcgggcguguccgaggccaccacgaagacccugauggaggccuacagccuguggcaggacgccuucaccaagaccaucaacgugaagaugcgcggggccuccaagacggaggucuacaacagcuuccgggacccccuccacgcggccgugaacuccguguucuucccgaacgacguccgggugaaguggcugaaggccaagggcauccugggccccgacggggugcccagccgcgccgccgaggucgcggccgccgccuaccggaaccucuga

SEQ ID NO: 6966 - RNA, 738 nt, Artificial Sequence
  derived and/or modified CDS sequence (opt1) from SFTSV(SPL160A)__AB985571.1__N
augagcgaguggucccgcaucgccguggaguucggcgagcagcagcugaaccucaccgagcuggaggacuucgcccgggagcuggcguacgaggggcucgaccccgcccugaucaucaccaagcugaaggagacgggcggggacgacuggguccgcgacaccaaguucaucaucguguucgcccucacccggggcaacaagaucgugaaggccagcgggaagauguccaacagcggcuccaagcgccugauggcccugcaggagaaguacggccucgucgagcgggcggagacccgccugagcaucacgccggugcggguggcccagucccugcccaccuggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccacgaccaagacccugauggaggccuacagccuguggcaggacgccuucaccaagacgaucaacgugaagaugcgcggcgccuccaagaccgagguguacaacagcuuccgggacccccuccacgcggccgucaacuccguguucuucccgaacgacgugcgcgucaaguggcugaaggccaaggggauccugggccccgacggcgugcccagccgggccgccgagguggcggccgccgccuaccgcaaccucuga

SEQ ID NO: 6967 - RNA, 738 nt, Artificial Sequence
  derived and/or modified CDS sequence (opt1) from SFTSV(SPL163A)__AB985573.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacuggguccgcgacacgaaguucaucaucguguucccgcucacccggggcaacaagaucgugaaggccagcgggaagauguccaacagcggcuccaagcgccugauggcccugcaggagaaguacggccucgucgagcgggccgagacccgccugagcaucacccccgugcggguggcgcagucccugcccacguggaccugcgccgccgccgcggcccucaaggaguaccugcccgucgggccggccgugaugaaccugaagguggagaacuacccgcccgagaugaugugcauggccuucggcagccucauccccaccgccggggucuccgaggcgaccacgaagacccugauggaggccuacagccuguggcaggacgccuucaccaagaccaucaacgugaagaugcgcggcgccuccaagacggagguguacaacagcuuccgggacccccuccacgccgcggucaacuccguguucuuccccaacgacgugcgcgucaaguggcugaaggccaaggggauccugggccccgacggcgugcccagccgggccgccgagguggccgcggccgccuaccgcaaccucuga

SEQ ID NO: 6968 - RNA, 738 nt, Artificial Sequence
  derived and/or modified CDS sequence (opt1) from SFTSV/FTLSV(2011YPQ12)__KF711915.1__N
augagcaaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcgaagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcggggcgccuccaagacggagguguacaacagcuuccgcgacccccuccacgcggccgucaacuccguguucuucccgaacgacgugcgggucaaguggcugaaggccaaggggauccugggccccgacggcgugcccagcaaggccgccgagguggcggccgccgccuaccgcaaccucuga

SEQ ID NO: 6969 - RNA, 738 nt, Artificial Sequence
  derived and/or modified CDS sequence (opt1) from SFTSV/FTLSV(2011YXX9)__KF711898.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugguggaggccuacagccuguggcaggacgccuucaccaagaccaucaacgugaagaugcggggcgccuccaagacggaggucuacaacagcuuccgcgacccccuccacgcggccgugaacuccguguucuucccgaacgacguccgggugaaguggcugaaggccaaggggauccugggccccgacggcgugcccagccgcgccgccgaggucgcggccgccgccuaccggaaccucuga

SEQ ID NO: 6970 - RNA, 738 nt, Artificial Sequence
  derived and/or modified CDS sequence (opt1) from SFTSV/FTLSV(YPQ2)__KF356519.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcggggcgccuccaagacggagguguacaacagcuuccgcgacccccuccacgcggccgucaacuccguguucuucccgaacgacgugcgggucaaguggcugaaggccaaggggauccugggccccaacggcgugcccagccgcgccgccgagguggcggccgccgccuaccggaaccucuga

SEQ ID NO: 6971 - RNA, 738 nt, Artificial Sequence
  derived and/or modified CDS sequence (opt1) from SFTSV/Guertu virus(DXM)__KT328591.1__N
augagcgagugguccaagaucgccguggaguucggcgagcagcagcugaacgucaucgagcucgaggaguucgcccgcgagcuggcguacgaggggcuggaccccgcccucaucaucaagaagcugaaggaggugggcggggacgacuggaugcgggacaccaaguucaucaucguguucgcccugacccgcggcaacaagauccucaaggccgccgggaagaugagcaacuccggcagcaagcggaucauggcgcugcaggagaaguacggccuggucgagcgcgccgagacgcggcucuccaucaccccggugcgcguggcccagagccugcccaccuggaccugcuccgccgcggccgcccugcaggaguaccuccccgucgggcccgccgugaugagccugaagguguccaacuucccgcccgagaugaugugcauggccuucggcagccugauccccgcgacggggguccccgaguccaccaccaagauccucauggaggccuacagccuguggcaggacgccuucaccaagacgaucaacgugaagaugcggggcgccuccaaggccgagguguacaacagcuuccgcgacccgcugcacgcggccgucaacuccguguucuuccccaacgacgugcggcuccgcuggcucaagagcaaggggauccugggccccgacggccugcccuccaaggccgucgagaccgccgccgcggccuaccggaaccuguga

SEQ ID NO: 6972 - RNA, 738 nt, Artificial Sequence
  derived and/or modified CDS sequence (opt1) from SFTSV/Huaiyangshan virus(2010-FQM)__HQ419240.1__N
augagcgaguggucccgcaucgccgugaaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcggggcgccuccaagacggagguguacaacagcuuccgcgacccccuccacgcggccgucaacuccguguuccugccgaacgacgugcgggucaaguggcugaaggccaaggggauccucggccccgacggcgugcccagccgcgccgccgagguggcggccgccgccuaccggaaccuguga

SEQ ID NO: 6973 - RNA, 738 nt, Artificial Sequence
  derived and/or modified CDS sequence (opt1) from SFTSV/Huaiyangshan virus(2010-ZGQ)__HQ419241.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugaugagccugcaggagaaguacggccucgucgagcgcgccgagacccggcuguccaucaccccggugcgcguggcgcagagccugcccacguggaccugcgccgccgccgcggcccucaaggaguaccugcccgucgggcccgccgugaugaaccugaagguggagaacuacccgcccgagaugaugugcauggccuucggcucccucauccccaccgccggggucagcgaggcgaccacgcggacccugauggaggccuacucccuguggcaggacgccuucaccaagaccaucaacgugaagaugcgcggcgccagcaagacggagguguacaacuccuuccgggacccccuccacgccgcggucaacagcguguucuucccgaacgacgugcgcgucaaguggcugaaggccaaggggauccugggccccgacggcgugcccucccgggccgccgagguggccgcggccgccuaccgcaaccucuga

SEQ ID NO: 6974 - RNA, 738 nt, Artificial Sequence
  derived and/or modified CDS sequence (opt1) from SFTSV/Huaiyangshan virus(S-HGX)__HQ171192.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucaccccggugcgcguggcccagucccugcccacguggaccugcaccgccgccgcggcccucaaggaguaccugcccgucgggcccgccgugaugaaccugaagguggagaacuacccgcccgagaugaugugcauggccuucgagagccucauccccaccgccggcgucuccgaggcgacgaccaagacccugauggaggccuacagccuguggcaggacgccuucaccaagacgaucaacguggagaugcgcggggccuccaagaccgagguguacaacagcuuccgggacccccuccacgccgcggucaacuccguguucuucccgaacgacgugcgggucaaguggcugaaggccaagggcauccuggggcccgacggcgugcccagccgcgccgccgagguggccgcggccgccuaccggaaccucuga

SEQ ID NO: 6975 - RNA, 738 nt, Artificial Sequence
  derived and/or modified CDS sequence (opt1) from SFTSV/Huaiyangshan virus(S-HZM)__HQ171193.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacggaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccaccggggucuccgaggcgacgaccaagacccugauggaggccuacagccuguggcaggacgccuucaccaagacgaucaacgugaagaugcggggcgccuccaagaccgagguguacaacagcuuccgcgacccccuccacgccgcggucaacuccguguucuucccgaacgaccugcgggugaaguggcugaaggccaaggggauccucggccccgacggcguccccagccgcgccgccgagguggccgcggccgccuaccggaaccuguga

SEQ ID NO: 6976 - RNA, 738 nt, Artificial Sequence
  derived and/or modified CDS sequence (opt1) from SFTSV/Huaiyangshan virus(S-WJ)__HQ171191.1__N
augagcgaguggucccgcaucgccguggaguucggcgagcagcagcugaaccucaccgagcuggaggacuucgcccgggagcuggcguacgaggggcucggccccgcccugaucaucaagaagcugaaggagaccgggggcgacgacugggucaaggacacgaaguucaucaucguguucgcccucacccgcgggaacaagaucgugaaggccagcggcaagauguccaacagcggcuccaagcggcugauggcccugcaggagaaguacgggcucgucgagcgcgcggagacccggcugagcaucaccccggugcgcguggcccagucccugcccacguggaccugcgccgccgcggccgcccucaaggaguaccugcccgucggccccgccgugaugaaccugaagguggagaacuacccgcccgagaugaugugcauggccuucgggagccucauccccaccgcgggcgucuccgaggccaccacgaagacccugauggaggccuacagccuguggcaggacgccuucaccaagaccaucaacgugaagaugcgcggggccuccaagacggagguguacaacagcuuccgggacccccuccacgcggccgucaacuccguguucuucccgaacgacgugcgggucaaguggcugaaggccaagggcauccugggccccgacggggugcccagccgcgccgccgagguggcggccgccgccuaccggaaccucuga

SEQ ID NO: 6977 - RNA, 738 nt, Artificial Sequence
  derived and/or modified CDS sequence (opt1) from SFTSV/Phlebovirus(JS2010-019)__JQ317180.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcggggcgccuccaagacggagguguacaacagcuuccgcgacccccuccacgcggccgucaacuccguguucuucccgaacgacgugcgggucaaguggcugaaggccaaggggauccugggccccgacggcgugcccagccgcgccgccgaggcggccgccgccgccuaccggaaccucuga

SEQ ID NO: 6978 - RNA, 738 nt, Artificial Sequence
  derived and/or modified CDS sequence (opt1) from SFTSV/Phlebovirus(SD24/China/2010 strain SD24)__HM802205.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucaccgaggccacgaccaagacccugauggaggccuacucccuguggcaggacgccuucaccaagacgaucaacgugaagaugcggggcgccagcaagaccgagguguacaacuccuuccgcgacccccuccacgcggccgucaacagcguguucuucccgaacgacgugcgggucaaguggcugaaggccaaggggauccugggccccgacggcgugcccucccgcgccgccgagguggcggccgccgccuaccggaaccucuga

SEQ ID NO: 6979 - RNA, 738 nt, Artificial Sequence
  derived and/or modified CDS sequence (opt1) from SFTSV/Phlebovirus(ZJ1/China/2011)__HE663216.1__N
augagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacuggguccgcgacacgaaguucaucaucguguucgcccucacccggggcaacaagaucgugaaggccagcgggaagauguccaacagcggcuccaagcgccugauggcccugcaggagaaguacggccucgucgagaaggcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaaggcccugauggaggccuacagccuguggcaggacgccuucaccaagaccaucaacgugaagaugcggggcgcguccaagaccgagguguacagcuccuuccgcgacccccuccacgccgccgucaacagcguguucuucccgaacgacgugcgggucaaguggcugaaggccaaggggauccugggccccgacggcgugcccucccgcgccgcggagguggccgccgccgccuaccggaaccucuga

SEQ ID NO: 6980 - RNA, 1287 nt, Artificial Sequence
  derived and/or modified CDS sequence (opt5) from ANDV(Chile-9717869)__AF291702.1__N
augagcacccugcaggagcuccaagaaaacaucacagcccacgagcagcagcuggugacggcuagacagaaacuuaaggacgccgaaaaggcggucgagguugaucccgacgaugugaauaaauccacccugcaaucucggcgcgcugccgugagcacacucgaaaccaagcugggcgagcuuaaaagacagcuggccgaccucgucgcugcccagaagcuggcuacaaagccuguggauccgaccgggcuggagcccgacgaucaucucaaagaaaaguccucucugcgguacggaaacguucuugacgugaauagcauugaucuggaggaaccuuccggccagacagccgacuggaaagcgaucggggccuauauucucggauucgcuauccccauuauccugaaggcccuuuacaugcugucuacccgcggcagacaaacggucaaagauaacaaggggacccggauccgcuuuaaggacgauagcuccuucgaggaggugaauggaauuagaaaaccuaagcaccucuauguuagcaugcccacagcucagucuaccaugaaagccgaagagaucacaccuggccgguuucgcaccauugcgugcggccuguucccggcccaggugaaggcuagaaacaucauuucccccgucaugggggugaucggauuuggcuucuuugugaaagacuggauggaccggauugaagaguuccuggccgcugaauguccuuuucuccccaagccuaaagucgccagcgaggccuucaugucuacgaauaagauguacuuucugaaccgccagagacaaguuaaugaguccaaggugcaggauaucaucgaccuuauugaucaugcugaaacagagagcgcgacccuguucacagaaaucgccacaccccacucugugugggucuuugcuugcgccccggaccgguguccucccaccgcccucuauguggcugggguuccugagcugggagccuucuucuccauucuucaggauaugcgcaacaccaucauggcgagcaaauccgugggcacggcugaagagaagcugaaaaagaaaucugccuuuuaccaaagcuaucucagacggacccaguccauggggauucagcuggaccagaagaucaucauucuguacaugcucagcuggggaaaggaggccgucaaucauuuccaccugggcgaugacauggaucccgaacuuagacaacuggcucagucucucaucgacacaaaagugaaggagauuuccaaccaggaaccccugaaacuuuga

SEQ ID NO: 6981 - RNA, 1287 nt, Artificial Sequence
  derived and/or modified CDS sequence (opt5) from ANDV(Nort)__AF325966.1__N
augagcacccugcaggagcuccaagaaaacaucacagcccacgagcagcagcuggugacggcuagacagaaacuuaaggacgccgaaaagaccgucgagguugaucccgacgaagugaauaaauccacacugcaaucucggcgcgcggcugugagcacccucgagacaaagcugggcgagcuuaaaagacagcuggccgaucucgucgccgcucagaagcuggccaccaagccuguggacccgacagggcuggaacccgaugaccaucucaaagagaaguccucucugcgguacggaaacguucuugaugugaauagcauugaccuggaggaaccuuccggccagaccgcugauuggaaagccaucggggcguauauucucggauucgccauccccauuauccugaaggcucuuuacaugcugucuacgcgcggcagacaaaccgucaaagacaacaaggggacacggauccgcuuuaaggaugacagcuccuucgaggaagugaauggaauuagaaaaccuaagcaccucuauguuagcaugcccaccgcccagucuacaaugaaagcugaggaaaucaccccuggccgguuucgcacgauugccugcggccuguucccggcccaggugaaggcgagaaacaucauuucccccgucaugggggugaucggauuuagcuucuuugugaaagauuggauggagcggauugaagacuuccuggcugccgaguguccuuuucuccccaagccuaaagcucugucugaggccuucauggccacaaauaaggcuuacuuucuuaaccgccagagacaagucaaugacuccaagguucaggauaucguggaccugaucgaucaugcggaaauugagagcgccacccucuucacagacaucgcuacaccccacucugugugggucuuugccugcgccccggaucgguguccucccaccgcucuguauguggccggcguuccugaacuuggggcguucuucgcuauucugcaggacaugcgcaacaccaucauggccuccaaaagcgugggaacggccgaggaaaagcucaaaaagaaauccgcuuuuuaccaaucuuaucugagacggacccaguacaugggcauucagcuggaucagaagaucaucauucucuacaugcugagcugggggaaggaggccgucaaucauuuccaccuuggagacgauauggaccccgagcugagacaacucgcucagucccugaucgauacaaaagugaaggaaauuagcaaccaggagccccuuaaacuguga

SEQ ID NO: 6982 - RNA, 1287 nt, Artificial Sequence
  derived and/or modified CDS sequence (opt5) from ANDV(CHI-7913)__AY228237.1__N
augagcacccugcaggagcuccaagaaaacaucacagcccacgagcagcagcuggugacggcuagacagaaacuuaaggacgccgaaaaggcggucgagguugaucccgacgaugugaauaaauccacccugcaaaaccggcgcgcugccgugucuacacucgaaaccaagcugggcgagcuuaaaagacagcuggccgaccucgucgcugcccagaagcuggcuacaaagccuguggauccgaccgggcuggagcccgacgaucaucucaaagaaaagagcucccugcgguacggaaauguucuugacgugaacucuauugaucuggaggaaccuagcggccagacagccgacuggaaagcgaucggggccuauauucucggauucgcuauccccauuauccugaaggcccuuuacaugcuguccacccgcggcagacaagcugucaaagauaauaaggggacgcggauccgcuuuaaggacgauucuagcuucgaggaggugaacggaauuagaaaaccuaagcaccucuauguuuccaugcccaccgcccagagcacaaugaaagcggaagagaucaccccuggccgguuucgcacaauugccugcggccuguucccggcucaggugaaggccagaaauaucauuucucccgucaugggggugaucggauuuggcuucuuugugaaagacuggauggaccggauugaagaguuccuggcugccgaauguccuuuucuccccaagccuaaagucgccuccgaggcuuucaugagcaccaacaagauguacuuucugaaucgccagagacaaguuaacgagucuaaggugcaggauaucaucgaccuuauugaucaugcggaaacggaguccgccacacuguucaccgaaaucgcuacaccccacagcgugugggucuuugccugcgccccggaccgguguccucccaccgcucucuauguggccgggguuccugagcugggagcguucuucucuauucuucaggauaugcgcaauaccaucauggcuuccaaaagcgugggcacagccgaagagaagcugaaaaagaaauccgccuuuuaccaaucuuaucucagacggacgcagagcauggggauucagcuggaccagaagaucaucauucuguacaugcucuccuggggaaaggaggcugucaaccauuuccaccugggcgaugacauggaucccgaacuuagacaacuggcccagagccucaucgacaccaaagugaaggagauuucuaaucaggaaccccugaaacuuuga

SEQ ID NO: 6983 - RNA, 1287 nt, Artificial Sequence
  derived and/or modified CDS sequence (opt5) from ANDV(9718133)__AF482712.1__N
augagcacccugcaggagcuccaagaaaacaucacagcccacgagcagcagcuggugacggcuagacagaaacuuaaggacgccgaaaaggcggucgagguugaucccgacgaugugaauaaauccacccugcaaaaccggcgcgcugccgugucuacacucgaaaccaagcugggcgagcuuaaaagacagcuggccgaccucgucgcugcccagaagcuggcuacaaagccuguggauccgaccgggcuggagcccgacgaucaucucaaagaaaagagcucccugcgguacggaaauguucuugacgugaacucuauugaucuggaggaaccuagcggccagacagccgacuggaaagcgaucggggccuauauucucggauucgcuauccccauuauccugaaggcccuuuacaugcuguccacccgcggcagacaaacggucaaagauaauaaggggacccggauccgcuuuaaggacgauucuagcuucgaggaggugaacggaauuagaaaaccuaagcaccucuauguuuccaugcccacagcucagagcaccaugaaagccgaagagaucacaccuggccgguuucgcaccauugcgugcggccuguucccggcccaggugaaggcuagaaauaucauuucucccgucaugggggugaucggauuuggcuucuuugugaaagacuggauggaccggauugaagaguuccuggccgcugaauguccuuuucuccccaagccuaaagucgccuccgaggccuucaugagcacgaacaagauguacuuucugaaucgccagagacaaguuaacgagucuaaggugcaggauaucaucgaccuuauugaucaugcugaaacagaguccgcgacccuguucacagaaaucgccacaccccacagcgugugggucuuugcuugcgccccggaccgguguccucccaccgcccucuauguggcugggguuccugagcugggagccuucuucucuauucuucaggauaugcgcaauaccaucauggcguccaaaagcgugggcacggcugaagagaagcugaaaaagaaauccgccuuuuaccaaucuuaucucagacggacccagagcauggggauucagcuggaccagaagaucaucauucuguacaugcucuccuggggaaaggaggccgucaaccauuuccaccugggcgaugacauggaucccgaacuuagacaacuggcucagagccucaucgacacaaaagugaaggagauuucuaaucaggaaccccugaaacuuuga

SEQ ID NO: 6984 - RNA, 1278 nt, Artificial Sequence
  derived and/or modified CDS sequence (opt5) from Araraquara virus(9480)__KP202360.1__N
augagcaaccugcaggagcuccaagaaaauaucaccgcccacgagcagcagcuggugacagcuagacagaagcucaaagacgccgaaaaggcggucgauguugaccccgaugaggugaacaaauccacgcugcaaggccggcgcgcugccgugucuacccucgaaacaaagcugggggagcuuaaaagacagcuggccgaccucgucgcugcccagcggcuggcuagcaagccuguggauccgaccggaauugagcccgacgaucaucugaaggaaaaauccucucuccgcuacggcaauguucuggacgugaacagcaucgaucuugaggaaccuuccgggcagacagccgacuggaaggcgauuggagccuauauccugggcuucgcuauucccaucauccucaaagcccuguacaugcuuucuaccagagggcggcaaacagucaaggauaauaaaggaacccgcauuagauuuaaggacgauagcuccuucgaggaggugaacggcauccggaagccuaaacaccuguauauuagcaugcccacggcucagucuaccaugaaggccgaagagaucacaccuggccgcuuuagaaccauugcgugcgggcuuuucccggcccagguuaaagcucggaauaucauuucccccgugaugggagucaucggcuuugccuucuuugugaaggacuggauggaacgcaucgaggacuuccuggcuagcgaauguccuuuucugcccaaaccuaagaaccccucugaggccuucauggccacaaauaaggcuuacuuucucaacagacagaagcaaguggaugagucccaggucccggacauuguugaucugaucgaccaugcggaagccgagagcgcuacccuuuucaaggaaauugccucuccucacuccguguggguguuugccugcgcucccgaucgguguccucccacggcccuguaugucgcggggaugcccgagcucggagcuuucuucgccauccugcaggacaugcgcaauacaauuauggccagcaaauccgugggcaccgcugaagagaaacuuaaaaagaaaucugccuuuuaccaaagcuaucugagacggacacaguccauggggauccagcucgaucagaagaucauuauccuguacaugcugagcuggggaaaggaggcuguuaaccauuuccaccucggcgacgauauggacccugaacugagacaacuugcccagucucugauugauaccaaagugaaggagucccagaccaaaagccucuga

SEQ ID NO: 6985 - RNA, 1287 nt, Artificial Sequence
  derived and/or modified CDS sequence (opt5) from Araraquara-like virus(P5/Cajuru)__EF571895.1__N
augagcaaccugcaggagcuccaagaaaauaucaccgcccacgagcagcagcuggugacagcuagacagaagcucaaagacgccgaaaaggcggucgauguugaccccgaugaggugaacaaauccacgcugcaaggccggcgcgcugccgugucuacccucgaaacaaagcugggggagcuuaaaagacagcuggccgaccucgucgcugcccagcggcuggcuagcaagccuguggauccgaccggaauugagcccgacgaucaucugaaggaaaaauccucucuccgcuacggcaauguucuggacgugaacccuaucgaucuugaggaacccagcgggcagacagccgacuggaaggcgauuggagccuauauccugggcuucgcuauuccuaucauccucaaagcccuguacaugcuuuccaccagagggcggcaaacagucaaggauaauaaaggaacccgcauuagauuuaaggacgauucuagcuucgaggaggugaacggcauccggaagcccaaacaccuguauauuuccaugccuacggcucagagcaccaugaaggccgaagagaucacaccgggccgcuuuagaaccauugcgugcgggcuuuuccccgcccagguuaaagcucggaauaucauuucuccugugaugggagucaucggcuuuggguucuuugugaaggacuggauggaacgcaucgaggacuuccuggccuccgaaugucccuuucugccuaaacccaagaacccgagcgaggcuuucauggccacaaauaaagccuacuuucucaacagacagaagcaaguggaugagucucaggucccugacauuguugaucugaucgaccaugcugaagcggaguccgccacccuuuucaaggaaauugcuagcccccacucuguguggguguuugccugcgccccugaucgguguccucccacggcucuguaugucgccggacuccccgagcugggcgcguucuucgcuauccuucaggacaugcgcaauacaauuauggccuccaaaagcguggggaccgccgaagagaagcugaaaaagaaauccgcuuuuuaccaaucuuaucucagacggacacagagcaugggaauccagcuggaucagaagaucauuauccuguacaugcucuccuggggcaaggaggccguuaaccauuuccaccugggcgacgauauggacccggaacuuagacaacuggcucagagccucauugauaccaaagugaaggagaucucuaaucaggggccccugaaacuuuga

SEQ ID NO: 6986 - RNA, 1287 nt, Artificial Sequence
  derived and/or modified CDS sequence (opt5) from BMJV(Oc22531)__AF482713.1__N
augagcacccugcaggagcuccaagaaaacaucacagcccacgagcagcagcuggugacggcuagacagaaacuuaaggacgccgaaaagaccgucgagguugaucccgacgaagugaauaaguccacacugcaaucucggcgcgcggcugugagcacccucgagacaaagcugggcgagcuuaaaagacagcuggccgaucucgucgccgcucagaagcuggccaccaagccuguggacccgacagggcuggaacccgaugaccaucucaaagagaaguccucucugcgguacggaaacguucuugaugugaauagcauugaccuggaggaaccuuccggccagaccgcugauuggcgcucuaucggggccuauauucucggauucgcgauccccauuauccugaaagcccuuuacaugcugagcacgagaggccggcaaaccgucaaggacaacaaagggacacgcaucagauuuaaggaugacuccagcuucgaggaagugaauggcauucggaagccuaaacaccucuauguuucuaugcccaccgcucaguccacaaugaaggccgaggaaaucaccccuggacgcuuuagaacgauugcuugcggccuguucccggcccaggugaaagcgcggaacaucauuagccccgucaugggggugaucggauuuucuuucuuugugaaggauuggauggagcgcauugaagacuuccuggccgcugaguguccuuuucuccccaaaccuaaggcccccuccgaggcuuucauggccacaaauaaagccuacuuucugaacagacagcggcaagucaaugaaagcaagguucaggacaucguggaucuuaucgaccaugcugagaccgaaucugcgacacuguucaccgauauugccaccccgcacuccgugugggucuuugcuugcgccccugaccgcugucccccuacagcccucuauguggcuggcguucccgagcugggggccuucuucgcgauccuucaggauaugagaaacacgauuauggcuagcaaguccgugggaaccgccgaagagaaacugaagaaaaagucugccuuuuaccaaagcuaucuccggagaacacaguccaugggcauccagcuggaccagaaaauuaucauccuguacaugcucagcugggggaaggaggcugucaaucauuuccaccugggagaugacauggaucccgaacuucgccaacuggcccagucucucauugacaccaaggugaaagagaucuccaaccaggaaccucugaaacuuuga

SEQ ID NO: 6987 - RNA, 1287 nt, Artificial Sequence
  derived and/or modified CDS sequence (opt5) from LECV(22819)__AF482714.1__N
augagcacccugcaggagcuccaagaaaacaucacagcccacgagcagcagcuggugacggcuagacagaaacuuaaggacgccgaaaagaccgucgagguugaucccgacgaagugaauaaguccacacugcaaucucggcgcgcggcugugagcacccucgagacaaagcugggcgagcuuaaaagacagcuggccgaucucgucgccgcucagaagcuggccaccaagccuguggacccgacagggcuggaacccgaugaccaucucaaagagaaguccucucugcgguacggaaacguucuugaugugaauagcauugaccuggaggaaccuuccggccagaccgcugauuggcgcucuaucggggccuauauucucggauucgcgauccccauuauccugaaagcccuuuacaugcugagcacgagaggccggcaaaccgucaaggacaacaaagggacacgcaucagauuuaaggaugacuccagcuucgaggaagugaauggcauucggaagccuaaacaccucuauguuucuaugcccaccgcucaguccacaaugaaggccgaggaaaucaccccuggacgcuuuagaacgauugcuugcggccuguucccggcccaggugaaagcgcggaacaucauuagccccgucaugggggugaucggauuuucuuucuuugugaaggauuggauggagcgcauugaagacuuccuggccgcugaguguccuuuucuccccaaaccuaaggcccccuccgaggcuuucauggccacaaauaaagccuacuuucugaacagacagcggcaagucaaugaaagcaagguucaggagaucguggaccuuaucgaucaugcugaaaccgagucugcgacacuguucaccgacauugccaccccgcacuccgugugggucuuugcuugcgccccugaucgcugucccccuacagcccucuauguggcuggcguucccgaacugggggccuucuucgcgauccuucaggacaugagaaacacgauuauggcuagcaaguccgugggaaccgccgaggagaaacugaagaaaaagucugccuuuuaccaaagcuaucuccggagaacacaguccaugggcauccagcuggaucagaaaauuaucauccuguacaugcucagcugggggaaggaagcugucaaucauuuccaccugggagacgauauggaccccgagcuucgccaacuggcccagucucucauugauaccaaggugaaagaaaucuccaaccaggagccucugaaacuuuga

SEQ ID NO: 6988 - RNA, 1287 nt, Artificial Sequence
  derived and/or modified CDS sequence (opt5) from MCLV(13796)__AF482716.1__N
augagcaaccugcaggagcuccaagaaaauaucaccgcccacgagcagcagcuggugacagcuagacagaagcucaaagacgccgaaaaggcggucgauguugaccccgaugaggugaacaaauccacgcugcaaggccggcgcgcugccgugucuacccucgaaacaaagcugggggagcuuaaaagacagcuggccgaccucgucgcugcccagaagcuggcuaccaagccuguggauccgacaggaauugagcccgacgaucaucugaaagaaaagagcucccuccgguacggcaauguucuggacgugaacucuaucgaucuugaggaaccuagcgggcagaccgccgacuggaaagcgauuggagccuauauccugggcuucgcuauucccaucauccucaaggcccuguacaugcuuuccacacgcgggagacaaaccgucaaagauaauaagggaacgcggauucgcuuuaaggacgauucuagcuucgaggaggugaacggcaucagaaaaccuaagcaccuguauauuuccaugcccaccgcucagagcacaaugaaagccgaagagaucaccccuggccgguuucgcacaauuguuugcgggcuuuucccggcgcaagugaaggccagaaauaucauuucucccgucaugggagugaucggcuuuuccuucuuugugaaagacuggauggaacggaucgagggguuccuggcugccgaauguccuuuucugcccaagccuaaaaccgcugccgagacguucauggccacaaacaaggcuuacuuuuucaaucgccagagacaagucgacgagagccagguucccgauauuguggaacucaucgaccaggcggagucugaauccgccacccuguuuacagagauugcuagcccgcauucugugugggucuucgccugcgccccugaucggugucccccuaccgcucuuuauguggccggaguucccgaacugggcgcguucuuugcuauccuccaagacaugcgcaacaccauuauggccuccaagagcguggggacagccgaggagaaacugaagaaaaaguccgcuuucuaccagucuuaucuuagacggacgcagagcaugggaauccagcuggaucagaaaaucauuauccucuacaugcuguccuggggcaaggaagccgucaaucacuuucaucugggcgacgauauggaccccgagcucagacagcuggcucaggcccuuauugauaccaaggugaaagaaaucagcaaccaggagccucugaagcucuga

SEQ ID NO: 6989 - RNA, 1287 nt, Artificial Sequence
  derived and/or modified CDS sequence (opt5) from Neembucu(Neembucu)__DQ345763.1__N
augagcacccugcaggagcuccaagaaaacaucacagcccacgagcagcagcuggugacggcuagacagaaacuuaaggacgccgaaaagaccgucgagguugaucccgacgaagugaauaaauccacacugcaaucucggcgcgcggcugugagcacccucgagacaaagcugggcgagcuuaaaagacagcuggccgaucucgucgccgcucagaagcuggccacccggccuguggacccgacagggcuggaacccgaugaccaucucaaggagaaauccucucugcgcuacggaaacguucuugaugugaauagcauugaccuggaggaaccuuccggccagaccgcugauuggagaucuaucggggccuauauucucggauucgcgauccccauuauccugaaggcccuuuacaugcugagcacgcggggccgccaaaccgucaaagacaacaaggggacaagaauccgguuuaaagaugacuccagcuucgaggaagugaauggcauucgcaagccuaagcaccucuauguuucuaugcccaccgcucaguccacaaugaaagccgaggaaaucaccccuggaagacugcggacgauugcuugcggccuguuuccggcccaggugaaggcgcgcagcaucauuucucccgucaugggggugaucggauucuccuuuuucgugaaagauuggauggagagaauugaagacuuucucgccgcugaguguccuuuccugcccaagccuaaagcccccagcgaggcuuuuauggccacaaacaaggccuacuuccuuaaucggcagcgccaagucaacgaaucuaaaguucaggacaucguggaucugaucgaccaugcugagaccgaauccgcgacacucuuuaccgauauugccaccccgcacagcgugugggucuucgcuugcgccccugacagaugucccccuacagcccuguauguggcuggcguucccgagcuuggggccuuuuucgcgauccugcaggauaugcggaauacgauuauggcuuccaagucugugggaaccgccgaagagaagcucaaaaagaaaagcgccuucuaccaauccuaucugagacgcacacagagcaugggcauccagcuggaccagaagauuaucauccucuacaugcugucuugggggaaagaggcugucaaccauuuucaccuuggagaugacauggaucccgaacugcggcaacucgcccagucccugauugacaccaaggugaaggagaucagcaaucaggaaccucuuaaacuguga

SEQ ID NO: 6990 - RNA, 1287 nt, Artificial Sequence
  derived and/or modified CDS sequence (opt5) from ORNV(22996)__AF482715.1__N
augagcacccugcaggagcuccaagaaaacaucacagcccacgagcagcagcuggugacggcuagacagaaacuuaaggacgccgaaaagaccgucgagguugaucccgacgaagugaauaaauccacacugcaaucucggcgcgcggcugugagcacccucgagacaaagcugggcgagcuuaaaagacagcuggccgaucucgucgccgcucagaagcuggccaccaagccuguggacccgacagggcuggaacccgaugaccaucucaaagagaaguccucucugcgguacggaaacguucuugaugugaauagcauugaccuggaggaaccuuccggccagaccgcugauuggaaagccaucggggcguauauucucggauucgccauccccauuauccugaaggcucuuuacaugcugucuacgcgcggcagacaaaccgucaaagacaacaaggggacacggauccgcuuuaaggaugacagcuccuucgaggaagugaauggaauuagaaaaccuaagcaccucuauguuagcaugcccaccgcccagucuacaaugaaagcugaggaaaucaccccuggccgguuucgcacgauugccugcggccuguucccggcccaggugaaggcgagaaacaucauuucccccgucaugggggugaucggauuuagcuucuuugugaaagauuggauggagcggauugaagacuuccuggcugccgaguguccuuuucuccccaagccuaaagcucugucugaggccuucauggccacaaauaaggcuuacuuucuuaaccgccagagacaagucaaugacuccaagguucaggauaucguggaccugaucgaucaugcggaaauugagagcgccacccucuucacagacaucgcuacaccccacucugugugggucuuugccugcgccccggaucgguguccucccaccgcucuguauguggccggcguuccugaacuuggggcguucuucgcuauucugcaggacaugcgcaacaccaucauggccuccaaaagcgugggaacggccgaggaaaagcucaaaaagaaauccgcuuuuuaccaaucuuaucugagacggacccagagcaugggcauucagcuggaucagaagaucaucauucucuacaugcuguccugggggaaggaggccgucaaucauuuccaccuuggagacgauauggaccccgagcugagacaacucgcucagagccugaucgauacaaaagugaaggaaauuucuaaccaggagccccuuaaacuguga

SEQ ID NO: 6991 - RNA, 1287 nt, Artificial Sequence
  derived and/or modified CDS sequence (opt5) from PRGV(14403)__AF482717.1__N
augagcacccugcaggagcuccaagaaaacaucacagcccacgagcagcaucuggugacggcuagacagaaacuuaaggacgccgaaaagaccgucgagguugaucccgacgaagugaauaaguccacacugcagucucggcgcgcggcugugagcacccucgagacaaagcugggcgagcuuaaaagacaacuggccgaucucgucgccgcucagaagcuggccgcuaagccuguggacccgaccgggcuggaacccgaugaccaccucaaagagaaguccucucugcgguacggaaacguucuugaugugaauagcauugaccuggaggaaccuuccggccagacagccgauuggaaagcgaucggggccuauauucucggauucgcuauccccauuauccugaaggcccuuuacaugcugucuacccgcggcagacagacggucaaagacaacaaggggacccggauccgcuuuaaggaugacagcuccuucgaggaagugaauggaauuagaaaaccuaagcaucucuauguuagcaugcccacagcucaaucuaccaugaaagccgaggaaaucacaccuggccgguuucgcaccauugcgugcggccuguucccggcccaggugaaggcuagaaacaucauuucccccgucaugggggugaucggauuuagcuucuuugugaaagauuggauggagcggauugaagacuuccuggccgcugaguguccuuuucuccccaagccuaaaacgacaucugaggccuucauguccaccaauaaggccuacuuucugaaccgccagagacaggucgacgaaagccaaguucccgauaucgcugagcuuaucgaacaggcggagucugaauccgccacacuguucaccgagauugcuagcccgcacuccguguggguguuugccugcgccccugaccggugucccccuaccgcucucuaugucgccggcgugcccgagcugggggcguucuucgcuauccuucaggauaugcgcaauacaauuauggccucuaagagcguuggaacggccgaagagaaacugaagaaaaaguccgcuuuuuaccaaagcuaucucagacggacccagucuaugggcauccagcuggaccagaaaauuaucauccuguacaugcucuccugggggaaggaagccgugaaccauuuccaccugggagaugacauggaucccgagcuuagacaacuggcucaggcccucauugacacaaaggucaaagaaaucagcaaucaggagccucugaaacuuuga

SEQ ID NO: 6992 - RNA, 1287 nt, Artificial Sequence
  derived and/or modified CDS sequence (opt5) from TUNV(FVB554)__JF750419.1__N
augagcaaccugcaggagcuccaagaaaauaucaccgcccacgagcagcagcuggugacagcuagacagaaacuuaaggacgccgaaaaggcggucgagauggaucccgacgauguuaacaaauccacgcugcaaucucggcgcgcugccgugagcacccucgaaacaaagcugggcgagcuuaaaagacagcuggccgacaugguggcugcccagaagcucgcuaccaagccugucgauccgacagggcuggagcccgacgaucaucugaaagaaaaguccucucuccgguacggaaaugugcuggacguuaacagcauugaucuugaggaaccuuccggccagaccgccgacuggaaaucuaucggggcguauauucugggauucgccauccccauuauccucaaggcucuguacaugcuuagcacacgcggcagacaaaccgugaaagauaauaaggggacgcggauccgcuuuaaggacgauuccagcuucgaggaggucaacggaauuagaaaaccuaagcaccuguaugugucuaugcccaccgcccaguccacaaugaaagcugaagagaucaccccuggccgguuucgcacaauugccugcggccucuucccggcgcagguuaaggccagaaauaucauuagccccgugaugggggucaucggauuuucuuucuuugugaaagacuggauggaacggauugaggacuuccuggcugaugaauguccuuuucugcccaagccuaaaucccccagcgaggccuucauggcuaccaacaaggccuacuuucucaaucgccagagacaagugaacgacucuaagguccaggauaucguugaccugaucgaucaugccgagacggaauccgcuacacuuuucaccgacauugcgacaccgcacagcguguggguguuugccugcgcuccugaucggugucccccuaccgcccuguaugucgccggcgugcccgagcucggggcuuucuucgccauccugcaggacaugcgcaauaccauuauggcguccaaaucuguuggaacagcugaagagaaacuuaagaagaaaagcgccuuuuaccaauccuaucugagacggacgcagagcaugggcauccagcucgaucagaagauuaucauccuguacaugcugucuugggggaaggaagccgugaaccauuuccaccucggagacgauauggaccccgagcugagacaacuugcucaggcccugauugacaccaaagucaaggagaucuccaaucaggaaccucucaaacuguga

SEQ ID NO: 6993 - RNA, 1287 nt, Artificial Sequence
  derived and/or modified CDS sequence (opt5) from BCCV(BCCV)__AB689163.1__N
augagcaaccugaaggaggugcaggacaauaucaccacacacgaacaacagcucgucgccgcuagacagaaacugaaggaugccgagcggacgguuggcguggaccccgaugacgugaacaaauccacccuucagaaucgcagagcggcugucucugcccuggaagccaagauuggggagcucaaacggcaacuggcugaucuuguggccgcucagaagcuggccacaaagagcguugacccuaccggaaucgaaccggaugaccaucucaaagagaaguccucucugcgcuacggcaacgugcuggaugucaauagcauugaccucgaggaacccuccgggcagacagcggauuggaaagccaucggaaccuauauucugucuuucgugcuuccuaucguucugaaggcucucuacaugcugagcacaagaggccggcagaccgugaaagagaacaaggggacgcgcaucagauuuaaggacgauuccagcuaugaagacgucaauggcauucggaaacccaagcaccuuuacgugucucugccuaccgcccaauccacaaugaaagcugacgagaucacccccggacgcuucagaacaauugugugcggccucuuuccugcccagaucaaggcgcggaacauuaucagcccggucauggggguuauuggauucuccuuuuucgugaaagauuggguggacaagaucgaggauuuucugcgcgccgaaugucccuuccugccuaaacccagagcucaggccgagucuuuucucagcaccaauggcgcuuauuucaugaaccggcagacgcaagucgaagagucuaaggugcaggacauccuggaucuuauugacacagccgaauccgggggagccacccuguuugauaauaucgcuagcccucaguccgcguggauuuucgccugcgcucccgaccgcuguccgccuacagcccucuacguugccggcgugcccgagcugggggccuuuuucucuauccuucaagauaugagaaacaccauuauggcuagcaaguccgucggaaccgcggaggaaaaacugaagaaaaagagcgcuuucuaucagucuuaccuccggagaacacaguccaugggcauccagcuggaccagaaaaucauuauccuguacaugauuaauuggggcaaggaggccgugaaccauuuucaccucggggaugacauggacccugaacugcgccaacuugcccaggcucugguugauacgaaggugaaagagaucagcaaucaggaaccccucaagauuuga

SEQ ID NO: 6994 - RNA, 1287 nt, Artificial Sequence
  derived and/or modified CDS sequence (opt5) from BCCV(BCCV)__L39949.1__N
augagcaaccugaaggaggugcaggacaauaucaccacacacgaacaacagcucgucgccgcuagacagaaacugaaggaugccgagcggacgguugaaguggaccccgaugacgugaacaaauccacccuucagaaucgcagagcggcugucucugcccuggaggccaagauuggcgaacucaaacggcaacuggcugaucuuguggccgcucagaagcuggccacaaagagcguugacccuaccgggaucgagccggaugaccaucucaaagagaaguccucucugcgcuacggaaacgugcuggaugucaauagcauugaccucgaggaacccuccggccagacagcggauuggaaagccaucgggaccuauauucugucuuucgugcuuccuaucguucugaaggcucucuacaugcugagcacaagaggacggcagaccgugaaagaaaacaagggcacgcgcaucagauuuaaggacgauuccagcuaugaggacgucaaugggauucggaaacccaagcaccuuuacgugucucugccuaccgcccaauccacaaugaaagcugacgagaucacccccggacgcuucagaacaauugugugcggccucuuuccugcccagaucaaggcgcggaacauuaucagcccggucaugggcguuauuggguucuccuuuuucgugaaagauuggguggacaagaucgaagauuuucugcgcgccgagugucccuuccugccuaaacccagagcucaggccgaaucuuuucucagcaccaauggagcuuauuucaugaaccggcagacgcaagucgaggaaucuaaggugcaggacauccuggaucuuauugacacagccgaguccggcggggccacccuguuugauaauaucgcuagcccucaguccgcguggauuuucgccugcgcucccgaccgcuguccgccuacagcccucuacguugccggagugcccgagcugggcgccuuuuucucuauccuucaagauaugagaaacaccauuauggcuagcaaguccgucgggaccgcggaagagaaacugaagaaaaagagcgcuuucuaucagucuuaccuccggagaacacaguccaugggaauccagcuggaccagaaaaucauuauccuguacaugauuaauuggggcaaggaagccgugaaccauuuucaccucggcgaugacauggacccugagcugcgccaacuugcccaggcucugguugauacgaaggugaaagaaaucagcaaucaggagccccucaagauuuga

SEQ ID NO: 6995 - RNA, 1290 nt, Artificial Sequence
  derived and/or modified CDS sequence (opt5) from DOBV(DOBV/Ano-Poroia/Afl9/1999)__NC_005233.1__N
auggccacccuggaggaacuccagaaggagaucaacaaucacgaaggccaacuggugauugcuagacagaaagucaaggacgccgagaaacaguacgaaaaggaucccgacgaucuuaacaaacgggcgcugagcgaccgcgaguccaucgcucagucuauucaagggaagaucgaugagcucagacggcagcuggccgaccgcguugccgcuggaaagaauauuggcaaagaaagagauccuacagggcuugacccgggagaucaucugaaggagaaaagcaugcucuccuauggcaacgugaucgaccugaaucaccuggauaucgacgaacccacggggcagaccgccgauuggcucucuauuguggucuaccugaccagcuucgugguuccuauccuucugaaggcucucuauaugcugacaacacggggacgccagaccacaaaagacaacaagggcaugcggauuagauuuaaggacgauuccucuuucgaggacgugaauggcauccgcaaacccaagcaucuuuuucugagcaugccuaacgcccaauccagcaugaaagcggaugagauuacccccgggagauuccggacggccaucugcggacucuacccugcucaggucaaggcccgcaaucugauuucuccggugauguccguuaucggcuuucuggcucucgccaaaaacuggaccgaaagaguggaggaauggcuggaccuucccuguaagcugcucagcgagccuucucccacaucccugaccaaagggccuagcacaaaucgggauuaucuuaaccagcgccagggagcgcuggccaagauggaaaccaaggaggcucaagccgucagaaaacacgcuaucgacgccggcugcaaucucauugaucauaucgacucucccuccagcauuuggguguucgccggggcuccggaucgguguccucccacgugccuguuuaucgcgggaauggccgagcugggcgcuuucuuugccgugcuccaggacaugagaaacacaauuauggccuccaagaccaucggcacaucugaagagaaacugaagaaaaagagcuccuucuaccagagcuaucuucgccggacccaaucuauggggauccagcuggaucagagaauuaucguccucuuuaugguugacuggggaaaggaagcuguggacuccuuccaccugggcgaugacauggauccugagcuucgcgggcuggcccaggcgcucauugaccaaaaagugaaggaaaucagcaaucaggagccccugaaacuguga

SEQ ID NO: 6996 - RNA, 1290 nt, Artificial Sequence
  derived and/or modified CDS sequence (opt5) from DOBV(DOB/Saaremaa/160V)__AJ009773.1__N
auggccacccuggaggaacuccagaaggagaucaacagccacgaaggccaacuggugauugcuagacagaaagucaaggacgccgagaaacaguacgaaaaggaucccgacgaucuuaauaaacgggcgcuguccgaccgcgagucuaucgcucagagcauucaagggaagaucgaugagcucagacggcagcuggccgaccgcguugccgcuggaaagaacauuggcaaagaaagagauccuacagggcuugacccgggagaucaucugaaggagaaauccaugcucucuuauggcaaugugaucgaccugaaccaccuggauaucgacgaacccacggggcagaccgccgauuggcucagcauugugaucuaccugacauccuucgucgugccuauucuucugaaggcucucuauaugcugaccacacggggacgccagaccacaaaagacaauaagggcaugagaauccgguuuaaggacgauucuagcuucgaggacguuaacggcauucgcaaacccaagcaucuuuuucuguccaugccuaaugcccaaagcucuaugaaagcggaugagaucacccccgggagauuccggacggccgugugcggacucuacccugcucaggucaaggcccgcaaccugauuuccccggugaugagcguuaucggcuuucugacccucgcuaaaaauuggacagaaagaguggaggaauggcuggaccuucccuguaagcugcucucugagccuucccccaccagccugacaaaagggccuucuaccaaccgggauuaucuuucccagcgccagggagcccuggcgaagauggaaacgaaggaggcccaagucgugagaaaacacgcuaucgacgccggcugcaauauuaucgaucauauugacagccccuccucuaucuggguguucgcuggggccccggaucgguguccucccacaugccucuuuauugccggaauggcugagcugggcgcguucuuugccguccugcaggacaugagaaacaccaucauggcuagcaagacaaucggcaccuccgaagagaaacuccgcaagaaaagcucuuucuaccaguccuaucugcggagaacccaaagcauggggauucagcuugaucagcgcaucauuguucuguuuaugaucgaauggggaaaggaggccguggacucuuuccaccucggcgacgauauggacccugaaauucggagccuggcccaggcucuuaucgaucaaaaggugaaagagaucuccaaucaggagccccugaagcucuga

SEQ ID NO: 6997 - RNA, 1290 nt, Artificial Sequence
  derived and/or modified CDS sequence (opt5) from DOBV(Slovakia/400Af/98)__AY168576.1__N
auggccacccuggaggaacuccagaaggagaucaacaaucacgaaggccaacuggugauugcuagacagaaagucaaggacgccgagaaacaguacgaaaaggaucccgacgaucuuaacaaacgggcgcugagcgaccgcgaguccaucgcucagucuauucaagggaagaucgaugagcucagacggcagcuggccgaccgcguugccgcuggaaagaauauuggcaaagaaagagauccuacagggcuugacccgggagaucaucugaaggagaaaagcaugcucuccuauggcaacgugaucgaccugaaucaccuggauaucgacgaacccacggggcagaccgccgauuggcucucuauuguggucuaccugaccagcuucgugguuccuauccuucugaaggcucucuauaugcugacaacacggggacgccagaccacaaaagacaacaagggcaugcggauuagauuuaaggacgauuccucuuucgaggacgugaauggcauccgcaaacccaagcaucuuuuucugagcaugccuaacgcccaauccagcaugaaagcggaugagauuacccccgggagauuccggacggccaucugcggacucuacccugcucaggucaaggcccgcaaucugauuucuccggugauguccguuaucggcuuucuggcucucgccaaaaacuggaccgaaagaguggaggaauggcuggaccuucccuguaagcugcucagcgagccuucucccacaucccugaccaaagggccuagcacaaaucgggauuaucuuaaccagcgccagggagcgcuggccaagauggaaaccaaggaggcucaagccgucagaaaacacgcuaucgacgccggcugcaaucucauugaucauaucgacucucccuccagcauuuggguguucgccggggcuccggaucgguguccucccacgugccuguuuaucgcgggaauggccgagcugggcgcuuucuuugccgugcuccaggacaugagaaacacaauuauggccuccaagaccaucggcacaucugaagagaaacugaagaaaaagagcuccuucuaccagagccuucugcgccggacccaaucuauggggauccagcucgaucagagaauuaucguccuguuuaugguugacuggggaaaggaagcuguggacuccuuccaccuuggcgaugacauggauccugagcugcgcgggcucgcccaggcgcugauugaccaaaaagugaaggaaaucagcaaucaggagccccugaaacucuga

SEQ ID NO: 6998 - RNA, 1290 nt, Artificial Sequence
  derived and/or modified CDS sequence (opt5) from DOBV(Slovakia-856-Aa)__AJ269549.1__N
auggccacccuggaggaacuccagaaggagaucaacagccacgaaggccaacuggugauugcuagacagaaagucaaggacgccgagaaacaguacgaaaaggaucccgacgaucuuaauaaacgggcgcuguccgaccgcgagucuguugcucagagcauccaauccaagauugaugagcucagacggcagcuggccgaccgcguggccgcugggaagaacaucggaaaagaaagagauccuacaggccuugacccgggggaucaucugaaggagaaaucuaugcucagcuauggaaaugugauugaccugaaccaccuggauaucgacgaacccacgggccagaccgccgauuggcucuccaucgucguguaccugacaucuuucguugugccuauucuucugaaggcucucuauaugcugaccacacgggggcgccagaccacaaaagacaauaagggaaugagaauccgguuuaaggacgauagcuccuucgaggacgucaacggcauucgcaaacccaagcaucuuuuucugagcaugccuaaugcccaaucuuccaugaaagcggaugagaucacccccggcagauuccggacggccauuugcgggcucuacccugcucaggugaaggcccgcaaccugguuagcccggugaugucugucaucggauuuauggcucuggccaaaaauuggaccgaaagaguggaggaauggcucgaccugcccuguaaacuucuguccgagccuagccccacaucucucaccaagggcccuuccacaaaccgggauuaucugaaucagcgccagggggcgcuugccaagauggaaaccaaggaggcucaagccgugagaaaacacgcuauugacgccggaugcaacaucaucgaucauauugacagccccuccucuaucugggucuucgccccggcuccugaucggugucccccuacgugccuguuuauugcgggcauggccgagcucggggcuuucuuuagcguucugcaggacaugagaaauacaaucauggccuccaagaccauuggaacaagcgaagagaaacugcgcaagaaaucuuccuucuaccagagcuaucuccggagaacccaaucuaugggcauccagcuggaucagcgcaucauugugcuuuuuaugguggacuggggcaaggaagccgucgacagcuuccaccugggggaugacauggaucccgagcuccggggacuggcucaggcccuuaucgaccaaaaggugaaagaaauuuccaaccaggagccccugaagcucuga

SEQ ID NO: 6999 - RNA, 1290 nt, Artificial Sequence
  derived and/or modified CDS sequence (opt5) from DOBV(Slovakia-862-Aa)__AJ269550.1__N
auggccacccuggaggaacuccagaaggagaucaacagccacgaaggccaacuggugauugcuagacagaaagucaaggacgccgagaaacaguacgaaaaggaucccgacgaucuuaauaaacgggcgcuguccgaccgcgagucuguugcucagagcauccaauccaagauugaugagcucagacggcagcuggccgaccgcguggccgcugggaagaacaucggaaaagaaagagauccuacaggccuugacccgggggaucaucugaaggagaaaucuaugcucagcuauggaaaugugauugaccugaaccaccuggauaucgacgaacccacgggccagaccgccgauuggcucuccaucgucguguaccugacaucuuucguugugccuauucuucugaaggcucucuauaugcugaccacacgggggcgccagaccacaaaagacaauaagggaaugagaauccgguuuaaggacgauagcuccuucgaggacgucaacggcauucgcaaacccaagcaucuuuuucugagcaugccuaaugcccaaucuuccaugaaagcggaugagaucacccccggcagauuccggacggccauuugcgggcucuacccugcucaggugaaggcccgcaaccugguuagcccggugaugucugucaucggauuuauggcucuggccaaaaauuggaccgaaagaguggaggaauggcucgaccugcccuguaaacuucuguccgagccuagccccacaucucucaccaagggcccuuccacaaaccgggauuaucugaaucagcgccagggggcgcuugccaagauggaaaccaaggaggcucaagccgugagaaaacacgcuauugacgccggaugcaacaucaucgaucauauugacagccccuccucuaucugggucuucgccggccggccggauagauguccucccacgugccuguuuauugcugggauggcggagcucggagccuucuuuagcguucugcaggacaugcgcaauacaaucauggcuuccaagaccauuggcacaagcgaagagaaacugcggaagaaaucuuccuucuaccagagcuaucucagacgcacccaaucuaugggcauccagcuggaucagcggaucauugugcuuuuuaugguggacugggggaaggaagccgucgacagcuuccaccugggagaugacauggauccugagcucagaggccuggcccaggcucuuaucgaccaaaaggugaaagaaauuuccaaccaggagccccugaagcucuga

SEQ ID NO: 7000 - RNA, 1290 nt, Artificial Sequence
  derived and/or modified CDS sequence (opt5) from DOBV(Esl/29Aa/01)__AY533118.2__N
auggccacccuggaggaacuccagaaggagaucaacagccacgaaggccaacuggugauugcuagacagaaagucaaggacgccgagaaacaguacgaaaaggaucccgacgaucuuaauaaacgggcgcuguccgaccgcgagucuguugcucagagcauccaauccaagauugaugagcucagacggcagcuggccgaccgcguggccgcugggaagaacaucggaaaagaaagagauccuacaggccuugacccgggggaucaucugaaggagaaaucuaugcucagcuauggaaaugugauugaccugaaccaccuggauaucgacgaacccacgggccagaccgccgauuggcucuccaucgucguguaccugacaucuuucguugugccuauucuucugaaggcucucuauaugcugaccacacgggggcgccagaccacaaaagacaauaagggaaugagaauccgguuuaaggacgauagcuccuucgaggacgucaacggcauucgcaaacccaagcaucuuuuucugagcaugccuaaugcccaaucuuccaugaaagcggaugagaucacccccggcagauuccggacggccauuugcgggcucuacccugcucaggugaaggcccgcaaccugguuagcccggugaugucugucaucggauuucuggcucucgccaaaaauuggaccgaaagaguggaggaauggcuggaccuucccuguaagcugcucuccgagccuagccccacaucucugaccaaaggcccuuccacaaaccgggauuaucuuaaucagcgccagggggcgcuggccaagauggaaaccaaggaggcucaagccgugagaaaacacgcuauugacgccggaugcaacaucaucgaucauauugacagccccuccucuaucugggucuucgccggcgcuccggaucgguguccucccacgugccucuuuauugcggggauggccgagcugggagcuuucuuuagcguucugcaggacaugagaaauacaaucauggccuccaagaccauuggcacaagcgaagagaaacuccgcaagaaaucuuccuucuaccagagcuaucugcggagaacccaaucuaugggcauccagcuugaucagcgcaucauugugcuguuuaugguggacugggggaaggaagccgucgacagcuuccaccucggagaugacauggauccugagcugcggggccuugcucaggcccugaucgaccaaaaggugaaagaaauuuccaaccaggagccccucaagcuguga

SEQ ID NO: 7001 - RNA, 1290 nt, Artificial Sequence
  derived and/or modified CDS sequence (opt5) from DOBV(Kurkino/44Aa/98)__AJ131672.1__N
auggccacccuggaggaacuccagaaggagaucaacagccacgaaggccaacuggugauugcuagacagaaagucaaggacgccgagaaacagcaugaaaaggaucccgacgaucuuaauaaacgggcgcuguccgaccgcgagucuguugcucagagcauccaauccaagauugaugagcucagacggcagcuggccgaccgcguggccgcugggaagaacaucggaaaagaaagagauccuacaggccuugacccgggggaucaccugaaggagaaaucuaugcucagcuacggaaaugugauugaccugaaccaucuggauaucgacgaacccacgggccagaccgccgauuggcucuccaucgucguguaucugacaucuuucguugugccuauucuucugaaggcucucuacaugcugaccacacgggggcgccagaccacaaaagacaauaagggaaugagaauccgguuuaaggacgauagcuccuucgaggacgucaacggcauucgcaaacccaagcaccuuuuucugagcaugccuaaugcccaaucuuccaugaaagcggaugagaucacccccggcagauuccggacggccauuugcgggcucuauccugcucaggugaaggcccgcaaccugguuagcccggugaugucugucaucggauuucuggcucucgccaaaaauuggaccgaaagaguggaggaauggcuggaccuucccuguaagcugcucuccgagccuagccccacaucucugaccaaaggcccuuccacaaaccgggauuaccuuaaucagcgccaggcggcccuggcuaagauggaaaccaaggaggcccaagcugugagaaaacaugccauugacgccgggugcacgaucaucgauuauauugacagccccuccucuaucugggucuucgcuggagcgccggaucgguguccucccacaugccucuuuauugccggcauggcugagcugggggccuucuuuagcguucugcaggacaugagaaacaccaucauggccuccaagacagugggaaccagcgaagagaaacuccgcaagaaaucuuccuucuaccagagcuaucugcggagaacccaaucuaugggcauucagcuugaucagcgcaucaucgugcuguuuauggucgacuggggcaaggaagcuguggacagcuuccaccucggggaugacauggauccugagcugcggggacuugcccaggcgcugauugaccaaaagguuaaagaaaucuccaauagagagccccucaagcuguga

SEQ ID NO: 7002 - RNA, 1290 nt, Artificial Sequence
  derived and/or modified CDS sequence (opt5) from DOBV(Kurkino/53Aa/98)__AJ131673.1__N
auggccacccuggaggaacuccagaaggagaucaacagccacgaaggccaacuggugauugcuagacagaaagucaaggacgccgagaaacaguacgaaaaggaucccgacgaucuuaauaaacgggcgcuguccgaccgcgagucuguugcucagagcauccaauccaagauugaugagcucagacggcagcuggccgaccgcguggccgcugggaagaacaucggaaaagaaagagauccuacaggccuugacccgggggaucaucugaaggagaaaucuaugcucagcuauggaaaugugauugaccugaaccaccuggauaucgacgaacccacgggccagaccgccgauuggcucuccaucgucguguaccugacaucuuucguugugccuauucuucugaaggcucucuauaugcugaccacacgggggcgccagaccacaaaagacaauaagggaaugagaauccgguuuaaggacgauagcuccuucgaggacgucaacggcauucgcaaacccaagcaucuuuuucugagcaugccuaaugcccaaucuuccaugaaagcggaugagaucacccccggcagauuccggacggccauuugcgggcucuacccugcucaggugaaggcccgcaaccugguuagcccggugaugucugucaucggauuucuggcucucgccaaaaauuggaccgaaagaguggaggaauggcuggaccuucccuguaagcugcucuccgagccuagccccacaucucugaccaaaggcccuuccacaaaccgggauuaucuuaaucagcgccaggcggcccuggcuaagauggaaaccaaggaggcccaagcugugagaaaacacgccauugacgccgggugcacgaucaucgaucauauugacagccccuccucuaucugggucuucgcuggagcgccggaucgguguccucccacaugccucuuuauugccggcauggcugagcugggggccuucuuuagcguucugcaggacaugagaaacaccaucauggccuccaagacagugggaaccagcgaagagaaacuccgcaagaaaucuuccuucuaccagagcuaucugcggagaacccaaucuaugggcauucagcuugaucagcgcaucaucgugcuguuuauggucgacuggggcaaggaagcuguggacagcuuccaccucggggaugacauggauccugagcugcggggacuugcccaggcgcugauugaccaaaagguuaaagaaaucuccaauagagagccccucaagcuguga

SEQ ID NO: 7003 - RNA, 1290 nt, Artificial Sequence
  derived and/or modified CDS sequence (opt5) from DOBV(Saar/90Aa/97)__AJ009775.1__N
auggccacccuggaggaacuccagaaggagaucaacagccacgaaggccaacuggugauugcuagacagaaagucaaggacgccgagaaacaguacgaaaaggaucccgacgaucuuaauaaacgggcgcuguccgaccgcgagucuaucgcucagagcauucaagggaagaucgaugagcucagacggcagcuggccgaccgcguugccgcuggaaagaacauuggcagagaacgggauccuacagggcuugacccgggagaucaucugaaagagaaguccaugcucucuuauggcaaugugaucgaccugaaccaccuggauaucgacgaacccacggggcagaccgccgauuggcucagcauugugaucuaccugacauccuucgucgugccuauucuucugaaagcucucuauaugcugaccacacgcggaagacagaccacaaaggacaauaaaggcaugcggauccgcuuuaaggacgauucuagcuucgaggacguuaacggcauuagaaagcccaaacaucuuuuucuguccaugccuaaugcccaaagcucuaugaaggcggaugagaucacccccgggcgguuccgcacggccgugugcggacucuacccugcucaggucaaagccagaaaccugauuuccccggugaugagcguuaucggcuuucugacccucgcuaagaauuggacagaacggguggaggaauggcuggaccuucccuguaaacugcucucugagccuucccccaccagccugacaaaggggccuucuaccaaccgcgauuaucuuucccagagacagggagcccuggcgaaaauggaaacgaaggaggcccaagcuguccggaagcacgccaucgacgcuggcugcaauauuaucgaucauauugacagccccuccucuaucuggguguucgccggggccccggauagauguccucccacaugccucuuuauugcuggaauggcggagcugggcgccuucuuugcugugcugcaggacaugcgcaacaccaucauggccagcaaaacaaucggcaccuccgaagagaagcuccggaaaaagagcucuuucuaccaguccuaucugagacgcacccaaagcauggggauucagcuugaucagcggaucauuguccuguuuaugaucgaauggggaaaagaggccguugacucuuuccaccucggcgacgauauggacccugaaauuagaagccuggcucaggcccuuaucgaucaaaaggugaaggagaucuccaaucaggagccccugaaacucuga

SEQ ID NO: 7004 - RNA, 1290 nt, Artificial Sequence
  derived and/or modified CDS sequence (opt5) from DOBV(SK/Aa)__AY961615.1__N
auggccacccuggaggaacuccagaaggagaucaacagccacgaaggccaacuggugauugcuagacagaaagucaaggacgccgagaaacaguacgaaaaggaucccgacgaucuuaauaaacggacacuguccgaccgcgagucuguugcgcagagcauccaauccaagauugaugagcucagacggcagcuggcugaccgcguggccgccgggaagaacaucggaaaagaaagagauccuacgggccuugacccgggggaucaucugaaggagaaaucuaugcucagcuauggaaaugugauugaccugaaccaccuggauaucgacgaacccaccggccagacagcugauuggcucuccaucgucguguaccugaccucuuucguugugccuauucuucugaaggcccucuauaugcugacaacccgggggcgccagacaaccaaagacaauaagggaaugagaauccgguuuaaggacgauagcuccuucgaggacgucaacggcauucgcaaacccaagcaucuuuuucugagcaugccuaaugcucaaucuuccaugaaagccgaugagaucacgcccggcagauuccggaccgcgauuugcgggcucuacccugcccaggugaaggcucgcaaccugguuagcccggugaugucugucaucggauuucuggcccucgcuaaaaauuggacagaaagaguggaggaauggcuggaccuucccuguaagcugcucuccgagccuagccccaccucucugacaaaaggcccuuccaccaaccgggauuaucuuaaucagcgccagggggcccuggcgaagauggaaacgaaggaggcccaagcugugagaaaacacgccauugacgcuggaugcaacaucaucgaucauauugacagccccuccucuaucugggucuucgccggcgccccggaucgguguccucccacaugccucuuuauugcugggauggcggagcugggagccuucuuuagcguucugcaggacaugagaaauaccaucauggcuuccaagacaauuggcaccagcgaagagaaacuccgcaagaaaucuuccuucuaccagagcuaucugcggagaacccaaucuaugggcauccagcuugaucagcgcaucauugugcuguuuaugguggacugggggaaggaagccgucgacagcuuccaccucggagaugacauggauccugagcugcggggccuugcccaggcucugaucgaccaaaaggugaaagaaauuuccaaccaggagccccucaagcuguga

SEQ ID NO: 7005 - RNA, 1290 nt, Artificial Sequence
  derived and/or modified CDS sequence (opt5) from DOBV(A35)__GU904030.1__N
auggccacccuggaggaacuccagaaggagaucaacaaucacgaaggccaacuggugauugcuagacagaaagucaaggacgccgagaaacaguacgaaaaggaucccgacgaucuuaacaaacgggcgcugagcgaccgcgaguccaucgcucagucuauucaagggaagaucgaugagcucagacggcagcuggccgaccgcguugccgcuggaaagaauauuggcaaagaaagagauccuacagggcuugacccgggagaucaucugaaggagaaaagcaugcucuccuauggcaacgugaucgaccugaaucaccuggauaucgacgaacccacggggcagaccgccgauuggcucucuauugugaucuaccugaccagcuucgucgugccuauucuucugaaggcucucuauaugcugacaacacggggacgccagaccacaaaagacaacaagggcaugagaauccgguuuaaggacgauuccucuuucgaggacguuaauggcauucgcaaacccaagcaucuuuuucugagcaugccuaacgcccaauccagcaugaaagcggaugagaucacccccgggagauuccggacggccauuugcggacucuacccugcucaggugaaggcccgcaaucugaucucuccggucauguccgugaucggcuuuguugcucuggccaaaaacuggaccgaaagaguggaggaauggcucgaccugcccuguaaacuucugagcgagccuucucccacaucccucaccaaggggccuagcacaaaucgggauuaucugaaccagcgccagggagcgcuugccaagauggaaaccaaggaggcucaagccgucagaaaacacgcuauugacgccggcugcaaucugaucgaucauauugacucucccuccagcaucuggguguucgccggggcuccggaucgguguccucccacgugccucuuuauugcgggaauggccgagcugggcgcuuucuuugccgugcugcaggacaugagaaacacaaucauggccuccaagaccaucggcacaucugaagagaaacucaagaaaaagagcuccuucuaccagagcuaucugcgccggacccaaucuauggggauucagcuugaucagagaaucauuguccuguuuaugguugacuggggaaaggaagcuguggacuccuuccaccucggcgaugacauggauccugagcugcgcgggcuugcccaggcgcugaucgaccaaaaagugaaggaaauuagcaaucaggagccccucaaacuguga

SEQ ID NO: 7006 - RNA, 1290 nt, Artificial Sequence
  derived and/or modified CDS sequence (opt5) from DOBV(3970/87)__L41916.1__N
auggccacccuggaggaacuccagaaggagaucaacaaucacgaaggccaacuggugauugcuagacagaaagucaaggacgccgagaaacaguacgaaaaggaucccgacgaucuuaacaaacgggcgcugagcgaccgcgaguccaucgcucagucuauucaagggaagaucgaugagcucagacggcagcuggccgaccgcguugccgcuggaaagaauauuggcaaagaaagagauccuacagggcuugacccgggagaucaucugaaggagaaaagcaugcucuccuauggcaacgugaucgaccugaaucaccuggauaucgacgaacccacggggcagaccgccgauuggcucucuauugugaucuaccugaccagcuucgucgugccuauucuucugaaggcucucuauaugcugacaacacggggacgccagaccacaaaagacaacaagggcaugagaauccgguuuaaggacgauuccucuuucgaggacguuaauggcauucgcaaacccaagcaucuuuuucugagcaugccuaacgcccaauccagcaugaaagcggaugagaucacccccgggagauuccggacggccauuugcggacucuacccugcucaggugaaggcccgcaaucugaucucuccggucauguccgugaucggcuuuguugcucuggccaaaaacuggaccgaaagaguggaggaauggcucgaccugcccuguaaacuucugagcgagccuucucccacaucccucaccaaggggccuagcacaaaucgggauuaucugaaccagcgccagggagcgcuugccaagauggaaaccaaggaggcucaagccgucagaaaacacgcuauugacgccggcugcaaucugaucgaucauauugacucucccuccagcaucuggguguucgccggggcuccggaucgguguccucccacgugccucuuuauugcgggaauggccgagcugggcgcuuucuuugccugucugcaggacaugagaaacacaaucauggccuccaagaccaucggcacaucugaagagaaacucaagaaaaagagcuccuucuaccagagcuaucugcgccggacccaaucuauggggauucagcuugaucagagaaucauugugcuguuuauggucgacuggggaaaggaagcuguugacuccuuccaccucggcgaugacauggauccugagcugcgcgggcuugcccaggcgcugaucgaccaaaaagugaaggaaauuagcaaucaggagccccucaaacuguga

SEQ ID NO: 7007 - RNA, 1290 nt, Artificial Sequence
  derived and/or modified CDS sequence (opt5) from DOBV(Klyuch-2000)__AF442622.1__N
auggccacccuggaggaacuccagaaggagaucaacagccacgaaggccaacuggugauugcuagacggaaagucaaggacgccgagaaacaguacgaaaaggaucccgacgaucuuaauaaacgcgcgcuguccgacagagagucuguugcucagagcauccaggggaagauugaugagcuccggcgccaacuggccgacagaguggccgcuggaaagaacaucggcaaagaacgggauccuacagggcuugacccgggagaucaucugaaggagaaauccaugcucucuuauggcaaugugauugaccugaaccaccuggauaucgacgaacccacggggcagaccgccgauuggcucagcaucgucguguaccugacauccuucguugugccuauucuucugaaggcucucuauaugcugaccacacgcggaagacagaccacaaaagacaauaagggcaugcggauccgcuuuaaggacgauucuagcuucgaggacgucaacggcauuagaaaacccaagcaucuuuuucuguccaugccuaaugcccagagcucuaugaaagcggaugagaucacccccgggcgguuccgcacggccgugugcggacucuacccugcucaaguuaaggccagaaaccugguguccccggucaugagcgugauuggcuuugugucucuggcuaaaaauuggaccgaacgggucgaggaauggcucgaccugcccuguaaacuucuguccgagccuagccccacaucucucaccaaggggccuuccacaaaccgcgauuaucugaaucagagacagggagcccuugcgaagauggaaaccaaggaggcccaggcuguucggaaacacgccaucaacgcuggcugcaaucugguggaccauauugauagccccuccucuaucuggguguucgccggggccccggacagauguccucccacgugccucuuugucgcuggaauggcggagcugggcgccuucuuugcugugcugcaagauaugcgcaacacaaucauggccagcaagaccauuggcacauccgaagagaaacuccggaagaaaagcucuuucuaccaguccuaucugagacgcacccagagcauggggauccaacuugaccagcggauuaucguucuguuuaugguggauuggggaaaggaagccgucgacucuuuccaccucggcgacgauauggacccugagcugagagggcuugcucaggcccugauugaacagaaggugaaagagaucagcaaucaagagccccucaagcuguga

SEQ ID NO: 7008 - RNA, 1290 nt, Artificial Sequence
  derived and/or modified CDS sequence (opt5) from DOBV(10636/Ap)__KP878311.1__N
auggccacccuggaggaacuccagaaggagaucaacaaucacgaaggccaacuggugauugcuagacagaaagucaaggacgccgagaaacaguacgaaaaggaucccgacgaucuuaacaaacgggcgcugagcgaccgcgaguccguugcucagucuauccaagggaagauugaugagcucagacggcagcuggccgaccgcguggccgcuggaaagaauaucggcaaagaaagagauccuacagggcuugacccgggagaucaucugaaggagaaaagcaugcucuccuauggcaacgugauugaccugaaucaccuggauaucgacgaacccacggggcagaccgccgauuggcucucuaucgucguguaccugaccagcuucguugugccuauucuucugaaggcucucuauaugcugacaacacggggacgccagaccacaaaagacaacaagggcaugagaauccgguuuaaggacgauuccucuuucgaggacgucaauggcauucgcaaacccaagcaucuuuuucugagcaugccuaacgcccaauccagcaugaaagcggaugagaucacccccgggagauuccggacggccgugugcggacucuacccugcucagguuaaggcccgcaaucuggugucuccggucauguccgugauuggcuuugugagccuggcuaaaaacuggaccgaaagagucgaggaauggcucgaccugcccuguaaacuucugucugagccuucccccacaagccucaccaaggggccuucuacaaaucgggauuaucugaaccagcgccagggagcccuugcgaagauggaaaccaaggaggcccaagcuguuagaaaacacgccaucgacgcuggcugcaaucugguggaucauauugacucccccagcuccaucuggguguucgccggggccccggaucgguguccucccacgugccucuuugucgcuggaauggcggagcugggcgccuucuuugcugugcugcaggacaugagaaacacaaucauggccucuaagaccauuggcacaagcgaagagaaacuccgcaagaaauccagcuucuaccagucuuaucugcggagaacccaauccauggggauccagcuugaucagcgcauuaucguucuguuuaugguggacuggggaaaggaagccgucgacagcuuccaccucggcgaugacauggauccugagcugcggucucuugcucaggcccugauugaccaaaaggugaaagaaaucagcaaucaggagccccucaagcuguga

SEQ ID NO: 7009 - RNA, 1290 nt, Artificial Sequence
  derived and/or modified CDS sequence (opt5) from DOBV(10645/Ap)__KP878312.1__N
auggccacccuggaggaacuccagaaggagaucaacaaucacgaaggccaacuggugauugcuagacagaaagucaaggacgccgagaaacaguacgaaaaggaucccgacgaucuuaacaaacgggcgcugagcgaccgcgaguccguugcucagucuauccaagggaagauugaugagcucagacggcagcuggccgaccgcguggccgcuggaaagaauaucggcaaagaaagagauccuacagggcuugacccgggagaucaucugaaggagaaaagcaugcucuccuauggcaacgugauugaccugaaucaccuggauaucgacgaacccacggggcagaccgccgauuggcucucuaucgucguguaccugaccagcuucguugugccuauucuucugaaggcucucuauaugcugacaacacggggacgccagaccacaaaagacaacaagggcaugagaauccgguuuaaggacgauuccucuuucgaggacgucaauggcauucgcaaacccaagcaucuuuuucugagcaugccuaacgcccaauccagcaugaaagcggaugagaucacccccgggagauuccggacggccgugugcggacucuacccugcucagguuaaggcccgcaaucuggugucuccggucauguccgugauuggcuuugugagccuggcuaaaaacuggaccgaaagagucgaggaauggcucgaccugcccuguaaacuucugucugagccuucccccacaagccucaccaaggggccuucuacaaaucgggauuaucugaaccagcgccagggagcccuugcgaagauggaaaccaaggaggcccaagcuguuagaaaacacgccaucgacgcuggcugcaaucugguggaucauauugacucccccagcuccaucuggguguucgccggggccccggaucgguguccucccacgugccucuuugucgcuggaauggcggagcugggcgccuucuuugcugugcugcaggacaugagaaacacaaucauggccucuaagaccauuggcacaagcgaagagaaacuccgcaagaaauccagcuucuaccagucuuaucugcggagaacccaauccauggggauccagcuugaucagcgcauuaucguucuguuuaugguggacuggggaaaggaagccgucgacagcuuccaccucggcgaugacauggauccugagcugcgggggcuugcucaggcccugauugaccaaaaggugaaagaaaucucuaaucaggagccccucaagcuguga

SEQ ID NO: 7010 - RNA, 1290 nt, Artificial Sequence
  derived and/or modified CDS sequence (opt5) from DOBV(Aa1854/Lipetsk-02)__EU188452.1__N
auggccacccuggaggaacuccagaaggagaucaacagccacgaaggccaacuggugauugcuagacagaaagucaaggacgccgagaaacaguacgaaaaggaucccgacgaucuuaauaaacgggcgcuguccgaccgcgagucuguugcucagagcauccaauccaagauugaugagcucagacggcagcuggccgaccgcguggccgcugggaagaacaucggaaaagaaagagauccuacaggccuugacccgggggaucaucugaaggagaaaucuaugcucagcuauggaaaugugauugaccugaaccaccuggauaucgacgaacccacgggccagaccgccgauuggcucuccaucgucguguaccugacaucuuucguugugccuauucuucugaaggcucucuauaugcugaccacacgggggcgccagaccacaaaagacaauaagggaaugagaauccgguuuaaggacgauagcuccuucgaggacgucaacggcauucgcaaacccaagcaucuuuuucugagcaugccuaaugcccaaucuuccaugaaagcggaugagaucacccccggcagauuccggacggccauuugcgggcucuacccugcucaggugaaggcccgcaaccugguuagcccggugaugucugucaucggauuucuggcucucgccaaaaauuggaccgaaagaguggaggaauggcuggaccuucccuguaagcugcucuccgagccuagccccacaucucugaccaaaggcccuuccacaaaccgggauuaucuuaaucagcgccaggcggcccuggcuaagauggaaaccaaggaggcccaagcugugagaaaacacgccauugacgccgggugcacgaucaucgaucauauugacagccccuccucuaucugggucuucgcuggagcgccggaucgguguccucccacaugccucuuuauugccggcauggcugagcugggggccuucuuuagcguucugcaggacaugagaaacaccaucauggccuccaagccugugggaacaagcgaagagaaacuccgcaagaaaucuuccuucuaccagagcuaucugcggagaacccaaucuaugggcauucagcuugaucagcgcaucaucgugcuguuuauggucgacuggggcaaggaagcuguggacagcuuccaccucggggaugacauggaucccgagcugcggggacuugcccaggcgcugauugaccaaaagguuaaagaaaucuccaaucaggagccccucaagcuguga

SEQ ID NO: 7011 - RNA, 1290 nt, Artificial Sequence
  derived and/or modified CDS sequence (opt5) from DOBV(Ap/Sochi/43)__JF920151.1__N
auggccacccuggaggaacuccagaaggagaucaacaaucacgaaggccaacuggugauugcuagacagaaagucaaggacgccgagaaacaguacgaaaaggaucccgacgaucuuaacaaacgggcgcugagcgaccgcgaguccguugcucagucuauccaagggaagauugaugagcucagacggcagcuggccgaccgcguggccgcuggaaagaauaucggcaaagaaagagauccuacagggcuugacccgggagaucaucugaaggagaaaagcaugcucuccuauggcaacgugauugaccugaaucaccuggauaucgacgaacccacggggcagaccgccgauuggcucucuaucgucguguaccugaccagcuucguugugccuauucuucugaaggcucucuauaugcugacaacacggggacgccagaccacaaaagacaacaagggcaugagaauccgguuuaaggacgauuccucuuucgaggacgucaauggcauucgcaaacccaagcaucuuuuucugagcaugccuaacgcccaauccagcaugaaagcggaugagaucacccccgggagauuccggacggccgugugcggacucuacccugcucagguuaaggcccgcaaucuggugucuccggucauguccgugauuggcuuugugagccuggcuaaaaacuggaccgaaagagucgaggaauggcucgaccugcccuguaaacuucugucugagccuucccccacaagccucaccaaggggccuucuacaaaucgggauuaucugaaccagcgccagggagcccuugcgaagauggaaaccaaggaggcccaagcuguuagaaaacacgccaucgacgcuggcugcaaucugguggaucauauugacucccccagcuccaucuggguguucgccggggccccggaucgguguccucccacgugccucuuugucgcuggaauggcggagcugggcgccuucuuugcugugcugcaggacaugagaaacacaaucauggccucuaagaccauuggcacaagcgaagagaaacuccgcaagaaauccagcuucuaccagucuuaucugcggagaacccacuccauggggauccaacuugaucagcgcauuaucguucuguuuaugguggacuggggaaaggaagccgucgacagcuuccaccucggcgaugacauggauccugagcugcgggggcuugcucaggcccugauugaccagaaggugaaagaaaucucuaaucaagagccccucaagcuguga

SEQ ID NO: 7012 - RNA, 1290 nt, Artificial Sequence
  derived and/or modified CDS sequence (opt5) from DOBV(Ap/Sochi/hu)__JF920150.1__N
auggccacccuggaggaacuccagaaggagaucaacaaucacgaaggccaacuggugauugcuagacagaaagucaaggacgccgagaaacaguacgaaaaggaucccgacgaucuuaacaaacgggcgcugagcgaccgcgaguccguugcucagucuauccaagggaagauugaugagcucagacggcagcuggccgaccgcguggccgcuggaaagaauaucggcaaagaaagagauccuacagggcuugacccgggagaucaucugaaggagaaaagcaugcucuccuauggcaacgugauugaccugaaucaccuggauaucgacgaacccacggggcagaccgccgauuggcucucuaucgucguguaccugaccagcuucguugugccuauucuucugaaggcucucuauaugcugacaacacggggacgccagaccacaaaagacaacaagggcaugagaauccgguuuaaggacgauuccucuuucgaggacgucaauggcauucgcaaacccaagcaucuuuuucugagcaugccuaacgcccaauccagcaugaaagcggaugagaucacccccgggagauuccggacggccgugugcggacucuacccugcucagguuaaggcccgcaaucuggugucuccggucauguccgugauuggcuuucugagccucgcuaaaaacuggaccgaaagaguggaggaauggcuggaccuucccuguaagcugcucucugagccuucccccacaagccugaccaaagggccuucuacaaaucgggauuaucuuaaccagcgccagggagcccuggcgaagauggaaaccaaggaggcccaagcugucagaaaacacgccaucgacgcuggcugcaaucucguugaucauauugacucccccagcuccaucuggguguucgccggggccccggaucgguguccucccacgugccuguuuguggcuggaauggcggagcugggcgccuucuuugcuguccuccaggacaugagaaacacaaucauggccucuaagaccauuggcacaagcgaagagaaacugcgcaagaaauccagcuucuaccagucuuaucuucggagaacccacuccauggggauccaacuggaucagcgcauuaucgugcucuuuaugguugacuggggaaaggaagccguggacagcuuccaccugggcgaugacauggauccugagcuucgggggcuggcucaggcccucauugaccagaaggucaaagaaaucucuaaucaagagccccugaagcuguga

SEQ ID NO: 7013 - RNA, 1290 nt, Artificial Sequence
  derived and/or modified CDS sequence (opt5) from DOBV(Ap1584/Sochi-01)__EU188449.1__N
auggccacccuggaggaacucaagaaagagaucaacaaucacgaaggccagcuggugauugcuagacaaaaggucaaagacgccgagaagcaguacgaaaaagaucccgacgaucuuaacaagcgggcgcugagcgaccgcgaguccguugcucagucuauccaggggaagauugaugagcucagacggcaacuggccgaccgcguggccgcuggaaagaauaucggcaaggaaagagauccuacagggcuugacccgggagaucaucugaaagagaaaagcaugcucuccuauggcaacgugauugaccugaaucaccuggauaucgacgaacccacggggcagaccgccgauuggcucucuaucgucguguaccugaccagcuucguugugccuauucuucugaaagcucucuauaugcugacaacacggggacgccagaccacaaaggacaacaagggcaugagaauccgguuuaaagacgauuccucuuucgaggacgucaauggcauucgcaagcccaaacaucuuuuucugagcaugccuaacgcccaguccagcaugaaggcggaugagaucacccccgggagauuccggacggccgugugcggacucuacccugcucaaguuaaagcccgcaaucuggugucuccggucauguccgugauuggcuuugugagccuggcuaagaacuggaccgaaagagucgaggaauggcucgaccugcccuguaaacuucugucugagccuucccccacaagccucaccaaggggccuucuacaaaucgggauuaucugaaccagcgccagggagcccuugcgaagauggaaaccaaagaggcccaggcuguuagaaagcacgccaucgacgcuggcugcaaucugguggaucauauugacucccccagcuccaucuggguguucgccggggccccggaucgguguccucccacgugccucuuugucgcuggaauggcggagcugggcgccuucuuugcugugcugcaagacaugagaaacacaaucauggccucuaaaaccauuggcacaagcgaagagaagcuccgcaaaaaguccagcuucuaccagucuuaucugcggagaacccaguccauggggauccaacuugaucagcgcauuaucguucuguuuaugguggacuggggaaaggaagccgucgacagcuuccaccucggcgaugacauggauccugagcugcgggggcuugcucaggcccugauugaccagaaagugaaggaaaucucuaaucaagagccccucaaacuguga

SEQ ID NO: 7014 - RNA, 1290 nt, Artificial Sequence
  derived and/or modified CDS sequence (opt5) from DOBV(DOB/Gola/235Af/07)__KC848495.1__N
auggccacccuggaggaacuccagaaggagaucaacaaucacgaaggccaacuggugauugcuagacagaaagucaaggacgccgagaaacaguacgaaaaggaucccgacgaucuuaacaaacgggcgcugagcgaccgcgaguccaucgcucagucuauucaagggaagaucgaugagcucagacggcagcuggccgaccgcguugccgcuggaaagaauauuggcaaagaaagagauccuacagggcuugacccgggagaucaucugaaggagaaaagcaugcucuccuauggcaacgugaucgaccugaaucaccuggauaucgacgaacccacggggcagaccgccgauuggcucucuauuguggucuaccugaccagcuucgugguuccuauccuucugaaggcucucuauaugcugacaacacggggacgccagaccacaaaagacaacaagggcaugcggauuagauuuaaggacgauuccucuuucgaggacgugaauggcauccgcaaacccaagcaucuuuuucugagcaugccuaacgcccaauccagcagaaaagcggaugagauuacccccgggcgguuccgcacggccaucugcggacucuacccugcucaggucaaggccagaaaucugauuucuccggugauguccguuaucggcuuucuggcucucgccaaaaacuggaccgaacggguggaggaauggcuggaccuucccuguaagcugcucagcgagccuucucccacaucccugaccaaagggccuagcacaaaucgcgauuaucuuaaccagagacagggagcgcuggccaagauggaaaccaaggaggcucaagccguccggaaacacgcuaucgacgccggcugcaaucucauugaucauaucgacucucccuccagcauuuggguguucgccggggcuccggauagauguccucccacgugccuguuuaucgcgggaauggccgagcugggcgcuuucuuugccgugcuccaggacaugcgcaacacaauuauggccuccaagaccaucggcacaucugaagagaaacugaagaaaaagagcuccuucuaccagagcuaucuucggagaacccaaucuauggggauccagcuggaucagcgcauuaucguccucuuuaugguugacuggggaaaggaagcuguggacuccuuccaccugggcgaugacauggauccugagcuucgggggcuggcccaggcgcucauugaccaaaaagugaaggaaaucagcaaucaggagccccugaaacuguga

SEQ ID NO: 7015 - RNA, 1290 nt, Artificial Sequence
  derived and/or modified CDS sequence (opt5) from DOBV(DOB/Gola/343Af/07)__KC848498.1__N
auggccacccuggaggaacuccagaaggagaucaacaaucacgaaggccaacuggugauugcuagacagaaagucaaggacgccgagaaacaguacgaaaaggaucccgacgaucuuaacaaacgggcgcugagcgaccgcgaguccaucgcucagucuauucaagggaagaucgaugagcucagacggcagcuggccgaccgcguugccgcuggaaagaauauuggcaaagaaagagauccuacagggcuugacccgggagaucaucugaaggagaaaagcaugcucuccuauggcaacgugaucgaccugaaucaccuggauaucgacgaacccacggggcagaccgccgauuggcucucuauuguggucuaccugaccagcuucgugguuccuauccuucugaaggcucucuauaugcugacaacacggggacgccagaccacaaaagacaacaagggcaugcggauuagauuuaaggacgauuccucuuucgaggacgugaauggcauccgcaaacccaagcaucuuuuucugagcaugccuaacgcccaauccagcaugaaagcggaugagauuacccccgggagauuccggacggccaucugcggacucuacccugcucaggucaaggcccgcaaucugauuucuccggugauguccguuaucggcuuucuggcucucgccaaaaacuggaccgaaagaguggaggaauggcuggaccuucccuguaagcugcucagcgagccuucucccacaucccugaccaaagggccuagcacaaaucgggauuaucuuaaccagcgccagggagcgcuggccaagauggaaaccaaggaggcucaagccgucagaaaacacgcuacggacgccggcugcaaucucaucgaucauauugacucucccuccagcaucuggguguucgccggggcuccggaucgguguccucccacaugccuguuuauugcgggaauggccgagcugggcgcuuucuuugccgugcuccaggacaugagaaacaccaucauggccuccaagacaauuggcaccucugaagagaaacugaagaaaaagagcuccuucuaccagagcuaucuucgccggacccaaucuauggggauccagcuggaucagagaaucauuguccucuuuaugguugacuggggaaaggaagcuguggacuccuuccaccugggcgaugacauggauccugagcuucgcgggcuggcccaggcgcucaucgaccaaaaagugaaggaaauuagcaaucaggagccccugaaacuguga

SEQ ID NO: 7016 - RNA, 1290 nt, Artificial Sequence
  derived and/or modified CDS sequence (opt5) from DOBV(DOB/Pecs/27Aa/06)__KC848499.1__N
auggccacccuggaggaacuccagaaggagaucaacagccacgaaggccaacuggugauugcuagacagaaagucaaggacgccgagaaacaguacgaaaaggaucccgacgaucuuaauaaacgggcgcuguccgaccgcgagucuguugcucagagcauccaauccaagauugaugagcucagacggcagcuggccgaccgcguggccgcugggaagaacaucggaaaagaaagagauccuacaggccuugacccgggggaucaucugaaggagaaaucuaugcucagcuauggaaaugugauugaccugaaccaccuggauaucgacgaacccacgggccagaccgccgauuggcucuccaucgucguguaccugacaucuuucguugugccuauucuucugaaggcucucuauaugcugaccacacgggggcgccagaccacaaaagacaauaagggaaugagaguccgguuuaaggacgauagcuccuucgaggacgugaacggcauccgcaaacccaagcaucuuuuucugagcaugccuaaugcccaaucuuccaugaaagcggaugagauuacccccggcagauuccggacggccguuugcgggcucuacccugcucaggugaaggcccgcaaccuggucagcccggugaugucugugaucggauuucuggcucucgccaaaaauuggaccgaaagagucgaggaauggcuggaccuucccuguaagcugcucuccgagccuagccccacaucucugaccaaaggcccuuccacaaaccgggauuaucuuaaucagcgccagggggcgcuggccaagauggaaaccaaggaggcucaagccguuagaaaacacgcuauugacgccggaugcaacaucauugaucauaucgacagccccuccucuaucuggguguucgccggcgcuccggaucgguguccucccacgugccucuuuauugcggggauggccgagcugggagcuuucuuuagcgugcugcaggacaugagaaauacaaucauggccuccaagaccauuggcacaagcgaagagaaacuccgcaagaaaucuuccuucuaccagagcuaucugcggagaacccaaucuaugggcauccagcuugaucagcgcauuaucguccuguuuaugguggacugggggaaggaagccguugacagcuuccaccucggagaugacauggauccugagcugcggggccuugcucaggcccugaucgaccaaaaggugaaagaaauuuccaaccaggagccccucaagcuguga

SEQ ID NO: 7017 - RNA, 1290 nt, Artificial Sequence
  derived and/or modified CDS sequence (opt5) from DOBV(DOB/Pecs/31Aa/06)__KC848500.1__N
auggccacccuggaggaacuccagaaggagaucaacagccacgaaggccaacuggugauugcuagacagaaagucaaggacgccgagaaacaguacgaaaaggaucccgacgaucuuaauaaacgggcgcuguccgaccgcgagucuguugcucagagcauccaauccaagauugaugagcucagacggcagcuggccgaccgcguggccgcugggaagaacaucggaaaagaaagagauccuacaggccuugacccgggggaucaucugaaggagaaaucuaugcucagcuauggaaaugugauugaccugaaccaccuggauaucgacgaacccacgggccagaccgccgauuggcucuccaucgucguguaccugacaucuuucguugugccuauucuucugaaggcucucuauaugcugaccacacgggggcgccagaccacaaaagacaauaagggaaugagaauccgguuuaaggacgauagcuccuucgaggacgucaacggcauucgcaaacccaagcaucuuuuucugagcaugccuaaugcccaaucuuccaugaaagcggaugagaucacccccggcagauuccggacggccgugugcgggcucuacccugcucagguuaaggcccgcaaccuggugagcccggucaugucugugauuggauuucuggcucucgccaaaaauuggaccgaaagaguggaggaauggcuggaccuucccuguaagcugcucuccgagccuagccccacaucucugaccaaaggcccuuccacaaaccgggauuaucuuaaucagcgccagggggcgcuggccaagauggaaaccaaggaggcucaagccgucagaaaacacgcuaucgacgccggaugcaacauuaucgaucauaucgacagccccuccucuauuuggguuuucgccggcgcuccggaucgguguccucccacgugccucuuuaucgcggggauggcccagcugggagcuuucuuuagcgugcugcaggacaugagaaauacaauuauggccuccaagaccaucggcacaagcgaggaaaaacuccgcaagaaaucuuccuucuaccaaagcuaucugcggagaacccagucuaugggcauucagcuugaucagcgcaucaucgugcuguuuauggucgacugggggaaggaggccguggacagcuuccaccucggagaugacauggauccugaacugcggggccuugcucaagcccugauugaccagaagaugaaagagaucuccaaccaggaaccccucaagcuguga

SEQ ID NO: 7018 - RNA, 1290 nt, Artificial Sequence
  derived and/or modified CDS sequence (opt5) from DOBV(DOB/Sarmellek/77Aa/06)__KC848501.1__N
auggccacccuggaggaacuccagaaggagaucaacagccacgaaggccaacuggugauugcuagacagaaagucaaggacgccgagaaacaguacgaaaaggaucccgacgaucuuaauaaacgggcgcuguccgaccgcgagucuguugcucagagcauccaauccaagauugaugagcucagacggcagcuggccgaccgcguggccucugggaagaacaucggaaaagaaagagauccuacaggccuugacccgggggaucaucugacggaaaagagcaugcucuccuauggaaaugugauugaccugaaccaccuggauaucgacgagcccaccggccagacagcugauuggcucucuaucgucguguaccugaccagcuucguugugccuauucuucugaaagcccucuauaugcugacaacccgggggcgccagacaaccaaggacaauaaaggaaugagaauccgguuuaaggacgauuccagcuucgaggacgucaacggcauucgcaagcccaaacaucuuuuucugucuaugccuaaugcucaauccagcaugaaggccgaugagaucacgcccggcagauuccggaccgcgauuugcgggcucuacccugcccaggugaaagcucgcaaccugguuucuccggugauguccgucaucggauuucuggcccucgcuaagaauuggacagaaagaguggaggaauggcuggaccuucccuguaaacugcucagcgagccuucucccaccucccugacaaagggcccuagcaccaaccgggauuaucuuaaucagcgccagggggcccuggcgaaaauggaaacgaaggaggcccaagcugugagaaagcacgccauugacgcuggaugcaacaucaucgaucauauugacucccccucuagcaucugggucuucgccggcgccccggaucgguguccucccacaugccucuuuauugcugggauggcggagcugggagccuucuuuuccguucugcaggacaugagaaauaccaucauggcuagcaaaacagugggcaccucugaagagaagcuccgcaaaaaguccagcuucuaccagucuuaucugcggagaacccaaagcaugggcauucagcuugaucagcgcaucaucgugcuguuuauggucgacugggggaaagaagccguggacuccuuccaccucggagaugacauggauccugagcugcggucucuugcccaggcucugauugaccaaaagguuaaggaaaucagcaaccaggagccccucaaacuguga

SEQ ID NO: 7019 - RNA, 1290 nt, Artificial Sequence
  derived and/or modified CDS sequence (opt5) from DOBV(GER/05/239/Aa)__GQ205405.1__N
auggccacccuggaggaacuccagaaggagaucaacagccacgaaggccaacuggugauugcuagacagaaagucaaggacgccgagaaacaguacgaaaaggaucccgacgaucuuaauaaacgggcgcuguccgaccgcgagucuguugcucagagcauccaagggaagauugaugagcucagacggcagcuggccgaccgcguggccgcuggaaagaacaucggcaaagaaagagauccuacagggcuugacccgggagaucaucugaaggagaaauccaugcucucuuauggcaaugugauugaccugaaccaccuggauaucgacgaacccacggggcagaccgccgauuggcucagcaucgucguguaccugacauccuucguugugccuauucuucugaaggcucucuauaugcugaccacacggggacgccagaccacaaaagacaauaagggcaugagaauccgguuuaaggacgauucuagcuucgaggacgucaacggcauucgcaaacccaagcaucuuuuucuguccaugccuaaugcccaaagcucuaugaaagcggaugagaucacccccgggagauuccggacggccauuugcggacucuacccugcucaggugaaggcccgcaaccugguuuccccggugaugagcgucaucggcuuucuggcucucgccaaaaauuggaccgaaagaguggaggaauggcuggaccuucccuguaagcugcucucugagccuucccccacaagccugaccaaagggccuucuacaaaccgggauuaucuuucccagcgccagggagcgcuggccaagauggaaaccaaggaggcucaagccgugagaaaacacgcuauugacgccggcugcaauaucaucgaucauauugacagccccuccucuaucugggucuucgccggggcuccggaucgguguccucccacgugccucuuuauugcgggaauggccgagcugggcgcuuucuuugccguucugcaggacaugagaaacacaaucauggccagcaagaccauuggcacauccgaagagaaacuccgcaagaaaagcucuuucuaccaguccuaucugcggagaacccaaagcauggggauccagcuugaucagcgcaucauugugcuguuuaugguggacuggggaaaggaagcugucgacucuuuccaccucggcgaugacauggauccugagcugcggagccuugcccaggcgcugaucgaccaaaaggugaaagaaauuuccaaucaggagccccucaagcuguga

SEQ ID NO: 7020 - RNA, 1290 nt, Artificial Sequence
  derived and/or modified CDS sequence (opt5) from DOBV(GER/05/477/Af)__GQ205406.1__N
auggccacccuggaggaacuccagaaggagaucaacagccacgaaggccaacuggugauugcuagacagaaagucaaggacgccgagaaacaguacgaaaaggaucccgacgaucuuaauaaacgggcgcuguccgaccgcgagucuguugcucagagcauccaagggaagauugaugagcucagacggcagcuggccgaccgcguggccgcuggaaagaacaucggcaaagaaagagauccuacagggcuugacccgggagaucaucugaaggagaaauccaugcucucuuauggcaaugugauugaccugaaccaccuggauaucgacgaacccacggggcagaccgccgauuggcucagcaucgucguguaccugacauccuucguugugccuauucuucugaaggcucucuauaugcugaccacacggggacgccagaccacaaaagacaauaagggcaugagaauccgguuuaaggacgauucuagcuucgaggacgucaacggcauucgcaaacccaagcaucuuuuucuguccaugccuaaugcccaaagcucuaugaaagcggaugagaucacccccgggagauuccggacggccauuugcggacucuacccugcucaggugaaggcccgcaaccugguuuccccggugaugagcgucaucggcuuucuggcucucgccaaaaauuggaccgaaagaguggaggaauggcuggaccuucccuguaagcugauuucugagccuucccccacaagccucaccaaagggccuucuacaaaccgggauuaucugucccagcgccagggagcgcuugccaagauggaaaccaaggaggcucaagccgugagaaaacacgcuaucgacgccggcugcaauaucauugaucauaucgacagccccuccucuauuugggucuucgccggggcuccggaucgguguccucccacgugccuguuuaucgcgggaauggccgagcucggcgcuuucuuugccguucugcaggacaugagaaacacaauuauggccagcaagaccaucggcacauccgaagagaaacugcgcaagaaaagcucuuucuaccaguccuaucuccggagaacccaaagcauggggauccagcuggaucagcgcauuaucgugcuuuuuaugguggacuggggaaaggaagcugucgacucuuuccaccugggcgaugacauggauccugagcuccggagccuggcccaggcgcuuauugaccaaaaggugaaagaaaucuccaaucaggagccccugaagcucuga

SEQ ID NO: 7021 - RNA, 1290 nt, Artificial Sequence
  derived and/or modified CDS sequence (opt5) from DOBV(GER/07/293/Aa)__GQ205401.1__N
auggccacccuggaggaacuccagaaggagaucaacagccacgaaggccaacuggugauugcuagacagaaagucaaggacgccgagaaacaguacgaaaaggaucccgacgaucuuaauaaacgggcgcuguccgaccgcgagucuguugcucagagcauccaagggaagauugaugagcucagacggcagcuggccgaccgcguggccgcuggaaagaacaucggcaaagaaagagauccuacagggcuugacccgggagaucaucugaaggagaaauccaugcucucuuauggcaaugugauugaccugaaccaccuggauaucgacgaacccacggggcagaccgccgauuggcucagcaucgucguguaccugacauccuucguugugccuauucuucugaaggcucucuauaugcugaccacacggggacgccagaccacaaaagacaauaagggcaugagaauccgguuuaaggacgauucuagcuucgaggacgucaacggcauucgcaaacccaagcaucuuuuucuguccaugccuaaugcccaaagcucuaugaaagcggaugagaucacccccgggagauuccggacggccauuugcggacucuacccugcucaggugaaggcccgcaaccugguuuccccggugaugagcgucaucggcuuucuggcucucgccaaaaauuggaccgaaagaguggaggacuggcuggaucuucccuguaagcugcucucugaaccuucccccacaagccugaccaaagggccuucuacaaaccgggacuaucuuaaucagcgccagggagcgcuggccaagauggagaccaaggaagcucaagccgugagaaaacacgcuauugaugccggcugcaacaucaucgaccauauugauucccccagcuccaucugggucuucgccggggcuccggaccgguguccucccacgugccucuuuauugcgggaauggccgagcugggcgcuuucuuugccguucugcaggauaugagaaauacaaucauggccucuaagaccauuggcacaagcgaggaaaaacuccgcaagaaauccagcuucuaccagucuuaucugcggagaacccaauccauggggauccagcuugaccagcgcaucauugugcugcucaugguggacuggggaaaggaggcugucgauagcuuucaccugggcgacgauauggacccugaacuucgggggcuggcccaggcgcucaucgaucaaaaggugaaagagauuucuaaccaggaaccccugaagcuguga

SEQ ID NO: 7022 - RNA, 1290 nt, Artificial Sequence
  derived and/or modified CDS sequence (opt5) from DOBV(GER/07/424/Aa)__GQ205403.1__N
auggccacccuggaggaacuccagaaggagaucaacagccacgaaggccaacuggugauugcuagacagaaagucaaggacgccgagaaacaguacgaaaaggaucccgacgaucuuaauaaacgggcgcuguccgaccgcgagucuguugcucagagcauccaagggaagauugaugagcucagacggcagcuggccgaccgcguggccgcuggaaagaacaucggcaaagaaagagauccuacagggcuugacccgggagaucaucugaaggagaaauccaugcucucuuauggcaaugugauugaccugaaccaccuggauaucgacgaacccacggggcagaccgccgauuggcucagcaucgucguguaccugacauccuucguugugccuauucuucugaaggcucucuauaugcugaccacacggggacgccagaccacaaaagacaauaagggcaugagaauccgguuuaaggacgauucuagcuucgaggacgucaacggcauucgcaaacccaagcaucuuuuucuguccaugccuaaugcccaaagcucuaugaaagcggaugagaucacccccgggagauuccggacggccauuugcggacucuacccugcucaggugaaggcccgcaaccugguuuccccggugaugagcgucaucggcuuucuggcucucgccaaaaauuggaccgaaagaguggaggacuggcuggaucuucccuguaagcugcucucugaaccuucccccacaagccugaccaaagggccuucuacaaaccgggacuaucuuaaucagcgccagggagcgcuggccaagauggagaccaaggaagcucaagccgugagaaaacacgcuauugaugccggcugcaacaucaucgaccauauugauucccccagcuccaucugggucuucgccggggcuccggaccgguguccucccacgugccucuuuauugcgggaauggccgagcugggcgcuuucuuugccguucugcaggauaugagaaauacaaucauggccucuaagaccauuggcacaagcgaggaaaaacuccgcaagaaauccagcuucuaccagucuuaucugcggagaacccaauccauggggauccagcuugaccagcgcaucauugugcuguuuaugguggacuggggaaaggaggcugucgauagcuuccaccucggcgacgauauggacccugaacugcgggggcuugcccaggcgcugaucgaucaaaaggugaaagagauuucuaaccaggaaccccucaagcuguga

SEQ ID NO: 7023 - RNA, 1290 nt, Artificial Sequence
  derived and/or modified CDS sequence (opt5) from DOBV(GER/08/118/Aa)__GQ205407.1__N
auggccacccuggaggaacuccagaaggagaucaacagccacgaaggccaacuggugauugcuagacagaaagucaaggacgccgagaaacaguacgaaaaggaucccgacgaucuuaauaaacgggcgcuguccgaccgcgagucuguugcucagagcauccaagggaagauugaugagcucagacggcagcuggccgaccgcguggccgcuggaaagaacaucggcaaagaaagagauccuacagggcuugacccgggagaucaucugaaggagaaauccaugcucucuuauggcaaugugauugaccugaaccaccuggauaucgacgaacccacggggcagaccgccgauuggcucagcaucgucguguaccugacauccuucguugugccuauucuucugaaggcucucuauaugcugaccacacggggacgccagaccacaaaagacaauaagggcaugagaauccgguuuaaggacgauucuagcuucgaggacgucaacggcauucgcaaacccaagcaucuuuuucuguccaugccuaaugcccaaagcucuaugaaagcggaugagaucacccccgggagauuccggacggccauuugcggacucuacccugcucaggugaaggcccgcaaccugguuuccccggugaugagcgucaucggcuuucuggcucucgccaaaaauuggaccgaaagaguggaggacuggcuggaucuucccuguaagcugcucucugaaccuucccccacaagccugaccaaagggccuucuacaaaccgggacuaucuuaaucagcgccagggagcgcuggccaagauggagaccaaggaagcucaagccgugagaaaacacgcuauugaugccggcugcaacaucaucgaccauauugauucccccagcuccaucugggucuucgccggggcuccggaccgguguccucccacgugccucuuuauugcgggaauggccgagcugggcgcuuucuuugccguucugcaggauaugagaaauacaaucauggccucuaagaccgugggcacaagcgaggagaaaaugcgcaagaaauccagcuucuaccagucuuaucuccggagaacccaauccauggggauucagcuggaccagcgcaucaucgugcuuuuuauggucgacuggggaaaggaagcuguggauagcuuccaccugggcgacgauauggacccugaacuccgggggcuggcccaggcgcuuauugaucaaaagguuaaagagaucucuaaccaggaaccccugaagcucuga

SEQ ID NO: 7024 - RNA, 1290 nt, Artificial Sequence
  derived and/or modified CDS sequence (opt5) from DOBV(GER/08/131/Af)__GQ205408.1__N
auggccacccuggaggaacuccagaaggagaucaacagccacgaaggccaacuggugauugcuagacagaaagucaaggacgccgagaaacaguacgaaaaggaucccgacgaucuuaauaaacgggcgcuguccgaccgcgagucuguugcucagagcauccaagggaagauugaugagcucagacggcagcuggccgaccgcguggccgcuggaaagaacaucggcaaagaaagagauccuacagggcuugacccgggagaucaucugaaggagaaauccaugcucucuuauggcaaugugauugaccugaaccaccuggauaucgacgaacccacggggcagaccgccgauuggcucagcaucgucguguaccugacauccuucguugugccuauucuucugaaggcucucuauaugcugaccacacggggacgccagaccacaaaagacaauaagggcaugagaauccgguuuaaggacgauucuagcuucgaggacgucaacggcauucgcaaacccaagcaucuuuuucuguccaugccuaaugcccaaagcucuaugaaagcggaugagaucacccccgggagauuccggacggccgugugcggacucuacccugcucagguuaaggcccgcaaccugguguccccggucaugagcgugauuggcuuucuggcucucgccaaaaauuggaccgaaagaguggaggacuggcuggaucuucccuguaagcugcucucugaaccuucccccacaagccugaccaaagggccuucuacaaaccgggacuaucuuaaucagcgccagggagcgcuggccaagauggagaccaaggaagcucaagccgucagaaaacacgcuaucgaugccggcugcaacauuaucgaccauaucgauucccccagcuccauuuggguuuucgccggggcuccggaccgguguccucccacgugccucuuuaucgcgggaauggccgagcugggcgcuuucuuugccgugcugcaggauaugagaaauacaauuauggccucuaagaccaucggcacaagcgaggaaaaacuccgcaagaaauccagcuucuaccagucuuaucugcggagaacccaauccauggggauucagcuugaccagcgcaucaucgugcuguuuauggucgacuggggaaaggaggcuguggauagcuuccaccucggcgacgauauggacccugaacugcgggggcuugcccaggcgcugauugaucaaaagguuaaagagaucucuaaccaggaaccccucaagcuguga

SEQ ID NO: 7025 - RNA, 1290 nt, Artificial Sequence
  derived and/or modified CDS sequence (opt5) from HTNV(76-118/POR)__KT885049.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacaaaccgggaggggguugccgugagcauccaggccaagauugaugaacugaaaaugcaacucgcugaccgcaucgccacgggaaagaaucugggcaaggagcaggauccuaccgggguggaaccgggagaccaucuuaaagagagauccaugcugucuuauggcaacguccucgaucugaaucaccuggacauugaugagcccacagggcagaccgcugacuggcucagcaucaucguguaccugacauccuucguugugccuauucuucugaaggcccucuauaugcugaccacacggggacgccagaccacgaaagauaacaagggcaccagaauccgguuuaaagacgauucuagcuucgaagacgucaauggcauucgcaagcccaagcaucuuuacgugucccugccuaacgcgcaaucuagcaugaaagccgaggaaaucacacccgggagauaucggaccgcuguuugcggacucuacccugcccagauuaaggcucgccagaugaucuccccggugaugagcgucauuggcuuucuggcccuggcgaaagacuggucugauagaaucgagcaguggcucaucgaacccuguaagcugcuuccugacacagccgcugugucccugcucgggggacccgccaccaaucgggauuaucugcgccaaagacagguggcucuuggcaacauggagacgaaagagagcaaggccauucggcagcacgccgaagcugcggggugcucuaugaucgaggacauugaauccccuagcucuaucugggucuucgccggagcucccgauagauguccgccuacaugccuguuuauugccggcaucgccgagcucggcgcuuucuuuuccauccugcaagacaugcgcaauaccauuauggccagcaaaacaguugggaccuccgaagagaagcugcggaagaaaucuagcuucuaccaguccuaccucagacgcacccagagcaugggaauccagcuggaucaacggauuaucgugcuuuuuaugguggcguggggcaaggaggcugucgacaacuuccaucugggggaugacauggaucccgaacucagaacacuggcccagucucuuauugacgugaaaguuaaggagaucuccaaucaggaaccucugaaacucuga

SEQ ID NO: 7026 - RNA, 1290 nt, Artificial Sequence
  derived and/or modified CDS sequence (opt5) from HTNV(A16)__AF288646.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggcuggccgccagcauccaggcuaagauugacgaacucaaacgccaacuggccgauagaaucgcuacgggaaagaaccuuggcaaggagcaggacccuaccgggguugaaccgggagaucaucugaaagagcgguccaugcucucuuauggcaaugugcuggaccugaaccaccucgauauugacgagcccacagggcagaccgccgauuggcugagcaucgugaucuaccuuacauccuucgucgugccuauucugcucaaggcgcuguauaugcuuaccacacgcggaagacagaccacgaaagacaauaagggcacccggauccgcuuuaaagaugacucuagcuucgaagacguuaacggcauuagaaagcccaagcaucuguacgugucccucccuaaugcccaaucuagcaugaaagcugaggaaaucacacccgggcgguaucgcaccgccauuugcggacuguacccugcucagaucaaggccagacagaugauuuccccggucaugagcgugaucggcuuucuggcgcucgccaaagauuggucugaccggaucgagcaguggcuguccgaacccuguaaacuucugccugauacagcugccguuagccuccacgggggacccgcuaccaaccgcgacuaucugagacaaagacagguggcccuuggcaauauggagacgaaggagucuaaggccauucggcagcaugcugaauccgcggggugcagcauggucgaggauaucgaaucuccuuccagcauuuggguguucgccggagcucccaaccgcuguccgccuacaugccuguuuaucgccggcauugccgagcucggcgcuuucuuuuccauccugcaagacaugcggaauaccaucauggccucuaaaacaguggggaccagcgaagagaagcugagaaagaaauccagcuucuaccagucuuaccuccgccggacccaguccaugggcauucagcuggaucaaagaaucauuguccuuuuuaugguugcguggggaaaggaggcuguggacaacuuccaccugggggaugacauggaucccgugcuccgcacacuggcccagagccuuaucgacgucaaagugaaggaaauuucuaaucaggagccucugaaacucuga

SEQ ID NO: 7027 - RNA, 1290 nt, Artificial Sequence
  derived and/or modified CDS sequence (opt5) from HTNV(CA09082007)__HQ834499.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgccagcauccaggcuaagauugacgaacugaaacgccaacucgccgauagaaucgcuacgggaaagaaccugggcaaggagcaggacccuaccgggguggaaccgggagaucaucuuaaagagcgguccaugcugucuuauggcaaugugcucgaccugaaccaccuggauauugacgagcccacagggcagaccgccgauuggcucagcaucgucaucuaccugacauccuucgugguuccuauucuucugaaggcgcucuauaugcugaccacacgcggaagacagaccacgaaagacaauaagggcacccggauccgcuuuaaagaugacucuagcuucgaagacgugaacggcauuagaaagcccaagcaucuuuacgucucccugccuaaugcccaaucuagcaugaaagcugaggaaaucacacccgggcgguaucgcaccgccauuugcggacucuacccugcucagaucaaggccagacagaugauuuccccggugaugagcguuaucggcuuucuggcgcuggccaaagauuggucugaccggaucgagcaguggcucuccgaacccuguaagcugcuuccugauacagcugccgugagccugcacgggggacccgcuaccaaccgcgacuaucucagacaacggcaggucgcccugggcaauauggagacgaaagagucuaaggccauuagacagcaugcugaauccgcggggugcagcaugguggaggauaucgaaucuccuuccagcauuuggguguucgccggagcucccgaccgcuguccgccuacaugccuuuuuaucgccggcauugccgagcugggcgcuuucuuuuccauccuccaagauaugcggaacaccaucauggccucuaaaacagucgggaccagcgaagagaagcugagaaagaaauccagcuucuaccagucuuacauucgccggacccaguccaugggaauccagcuggaccaaagaauuaucguucucuuuaugguggcguggggcaaggaggcuguggauaauuuccaccugggggacgauauggaccccgaacuucgcacacuggcccagagccucauugaccugaaagucaaggagaucucuaaccaggaaccucuuaaacuguga

SEQ ID NO: 7028 - RNA, 1290 nt, Artificial Sequence
  derived and/or modified CDS sequence (opt5) from HTNV(CA10081109)__HQ834500.1__N
augcccaccagcggcgagcugcagagagaaaucaacgcccacgaggggcaacucgugauugcucggcagaagguccgcgacgccgaaaagcaguacgagaaggauccugacgaacugaauaaaagagcgcuuacagaucgggagggaguugcugccuccauccaggccaagauugacgagcugaaacgccaacucgcugauagaaucgccacgggcaagaaccuggggaaggaacaggacccgaccggaguggagcccggcgaucaucuuaaagaacggucuaugcugagcuaugggaaugugcucgaccugaaccaccuggauauugacgagccuacaggacagaccgcugauuggcucuccaucgucaucuaccugacaucuuucgugguucccauucuucugaaggcccucuauaugcugaccacacgcggcagacagaccacgaaagacaauaagggcacccggauccgcuuuaaagaugacagcuccuucgaggacgugaacgggauuagaaagccuaagcaucuuuacgucucucugcccaaugcgcaaagcuccaugaaagccgaagagaucacaccuggacgguaucgcaccgcuauuugcgaacucuacccggcccagaucaaggcuagcaaaaugauuucucccgugauguccguuaucggcuuucuggcccuggcgaaggauuggagcgacagaaucgagcaguggcucucugaaccuuguaaacugcuucccgauacagccgcugugucccugcacgggggaccugccaccaaccgggacuaucuccgccagagacaagucgcucugggcaauauggagacgaaggagagcaaagccauucggcagcaugccgaaucugcugggugcuccaugguggaggauaucgaaagccccuccucuauuuggguguucgcgggagccccggacagauguccucccacaugccuuuuuaucgcuggcauugccgagcugggcgccuucuuuagcauccuccaggauaugcgcaacaccaucauggcuuccaagacagucgggaccagcgaagagaagcugcggaaaaagucuuccuucuaccaaagcuaccugagacgcacccagucuaugggcauucagcucgaccagcggaucauuguucuguuuaugguggccuggggaaaagaggcgguggauaauccucacgcuggggacgaugucgaccccagccuuggaaugcuggcccaaucccucaucgacgugaagguuaaagaaauuucuaaccaggagccccugaaacuuuga

SEQ ID NO: 7029 - RNA, 1290 nt, Artificial Sequence
  derived and/or modified CDS sequence (opt5) from HTNV(CA10081113)__HQ834501.1__N
auggccaccagcggcgagcugcagagagaaaucaacgcucacgaggggcaacucgugauugcccggcagaagguccgcgacgcggaaaaacaguacgagaaggaucccgacgaacugaauaaaagagcucuuacagaucgggagggaguugccgccuccauccaggcuaagauugacgagcugaaacgccaacucgccgauagaaucgcuacgggcaagaaccuggggaaggaacaggacccuaccggaguggagccgggcgaucaucuuaaagaacggucuaugcugagcuaugggaaugugcucgaccugaaccaccuggauauugacgagcccacaggacagaccgccgauuggcucuccaucgucaucuaccugacaucuuucgugguuccuauucuucugaaggcgcucuauaugcugaccacacgcggcagacagaccacgaaagacaauaagggcacccggauccgcuuuaaagaugacagcuccuucgaggacgugaacgggauuagaaagcccaagcaucuuuacgucucucugccuaaugcccaaagcuccaugaaagcugaagagaucacacccggacgguaucgcaccgccauuuuugaacucuacccugcucagaucaaggccagacagaugauuagcccggugaugucuguuaucggcuuccuggcgcuggccaaagauugguccgaccggaucgagcaguggcucagcgaacccugcaagcugcuuccugauacagcugccgugucucugcacgggggacccgcuaccaaccgcgacuaucucagacaacggcaggucgcccugggcaauauggagacgaaagaguccaaggccauuagacagcaugcugaaagcgcgggguguucuaugguggaggauaucgaauccccuagcuccauuuggguguuugccggagcucccgaccgcugcccgccuacaugucuuuucaucgccggcauugccgagcugggcgccuuuuucucuauccuccaagauaugcggaacaccaucauggcuagcaaaacagucgggaccuccgaagagaagcugagaaagaaaagcucuuuuuaccaguccuaccugcgccggacccagagcaugggcauucagcucgaccaaagaaucauuguucuguucaugguggcguggggaaaggaggcuguggauaaucgccaccuuaugaacaucgucgaccccgaaccucgggcccuggcccagucucucauugaugugaaaguuaaggagaucagcaaucaggaaccccugaaacuuuga

SEQ ID NO: 7030 - RNA, 1290 nt, Artificial Sequence
  derived and/or modified CDS sequence (opt5) from HTNV(CA10081203)__HQ834502.1__N
auggccaccaacggcgagcugcagagagaaaucaaugcucacgaggggcaacucgugauugcccggcagaagguccgcgacgcggaaaaacaguacgagaaggaucccgacgaacugaacaaaagagcucuuacagaucgggagggaguugccgccagcauccaggcuaagauugacgagcugaaacgccaacucgccgauagaaucgcuacgggcaagaaucuggggaaggaacaggacccuaccggaguggagccgggcgaucaucuuaaagaacgguccaugcugucuuaugggaacgugcucgaccugaaucaccuggauauugacgagcccacaggacagaccgccgauuggcucagcaucgucaucuaccugacauccuucgugguuccuauucuucugaaggcgcucuauaugcugaccacacgcggcagacagaccacgaaagacaacaagggcacccggauccgcuuuaaagaugacucuagcuucgaggacgugaaugggauuagaaagcccaagcaucuuuacgucucccugccuaacgcccaaucuagcaugaaagcugaagagaucacacccggacgguaucgcaccgccauuuuuggccucuacccugcucagaucaaggccagacagaugauuuccccggugaugagcguuaucggguuccuggcgcuggccaaagauuggucugaccggaucgaacaguggcucuccgagcccugcaagcugcuuccugauacagcugccgugagccugcacggaggccccgcuaccaaucgcgacuaucucagacaacggcaggucgcccuggggaacauggaaacgaaagagucuaaggccauuagacagcaugcugaguccgcgggauguagcaugguggaagauaucgagucuccuuccagcauuuggguguuugccggcgcucccgaccgcugcccgccuacaugucuuuucaucgccggcauugccgaacugggggccuuuuucuccauccuccaagauaugcggaauaccaucauggcuucuaaaacagucggaaccagcgaggaaaagcugagaaagaaauccagcuuuuaccagucuuaccugcgccggacccaguccaugggcauucagcucgaccaaagaaucauuguucuguucaugguggcgugggggaaggaggcuguggaugagcuucacagcggagacggcgaacaccaugccucucgcacacuggcccagagccucaucgaugucaaagugaaggagauuuccaaccaggaaccccugaaacuuuga

SEQ ID NO: 7031 - RNA, 1290 nt, Artificial Sequence
  derived and/or modified CDS sequence (opt5) from HTNV(CA10081206)__HQ834503.1__N
auggccaccaucgaggaacugcagagagagauuaacgcucacgaaggccaacucgugaucgcccggcagaagguccgcgacgcggagaaacaguacgaaaaggaucccgacgagcugaauaaaagagcucuuacagaucgggaggggguugccgccagcauucaggcuaagaucgacgaacugaaacgccaacucgccgauagaauugcuacgggaaagaaccugggcaaggagcaggacccuaccgggguggaaccgggagaucaucuuaaagagcgguccaugcugucuuauggcaaugugcucgaccugaaccaccuggauaucgacgagcccacagggcagaccgccgauuggcucagcaucgucauuuaccugacauccuucgugguuccuauccuucugaaggcgcucuauaugcugaccacacgcggaagacagaccacgaaagacaauaagggcacccggauucgcuuuaaagaugacucuagcuucgaagacgugaacggcaucagaaagcccaagcaucuuuacgucucccugccuaaugcccaaucuagcaugaaagcugaggaaauuacacccgggcgguaucgcaccgccaucugcggacucuacccugcucagauuaaggccagacagaugaucuccccggugaugagcguuaucggcuuucuggcgcuggccaaagauuggucugaccggauugagcaguggcucuccgaacccuguaagcugcuuccugauacagcugccgugagccugcacgggggacccgcuaccaaccgcgacuaucucagacaacggcaggucgcccugggcaauauggagacgaaagagucuaaggccaucagacagcaugcugaauccgcggggugcagcaugguggaggauauugaaucuccuuccagcaucuggguguucgccggagcucccgaccgcuguccgccuacaugccuuuuuauugccggcaucgccgagcugggcgcuuucuuuuccauccuccaagauaugcggaacaccauuauggccucuaaaacagucgggaccagcgaagagaagcugagaaagaaauccagcuucuaccagucuuaccugcgccggacccaguccaugggaauccagcucgaccaaagaauuaucguucuguuuaugguggcguggggcaaggaggcuguggauaauuuccacgccugggacgggauggaucccgaacuucgcacacuggcccagagccucauugacgucaaagugaaggagaucucuaaccaggaaccucugaaacuuuga

SEQ ID NO: 7032 - RNA, 1290 nt, Artificial Sequence
  derived and/or modified CDS sequence (opt5) from HTNV(CA10081708)__HQ834504.1__N
augcccaccagcggcgagcugcagagagaaaucaacgcccacgaggggcaacucgugauugcucggcagaagguccgcgacgccgaaaagcaguacgagaaggauccugacgaacugaauaaaagagcgcuuacagaucgggagggaguugcugccuccauccaggccaagauugacgagcugaaacgccaacucgcugauagaaucgccacgggcaagaaccuggggaaggaacaggacccgaccggaguggagcccggcgaucaucuuaaagaacggucuaugcugagcuaugggaaugugcucgaccugaaccaccuggauauugacgagccuacaggacagaccgcugauuggcucuccaucgucaucuaccugacaucuuucgugguucccauucuucugaaggcccucuauaugcugaccacacgcggcagacagaccacgaaagacaauaagggcacccggauccgcuuuaaagaugacagcuccuucgaggacgugaacgggauuagaaagccuaagcaucuuuacgucucucugcccaaugcgcaaagcuccaugaaagccgaagagaucacaccuggacgguaucgcaccgcuauuuuugaacucuacccggcccagaucaaggcuagaaaaaugauuagccccgugaugucuguuaucggcuuccuggcccuggcgaaggauugguccgaccggaucgagcaguggcucagcgaaccuugcaaacugcuucccgauacagccgcugugucucugcacgggggaccugccaccaaccgcgacuaucucagacagcggcaagucgcucugggcaauauggagacgaaggaguccaaagccauuagacagcaugccgaaagcgcuggguguucuaugguggaggauaucgaaucccccagcuccauuuggguguuugcgggagccccggaccgcugcccucccacaugucuuuucaucgcuggcauugccgagcugggcgccuuuuucucuauccuccaggauaugcggaacaccaucauggcuagcaagacagucgggaccuccgaagagaagcugcgcaaaaagagcucuuuuuaccaauccuaccugagacggacccagagcaugggcauucagcucgaccagagaaucauuguucuguucaugguggccuggggaaaagaggcgguggauaauccucacacaggggacgaugcugaccccgaacuucgcacgcuggcccaaucucucaucgacgucaaggugaaagagauuagcaaccaggaaccccugaaacuuuga

SEQ ID NO: 7033 - RNA, 1290 nt, Artificial Sequence
  derived and/or modified CDS sequence (opt5) from HTNV(CA10081905)__HQ834505.1__N
auggccaccagcggcgagcugcagagagaaaucaacgcucacgaggggcaacucgugauugcccggcagaagguccgcgacgcggaaaaacaguacgagaaggaucccgacgaacugaauaaaagagcucuuacagaucgggagggaguugccgccuccauccaggcuaagauugacgagcugaaacgccaacucgccgauagaaucgcuacgggcaagaaccuggggaaggaacaggacccuaccggaguggagccgggcgaucaucuuaaagaacggucuaugcugagcuaugggaaugugcucgaccugaaccaccuggauauugacgagcccacaggacagaccgccgauuggcucuccaucgucaucuaccugacaucuuucgugguuccuauucuucugaaggcgcucuauaugcugaccacacgcggcagacagaccacgaaagacaauaagggcacccggauccgcuuuaaagaugacagcuccuucgaggacgugaacgggauuagaaagcccaagcaucuuuacgucucucugccuaaugcccaaagcuccaugaaagcugaagagaucacacccggacgguaucgcaccgccauuuuugaacucuacccugcucagaucaaggccagaaaaaugauuagcccggugaugucuguuaucggcuuccuggcgcuggccaaggauugguccgaccggaucgagcaguggcucagcgaacccugcaaacugcuuccugauacagcugccgugucucugcacgggggacccgcuaccaaccgcgacuaucucagacagcggcaagucgcccugggcaauauggagacgaaggaguccaaagccauuagacagcaugcugaaagcgcgggguguucuaugguggaggauaucgaauccccuagcuccauuuggguguuugccggagcucccgaccgcugcccgccuacaugucuuuucaucgccggcauugccgagcugggcgccuuuuucucuauccuccaggauaugcggaacaccaucauggcuagcaagacagucgggaccuccgaagagaagcugcgcaaaaagagcucuuuuuaccaauccuaccugagacggacccagagcaugggcauucagcucgaccagagaaucauuguucuguucaugguggcguggggaaaagaggcuguggauaaucaccaccuuaucaacgccggggaccaugaacugcgcacacucgcccaaucucugauugaugucaaggugaaagagaucagcaaucaggaaccccuuaagcuguga

SEQ ID NO: 7034 - RNA, 1290 nt, Artificial Sequence
  derived and/or modified CDS sequence (opt5) from HTNV(E142)__AF288644.1__N
auggccaccauggaggaacugcagagagagaucaacgcucacgaaggccaacucgugauugcccggcagaagguccgcgacgcggagaaaagauacgaaaaggaucccgacgagcugaauaaacggacacuuacggaucgcgaggggguugcugccagcauccaggccaagauugacgaacugaaaagacagcucgcugaucggaucgccaccggaaagaaccugggcaaggagcaagacccuacagggguggaaccgggagaucaucuuaaagagcgcuccaugcugucuuauggcaaugugcucgaccugaaccaccuggauauugacgagcccaccgggcagacagcugauuggcucagcaucgucaucuaccugaccuccuucgugguuccuauucuucugaaggcccucuauaugcugacaaccagaggacggcagacgaccaaagacaauaagggcacacgcaucagauuuaaagaugacucuagcuccgaagacgugaacggcauucggaagcccaagcaucuuuacgucucucugccuaaugcgcagagcuccaugaaagccgaggaaaucacccccgggcgcuauagaacagcuauuugcggacucuacccugcccaaaucaaggcucggcagaugauuagcccggugaugucuguuaucggcuuccuggcccuggcgaaagauugguccgaccgcaucgagcaguggcucagcgaacccuguaagcugcuuccugauaccgccgcugugucucugcacgggggacccgccacgaacagagacuaucuccggcagagacaagucgcucugggcaauauggagacaaaagaguccaaggccauucgccagcaugccgaaagcgcugggugcucuaugaucgaggauauugaauccccuagcuccaucuggguguuugcgggagcccccgaccgguguccgccuaccugccuuuucauugcuggcaucgccgagcugggcgccuuuuucucuauccuccaggauaugagaaacacaauuauggcuagcaaaaccguggggaccuccgaagagaagcugcgcaagaaaagcucuuuuuaccaauccuaccugcggagaacacagagcaugggaauccagcucgaccagcgcauuaucguccuguucaugguugccuggggcaaggaggugguggauaauuuucaccuuggggacgauauggaccccgaacugcggacgcucgcgcaaucucugauugacgucaaagugaaggagaucagcaaccaggaaccucuuaaacuguga

SEQ ID NO: 7035 - RNA, 1290 nt, Artificial Sequence
  derived and/or modified CDS sequence (opt5) from HTNV(H10150)__HQ834506.1__N
auggccaccaugggcgagcugcagagagaaaucaacgcucacgaggggcaacucgugauugcccggcagaagguccgcgacgcggaaaaacaguacgagaaggaucccgacgaacugaauaaaagagcucuuacagaucgggagggaguugccgccagcauccaggcuaagauugacgagcugaaacgccaacucgccgauagaaucgcuacgggcaagaaccuggggaaggaacaggacccuaccggaguggagccgggcgaucaucuuaaagaacgguccaugcugucuuaugggaaugugcucgaccugaaccaccuggauauugacgagcccacaggacagaccgccgauuggcucagcaucgucaucuaccugacauccuucgugguuccuauucuucugaaggcgcucuauaugcugaccacacgcggcagacagaccacgaaagacaauaagggcacccggauccgcuuuaaagaugacucuagcuucgaggacgugaacgggauuagaaagcccaagcaucuuuacgucucccugccuaaugcccaaucuagcaugaaagcugaagagaucacacccggacgguaucgcaccgccauuuuuggccucuacccugcucagaucaaggccagacagaugauuuccccggugaugagcguuaucggguuccuggcgcuggccaaagauuggucugaccggaucgaacaguggcucuccgagcccugcaagcugcuuccugauacagcugccgugagccugcacggaggccccgcuaccaaccgcgacuaucucagacaacggcaggucgcccuggggaauauggaaacgaaagagucuaaggccauuagacagcaugcugaguccgcgggauguagcaugguggaagauaucgagucuccuuccagcauuuggguguuugccggcgcucccgaccgcugcccgccuacaugucuuuucaucgccggcauugccgaacugggggccuuuuucuccauccuccaagauaugcggaacaccaucauggcuucuaaaacagucggaaccagcgaggaaaagcugagaaagaaauccagcuuuuaccagucuuaccugcgccggacccaguccaugggcauucagcucgaccaaagaaucauuguucuguucaugguggcgugggggaaggaggcuguggauaaucaccacugggccaacgccaucggaagcgagcuucgcacacuggcucagucucucauugacgucaaagugaaggaaaucagcaaucaggagccccugaaacuuuga

SEQ ID NO: 7036 - RNA, 1290 nt, Artificial Sequence
  derived and/or modified CDS sequence (opt5) from HTNV(Aa03-161)__KT935024.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucguggucccuauccuucugaaggcccucuauaugcugaccacacgcggaagacagaccacgaaagacaauaagggcacccggauucgcuuuaaagaugacucuagcuucgaagacgugaacggcaucagaaagcccaagcaucuuuacguuucccugccuaaugcgcaaucuagcaugaaagccgaggaaauuacacccgggcgguaucgcaccgcugugugcggacucuacccugcccagaucaaggcuagacagaugauuuccccggucaugagcgugaucggcuuucuggcccuggcgaaagauuggucugaccggauugagcaguggcucuccgaacccuguaagcugcuuccugaugccgcugccgugagccugcucgggggacccgcuacaaaccgcgacuaucugagacaacggcaggucgcccuuggcaauauggagaccaaagagucuaaggccaucagacagcacgcugaagcggccgggugcuccaugaucgaggauauugaaagcccuucuuccaucuggguuuucgcuggagcccccgaccgcuguccgccuacgugccuguuuauugccggcaucgcugagcucggcgccuucuuuagcauucugcaagauaugcggaacacaaucauggcguccaaaaccguggggacaucugaagagaagcugagaaagaaaagcuccuucuaccagagcuaccuccgccggacccagucuaugggaauccagcuggaccaaagaauuaucgugcuuuuuauggucgcuuggggcaaggaggccguggauaauuuccaucugggggacgauauggaccccgaacuccgcacccuggcccagucccuuauugacguuaaagugaaggagaucagcaaccaggaaccucugaaacucuga

SEQ ID NO: 7037 - RNA, 1290 nt, Artificial Sequence
  derived and/or modified CDS sequence (opt5) from HTNV(Aa04-722)__KU207190.1__N
auggccaccauggaggaacugcagagagagaucaacgcucacgaaggccaacucgugauugcccggcagaagguccgcgacgcggagagacaguacgaaaaagaucccgacgagcugaauaagcgggcucuuacagaucgcgaggggguugccgugagcauccaggccaaaauugacgaacugaagagacaacucgcugaucggaucgccacgggaaagaaccugggcaaggagcaggacccuaccgggguggaaccgggagaucaucuuaaggagcgcuccaugcugucuuauggcaauguccucgaccugaaccaccuggauauugacgagcccacagggcagaccgcugauuggcucagcaucgugguuuaccugacauccuucguggucccuauccuucugaaagcccucuauaugcugaccacaagaggacggcagaccacgaaggacaauaaaggcacccgcauuagauuuaaggaugacucuagcuucgaagacgugaacggcauccggaaacccaagcaucuuuacguuucccugccuaaugcgcaaucuagcaugaaggccgaggaaauuacacccgggcgcuauagaaccgcugugugcggacucuacccugcccagaucaaagcucggcagaugauuuccccggucaugagcgugaucggcuuucuggcccuggcgaaggauuggucugaccgcauugagcaguggcucuccgaacccuguaaacugcuuccugauacagccgcugugagccugcucgggggacccgccaccaacagagacuaucugcggcaaagacaggucgcucuuggcaauauggagacgaaggagucuaaagccauccgccagcacgccgaagcugcggggugcuccaugaucgaggauauugaaagcccuucuuccaucuggguuuucgccggagcucccgaccgguguccgccuacaugccuguuuauugccggcaucgccgagcucggcgcuuucuuuagcauucugcaagauaugagaaacaccaucauggccuccaagacaguggggaccucugaagagaaacugcgcaaaaagagcuccuucuaccagagcuaccuccggagaacccagucuaugggaauccagcuggaccaacgcauuaucgugcuuuuuauggucgcguggggcaaagaggcuguggauaauuuccaucugggggacgauauggaccccgaacuccggacacuggcccagucccuuauugacguuaaggugaaagagaucagcaaccaggaaccucugaagcucuga

SEQ ID NO: 7038 - RNA, 1290 nt, Artificial Sequence
  derived and/or modified CDS sequence (opt5) from HTNV(Aa05-190)__KT935027.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucguggucccuauccuucugaaggcccucuauaugcugaccacacgcggaagacagaccacgaaagacaauaagggcacccggauucgcuuuaaagaugacucuagcuucgaagacgugaacggcaucagaaagcccaagcaucuuuacguuucccugccuaaugcgcaaucuagcaugaaagccgaggaaauuacacccgggcgguaucgcaccgcugugugcggacucuacccugcccagaucaaggcuagacagaugauuuccccggucaugagcgugaucggcuuucuggcccuggcgaaagauuggucugaccggauugagcaguggcucuccgaacccuguaagcugcuuccugauacagccgcugugagccugcucgggggacccgccaccaaccgcgacuaucugagacaacggcaggucgcucuuggcaauauggagacgaaagagucuaaggccaucagacagcacgccgaagcugcggggugcuccaugaucgaggauauugaaagcccuucuuccaucuggguuuucgccggagcucccgaccgcuguccgccuacaugccuguuuauugccggcaucgccgagcucggcgcuuucuuuagcauucugcaagauaugcggaacaccaucauggccuccaaaacaguggggaccucugaagagaagcugagaaagaaaagcuccuucuaccagagcuaccuccgccggacccagucuaugggaauccagcuggaccaaagaauuaucgugcuuuuuauggucgcguggggcaaggaggcuguggauaauuuccaucugggggacgauauggaccccgaacuccgcacacuggcccagucccuuauugacguuaaagugaaggagaucagcaaccaggaaccucugaaacucuga

SEQ ID NO: 7039 - RNA, 1290 nt, Artificial Sequence
  derived and/or modified CDS sequence (opt5) from HTNV(Aa10-123)__KT935036.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucguggucccuauccuucugaaggcccucuauaugcugaccacacgcggaagacagaccacgaaagacaauaagggcacccggauucgcuuuaaagaugacucuagcuucgaagacgugaacggcaucagaaagcccaagcaucuuuacguuucccugccuaaugcgcaaucuagcaugaaagccgaggaaauuacacccgggcgguaucgcaccgcugugugcggacucuacccugcccagaucaaggcuagacagaugauuuccccggucaugagcgugaucggcuuucuggcccuggcgaaagauuggucugaccggauugagcaguggcucuccgaacccuguaagcugcuuccugauacaaccgccgugagccugcucgggggacccgcuacgaaccgcgacuaucugagacaacggcaggucgcccuuggcaauauggagacaaaagagucuaaggcuaucagacagcacgccgaagccgcugggugcuccaugaucgaggauauugaaagcccuucuuccaucuggguuuucgcgggagcccccgaccgcuguccgccuaccugccuguuuguggcuggcauugccgagcucggcgccuucuuuagcauccugcaagauaugcggaacacaauuauggcuuccaaaaccguggggaccucugaagagaagcugagaaagaaaagcuccuucuaccagagcuaccuccgccggacacagucuaugggaauccagcuggaccaaagaaucauuguccuuuuuaugguggccuggggcaaggaggcgguugauaauuuccaucugggggacgauauggaccccgaacuccgcacgcuggcucagucccuuaucgacgugaaagucaaggagauuagcaaccaggaaccucugaaacucuga

SEQ ID NO: 7040 - RNA, 1290 nt, Artificial Sequence
  derived and/or modified CDS sequence (opt5) from HTNV(Aa10-265)__KU207194.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucguggucccuauccuucugaaggcccucuauaugcugaccacacgcggaagacagaccacgaaagacaauaagggcacccggauucgcuuuaaagaugacucuagcuucgaagacgugaacggcaucagaaagcccaagcaucuuuacguuucccugccuaaugcgcaaucuagcaugaaagccgaggaaauuacacccgggcgguaucgcaccgcugugugcggacucuacccugcccagaucaaggcuagacagaugauuuccccggucaugagcgugaucggcuuucuggcccuggcgaaagauuggucugaccggauugagcaguggcucuccgaacccuguaagcugcuuccugauacagccgcugugagccugcucgggggacccgccaccaaccgcgacuaucugagacaacggcaggucgcucuuggcaauauggagacgaaagagucuaaggccaucagacagcacgccgaagcugcggggugcuccaugaucgaggauauugaaagcccuucuuccaucuggguuuucgccggagcucccgaccgcuguccgccuacaugccuguuuguggccggcauugccgagcucggcgcuuucuuuagcauccugcaagauaugcggaacaccauuauggccuccaaaacaguggggaccucugaagagaagcugagaaagaaaagcuccuucuaccagagcuaccuccgccggacccagucuaugggaauccagcuggaccaaagaaucauuguccuuuuuaugguggcguggggcaaggaggcuguugauaauuuccaucugggggacgauauggaccccgaacuccgcacacuggcccagucccuuaucgacgugaaagucaaggagauuagcaaccaggaaccucugaaacucuga

SEQ ID NO: 7041 - RNA, 1290 nt, Artificial Sequence
  derived and/or modified CDS sequence (opt5) from HTNV(AA1028)__AF427318.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucguggucccuauccuucugaaggcccucuauaugcugaccacacgcggaagacagaccacgaaagacaauaagggcacccggauucgcuuuaaagaugacucuagcuucgaagacgugaacggcaucagaaagcccaagcaucuuuacguuucccugccuaaugcgcaaucuagcaugaaagccgaggaaauuacacccgggcgguaucgcaccgcuaucugcggacucuacccugcccagauuaaggcuagacagaugaucuccccggugaugagcgucauuggcuuucuggcccuggcgaaagauuggucugaccggaucgagcaguggcucuccgaacccuguaagcugcuuccugauacagccgcugugagccugcucgggggacccgccaccaaccgcgacuaucugagacaaagacagguggcucuuggcaauauggagacgaaagagucuaaggccauccggcagcacgccgaagcugcggggugcuccaugauugaggauaucgaaagcccuucuuccauuugggucuucgccggagcucccgaccgcuguccgccuacaugccuguuuaucgccggcauugccgagcucggcgcuuucuuuagcauccugcaagauaugcggaacaccaucauggccuccaaaacaguugggaccucugaagagaagcugagaaagaaaagcuccuucuaccagagcuaccuccgccggacccagucuaugggcauucagcuggaccaaagaaucauugugcuuuuuaugguggcguggggaaaggaggcugucgauaauuuccaucugggggacgauauggaccccgaacuccgcacacuggcccagucccuuaucgacgugaaaguuaaggagauuagcaaccaggaaccucugaaacucuga

SEQ ID NO: 7042 - RNA, 1290 nt, Artificial Sequence
  derived and/or modified CDS sequence (opt5) from HTNV(Aa10-434)__KT935038.1__N
auggccaccauggaggaacugcagagagagaucaacgcucacgaaggccaacucgugauugcccggcagaagguccgcgacgcggagaaacaguacgggaaggaucccgacgaacugaauaaaagagcucuuacagaucgggagggaguugccgugagcauccaggccaagauugacgagcugaaacgccaacucgcugauagaaucgccacgggcaagaaccuggggaaggaacaggacccuaccggaguggagccgggcgaucaucuuaaagaacgguccaugcugucuuaugggaauguccucgaccugaaccaccuggauauugacgagcccacaggacagaccgcugauuggcucagcaucgugguuuaccugacauccuucguggucccuauccuucugaaggcccucuauaugcugaccacacgcggcagacagaccacgaaagacaauaagggcacccggauucgcuuuaaagaugacucuagcuucgaggacgugaacgggaucagaaagcccaagcaucuuuacguuucccugccuaaugcgcaaucuagcaugaaagccgaagagauuacacccggacgguaucgcaccgcugugugcggccucuacccugcccagaucaaggcuagacagaugauuuccccggucaugagcgugaucggguuucuggcccuggcgaaagauuggucugaccggauugaacaguggcucuccgagcccuguaagcugcuuccugauacagccgcugugagccugcucggaggccccgccaccaaccgcgacuaucugagacaacggcaggucgcucuugggaauauggaaacgaaagagucuaaggccaucagacagcacgccgaggcugcgggaugcuccaugaucgaagauauugagagcccuucuuccaucuggguuuucgccggcgcucccgaccgcuguccgccuacaugccuguuuauugccggcaucgccgaacucggggcuuucuuuagcauucugcaagauaugcggaacaccaucauggccuccaaaacagugggaaccucugaggaaaagcugagaaagaaaagcuccuucuaccagagcuaccuccgccggacccagucuaugggcauccagcuggaccaaagaauuaucgugcuuuuuauggucgcgugggggaaggaggcuguggauaauuuccaucugggagacgauauggaccccgagcuccgcacacuggcccagucccuuauugacguuaaagugaaggaaaucagcaaccaggagccucugaaacucuga

SEQ ID NO: 7043 - RNA, 1290 nt, Artificial Sequence
  derived and/or modified CDS sequence (opt5) from HTNV(Aa14-362)__KT935049.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucguggucccuauccuucugaaggcccucuauaugcugaccacacgcggaagacagaccacgaaagacaauaagggcacccggauucgcuuuaaagaugacucuagcuucgaagacgugaacggcaucagaaagcccaagcaucuuuacguuucccugccuaaugcgcaaucuagcaugaaagccgaggaaauuacacccgggcgguaucgcaccgcugugugcggacucuacccugcccagaucaaggcuagacagaugauuuccccggucaugagcgugaucggcuuucuggcccuggcgaaagauuggucugaccggguggagcaguggcucuccgaacccuguaagcugcuuccugauacagccgcugucagccugcucgggggacccgccaccaaccgcgacuaucugagacaacggcagguugcucuuggcaauauggagacgaaagagucuaaggccauuagacagcacgccgaagcugcggggugcuccaugaucgaggauaucgaaagcccuucuuccauuuggguguucgccggagcucccgaccgcuguccgccuacaugccuguuuaucgccggcauugccgagcucggcgcuuucuuuagcauccugcaagauaugcggaacaccauuauggccuccaaaacaguggggaccucugaagagaagcugagaaagaaaagcuccuucuaccagagcuaccuccgccggacccagucuaugggaauccagcuggaccaaagaaucauuguccuuuuuaugguggcguggggcaaggaggcuguugauaauuuccaucugggggacgauauggaccccgaacuccgcacacuggcccagucccuuaucgacgugaaagucaaggagauuagcaaccaggaaccucugaaacucuga

SEQ ID NO: 7044 - RNA, 1290 nt, Artificial Sequence
  derived and/or modified CDS sequence (opt5) from HTNV(Aa14-404)__KT935052.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucguggucccuauccuucugaaggcccucuauaugcugaccacacgcggaagacagaccacgaaagacaauaagggcacccggauucgcuuuaaagaugacucuagcuucgaagacgugaacggcaucagaaagcccaagcaucuuuacguuucccugccuaaugcgcaaucuagcaugaaagccgaggaaauuacacccgggcgguaucgcaccgcugugugcggacucuacccugcccagaucaaggcuagacagaugauuuccccggucaugagcgugaucggcuuucuggcccuggcgaaagauuggucugaccggauugagcaguggcucuccgaacccuguaagcugcuuccugauacagccgcugugagccugcucgggggacccgccaccaaccgcgacuaucugagacaacggcaggucgcucuuggcaauauggagacgaaagagucuaaggccaucagacagcacgccgaagcugcggggugcuccaugaucgaggauauugaaagcccuucuuccaucuggguuuucgccggagcucccgaccgcuguccgccuacaugccuguuuauugccggcaucgccgagcucggcgcuuucuuuagcauucugcaagauaugcggaacaccaucauggccuccaaaacaguggggaccucugaagagaagcugagaaagaaaagcuccuucuaccagagcuaccuccgccggacccagucuaugggaauccagcuggaccaaagaauuaucgugcuuuuuauggucgcguggggcaaggaggcuguggauaauuuccaucugggggacgauauggaccccgaacuccgcacacuggcccagucccuuauugacguuaaagugaaggagaucagcucucaggaaccucugaaacucuga

SEQ ID NO: 7045 - RNA, 1290 nt, Artificial Sequence
  derived and/or modified CDS sequence (opt5) from HTNV(Aa15-56)__KU207195.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucguggucccuauccuucugaaggcccucuauaugcugaccacacgcggaagacagaccacgaaagacaauaagggcacccggauucgcuuuaaagaugacucuagcuucgaagacgugaacggcaucagaaagcccaagcaucuuuacguuucccugccuaaugcgcaaucuagcaugaaagccgaggaaauuacacccgggcgguaucgcaccgcugugugcggacucuacccugcccagaucaaggcuagacagaugauuuccccggucaugagcgugaucggcuuucuggcccuggcgaaagauuggucugaccggauugagcaguggcucaacgaacccuguaagcugcuuccugauacagccgcugugucccugcucgggggacccgccaccaaucgcgacuaucugagacaacggcaggucgcucuuggcaacauggagacgaaagagagcaaggccaucagacagcacgccgaagcugcggggugcucuaugaucgaggauauugaauccccuagcucuaucuggguuuucgccggagcucccgaccgcuguccgccuacaugccuguuuauugccggcaucgccgagcucggcgcuuucuuuuccauucugcaagauaugcggaauaccaucauggccagcaaaacaguggggaccuccgaagagaagcugagaaagaaaucuagcuucuaccaguccuaccuccgccggacccagagcaugggaauccagcuggaccaaagaauuaucgugcuuuuuauggucgcguggggcaaggaggcuguggauaacuuccaucugggggacgauauggaccccgaacuccgcacacuggcccagucucuuauugacguuaaagugaaggagaucuccaaucaggaaccucugaaacucuga

SEQ ID NO: 7046 - RNA, 1290 nt, Artificial Sequence
  derived and/or modified CDS sequence (opt5) from HTNV(AA1719)__AF427319.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucguggucccuauccuucugaaggcccucuauaugcugaccacacgcggaagacagaccacgaaagacaauaagggcacccggauucgcuuuaaagaugacucuagcuucgaagacgugaacggcaucagaaagcccaagcaucuuuacguuucccugccuaaugcgcaaucuagcaugaaagccgaggaaauuacacccgggcgguaucgcaccgcuaucugcggacucuacccugcccagauuaaggcuagacagaugaucuccccggugaugagcgucauuggcuuucuggcccuggcgaaagauuggucugaccggaucgagcaguggcucuccgaacccuguaagcugcuuccugauacagccgcugugagccugcucgggggacccgccaccaaccgcgacuaucugagacaaagacagguggcucuuggcaauauggagacgaaagagucuaaggccauccggcagcacgccgaagcugcggggugcuccauuaucgaggauauugaaagcccuucuuccaucugggucuucgccggagcucccgaccgcuguccgccuacaugccuguuuauugccggcaucgccgagcucggcgcuuucuuuagcauccugcaagauaugcggaacaccauuauggccuccaaaacaguugggaccucugaagagaagcugagaaagaaaagcuccuucuaccagagcuaccuccgccggacccagucuaugggaauccagcuggaccaaagaauuaucgugcuuuuuaugguggcguggggcaaggaggcugucgauaauuuccaucugggggacgauauggaccccgaacuccgcacacuggcccagucccuuauugacgugaaaguuaaggagaucagcaaccaggaaccucugaaacucuga

SEQ ID NO: 7047 - RNA, 1290 nt, Artificial Sequence
  derived and/or modified CDS sequence (opt5) from HTNV(AP1168)__AF427323.1__N
auggccaccauggaggaacugcagaaggagaucaacgcucacgaaggccaacucgugauugccagacagaaaguccgggacgcggagcgccaguacgaaaaggaucccgacgagcugaauaaaagagcucuuacagaucgggaggggguugccgccagcauccaggcuaagauugacgaacugaaacgccaacucgccgauagaaucgcuacgggaaagaaccugggcaaggagcaggacccuaccgggguggaaccgggagaucaucuuaaagagcgguccaugcugucuuauggcaaugugcucgaccugaaccaccuggauauugacgagcccacagggcagaccgccgauuggcucagcaucgucguguaccugacauccuucguugugccuauccuucugaaggcgcucuauaugcugaccacacgcggaagacagaccacgaaagacaauaagggcacccggauucgcuuuaaagaugacucuagcuucgaagacgucaacggcaucagaaagcccaagcaucuuuacgugucccugccuaaugcccaaucuagcaugaaagcugaggaaauuacacccgggcgguaucgcaccgccaucugcggacucuacccugcucagauuaaggccagacagaugguuuccccggugaugagcgucaucggcuuucuggcgcuggccaaagauuggggagaccggauugagcaguggcucucugaacccuguaagcugcuuccugauacagcugccgugucccugcacgggggccccgcuaccaaccgcgacuaucucagacaacggcaggccgcccuggggaauauggagacgaaagagagcaaggcuaucagacagcaugcggaaacagccggaugcucuaugaucgaggauauugaauccccuagcucuaucuggguguucgcuggcgcccccgaccgcuguccgccuaccugccuuuuuauugccggcaucgcugagcugggggccuucuuuuccauucuccaagauaugcggaacacaaucauggcgagcaaaaccgucggaaccuccgaagagaagcugagaaagaaaucuagcuucuaccaguccuaccugcgccggacacagagcaugggcauccagcucgaccaaagaauuaucguucuguuuaugguggcuugggggaaggaggccguggauaauuuccaccuuggagacgauauggaccccgaacugcgcacgcucgcccagucucugauugaccuuaaagucaaggagaucuccaaccaggaaccucugaaacucuga

SEQ ID NO: 7048 - RNA, 1290 nt, Artificial Sequence
  derived and/or modified CDS sequence (opt5) from HTNV(AP708)__AF427322.1__N
auggccaccauggaggaacugcagaaggagaucaacgcucacgaaggccaacucgugauugccagacagaaaguccgggacgcggagcgccaguacgaaaaggaucccgacgagcugaauaaaagagcucuuacagaucgggaggggguugccgccagcauccaggcuaagauugacgaacugaaacgccaacucgccgauagaaucgcuacgggaaagaaccugggcaaggagcaggacccuaccgggguggaaccgggagaucaucuuaaagagcgguccaugcugucuuauggcaaugugcucgaccugaaccaccuggauauugacgagcccacagggcagaccgccgauuggcucagcaucgucguguaccugacauccuucguugugccuauccuucugaaggcgcucuauaugcugaccacacgcggaagacagaccacgaaagacaauaagggcacccggauucgcuuuaaagaugacucuagcuucgaagacgucaacggcaucagaaagcccaagcaucuuuacgugucccugccuaaugcccaaucuagcaugaaagcugaggaaauuacacccgggcgguaucgcaccgccaucugcggacucuacccugcucagauuaaggccagacagaugguuuccccggugaugagcgucaucggcuuucuggcgcuggccaaagauuggggagaccggauugagcaguggcucucugaacccuguaagcugcuuccugauacagcugccgugucccugcacgggggccccgcuaccaaccgcgacuaucucagacaacggcaggccgcccuggggaauauggagacgaaagagagcaaggcuaucagacagcaugcggaaacagccggaugcucuaugaucgaggauauugaauccccuagcucugugugggucuucgcuggcgcccccgaccgcuguccgccuaccugccuuuuuaucgccggcauugcugagcugggggccuucuuuuccauccuccaagauaugcggaacacaauuauggcgagcaaaaccguuggaaccuccgaagagaagcugagaaagaaaucuagcuucuaccaguccuaccugcgccggacacagagcaugggcauccagcucgaccaaagaaucauugugcuguuuaugguggcuugggggaaggaggccgucgauaauuuccaccuuggagacgauauggaccccgaacugcgcacgcucgcccagucucugaucgaccuuaaagugaaggagauuuccaaccaggaaccucugaaacucuga

SEQ ID NO: 7049 - RNA, 1290 nt, Artificial Sequence
  derived and/or modified CDS sequence (opt5) from HTNV(DandongHu-32)__KC570386.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucguggucccuauccuucugaaggcccucuauaugcugaccacacgcggaagacagaccacgaaagacaauaagggcacccggauucgcuuuaaagaugacucuagcuucgaagacgugaacggcaucagaaagcccaagcaucuuuacguuucccugccuaaugcgcaaucuagcaugaaagccgaggaaauuacacccgggcgguaucgcaccgcuaucugcggacucuacccugcccagauuaaggcuagacagaugaucuccccggugaugagcgucauuggcuuucuggcccuggcgaaagauuggucugaccggaucgagcaguggcucuccgaacccuguaagcugcuuccugauacagccgcugugagccugcucgggggacccgccaccaaccgcgacuaucugagacaaagacagguggcucuuggcaauauggagacgaaagagucuaaggccauccggcagcacgccgaagcugcggggugcuccaugauugaggauaucgaaagcccuucuuccauuugggucuucgccggagcucccgaccgcuguccgccuacaugccuguuuaucgccggcauugccgagcucggcgcuuucuuuagcauccugcaagauaugcggaacaccaucauggccuccaaaacaguugggaccucugaagagaagcugagaaagaaaagcuccuucuaccagagcuaccuccgccggacccagucuaugggcauucagcuggaccaaagaaucauugugcuuuuuaugguggcguggggaaaggaggcugucgauaauuuccaucugggggacgauauggaccccgaacuccgcauccuggcccagucccuuauugacgugaaaguuaaggagaucagcaaccaggaaccucugaaacucuga

SEQ ID NO: 7050 - RNA, 1290 nt, Artificial Sequence
  derived and/or modified CDS sequence (opt5) from HTNV(DandongHu-34)__KC570387.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucguggucccuauccuucugaaggcccucuauaugcugaccacacgcggaagacagaccacgaaagacaauaagggcacccggauucgcuuuaaagaugacucuagcuucgaagacgugaacggcaucagaaagcccaagcaucuuuacguuucccugccuaaugcgcaaucuagcaugaaagccgaggaaauuacacccgggcgguaucgcaccgcuaucugcggacucuacccugcccagauuaaggcuagacagaugaucuccccggugaugagcgucauuggcuuucuggcccuggcgaaagauuggucugaccggaucgagcaguggcucuccgaacccuguaagcugcuuccugauacagccgcugugagccugcucgggggacccgccaccaaccgcgacuaucugagacaaagacagguggcucuuggcaauauggagacgaaagagucuaaggccauccggcagcacgccgaagcugcggggugcuccaugauugaggauaucgaaagcccuucuuccauuugggucuucgccggagcucccgaccgcuguccgccuacaugccuguuuaucgccggcauggccgagcucggcgcuuucuuuagcauucugcaagauaugcggaacaccaucauggccuccaaaacaguugggaccucugaagagaagcugagaaagaaaagcuccuucuaccagagcuaccuccgccggacccagucuaugggaauccagcuggaccaaagaauuaucgugcuuuuuaugguggcguggggcaaggaggcugucgauaauuuccaucugggggacgauauggaccccgaacuccgcacacuggcccagucccuuauugacgugaaaguuaaggagaucagcaaccaggaaccucugaaacucuga

SEQ ID NO: 7051 - RNA, 1290 nt, Artificial Sequence
  derived and/or modified CDS sequence (opt5) from HTNV(DandongHu-89)__KC570389.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucguggucccuauccuucugaaggcccucuauaugcugaccacacgcggaagacagaccacgaaagacaauaagggcacccggauucgcuuuaaagaugacucuagcuucgaagacgugaacggcaucagaaagcccaagcaucuuugcguuucccugccuaaugcgcaaucuagcaugaaagccgaggaaauuacacccgggcgguaccgcaccgcuaucuguggacucuauccugcccagauuaaggcuagacagaugaucuccccggugaugagcgucauuggcuuucuggcccuggcgaaagauuggucugaccggaucgagcaguggcucuccgaacccugcaagcugcuuccugauacagccgcugugagccugcucgggggacccgccaccaaccgcgacuaccugagacaaagacagguggcucuuggcaauauggagacgaaagagucuaaggccauccggcagcacgccgaagcugcgggguguuccaugauugaggauaucgaaagcccuucuuccauuugggucuucgccggagcucccgaccgcugcccgccuacaugucuguuuaucgccggcauugccgagcucggcgcuuucuuuagcauccugcaagauaugcggaacaccaucauggccuccaaaacaguugggaccucugaagagaagcugagaaagaaaagcuccuucuaucagagcuaccuccgccggacccagucuaugggcauucagcuggaccaaagaaucauugugcuuuuuaugguggcguggggaaaggaggcugucgauaauuuccaucugggggacgauauggaccccgaacuccgcacacuggcccagucccuuaucgacgugaaaguuaaggagauuagcaaccaggaaccucugaaacucuga

SEQ ID NO: 7052 - RNA, 1290 nt, Artificial Sequence
  derived and/or modified CDS sequence (opt5) from HTNV(DandongHu-91)__KC570390.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucggaaucgugaucuaccugaccagcuucguugugccuauucuucugaaggcccucuauaugcugacaacacgcggcagacagaccacgaaagacaauaagggcacccggauccgcuuuaaagaugacuccucuuucgaagacgucaacgggauuagaaagcccaagcaucuuuacgugagccugccuaaugcgcaauccucuaugaaagccgaggaaaucacacccggacgguaucgcaccgcuauuugcggccucuacccugcccagaucaaggcuagacagaugauuagcccgguuauguccgugaucggguuucuggcccuggcgaaagauuggagcgaccggaucgagcaguggcucucugaacccuguaagcugcuuccugauacagccgcugucucccugcucggaggccccgccaccaaccgcgacuaucugagacaaagacagguggcucuugggaauauggagacgaaagagagcaaggccauucggcagcacgccgaagcugcgggaugcucuaugaucgaggauauugaauccccuagcucuaucuggguguucgccggcgcucccgaccgcuguccgccuacaugccuguuuauugccggcauggccgagcucggggcuuucuuuuccauccugcaagauaugcggaacaccaucauggccagcaaaacagucggaaccuccgaagagaagcugagaaagaaaucuagcuucuaccaguccuaccuccgccggacccagagcaugggcauucagcuggaccaaagaaucauuguucuuuuuaugguggcgugggggaaggaggcuguggauaauuuccaucugggagacgauauggaccccgaacuccgcacacuggcccagucucuuaucgacgucaaagugaaggagauuuccaaccaggaaccucugaaacucuga

SEQ ID NO: 7053 - RNA, 1290 nt, Artificial Sequence
  derived and/or modified CDS sequence (opt5) from HTNV(Fuyuan-Aa-145)__KJ857349.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucguggucccuauccuucugaaggcccucuauaugcugaccacacgcggaagacagaccacgaaagacaauaagggcacccggauucgcuuuaaagaugacucuagcuucgaagacgugaacggcaucagaaagcccaagcaucuuuacguuucccugccuaaugcgcaaucuagcaugaaagccgaggaaauuacacccgggcgguaucgcaccgcuaucugcggacuccacccugcccagauuaaggcuagacagaugaucuccccggugaugagcgucauuggcuuucuggcccuggcgaaagauuggucugaccggaucgagcaguggcucuccgaacccuguaagcugcuuccugauacagccgcugugagccugcucgggggacccgccaccaaccgcgacuaccugagacaaagacagguggcucuuggcaauauggagacgaaagagucuaaggccauccggcagcaugccgaagcugcggggugcuccaugauugaggauaucgaaagcccuucuuccauuugggucuucgccggagcucccgaccgcuguccgccuacaugccuguuuaucgccggcauugccgagcucggcgcuuucuuuagcauccugcaagauaugcggaacaccaucauggccuccaaaacaguugggaccucugaagagaagcugagaaagaaaagcuccuucuaucagagcuaccuccgccggacccagucuaugggcauucagcuggaccaaagaaucauugugcuuuuuaugguggcguggggaaaggaggcugucgauaauuuccaccugggggacgauauggaccccgaacuccgcacacuggcccagucccuuaucgacgugaaaguuaaggagauuagcaaccaggaaccucugaaacucuga

SEQ ID NO: 7054 - RNA, 1290 nt, Artificial Sequence
  derived and/or modified CDS sequence (opt5) from HTNV(Fuyuan-Aa-26)__KJ857347.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucgccgugccuauccuucugaaggcgcucuauaugcugaccacacgcggaagacagaccacgaaagacaauaagggcacccggauucgcuuuaaagaugacucuagccuugaagacgucaacggcaucagaaagcccaagcaucuguacgugucccucccuaaugcccaaucuagcaugaaagcugaggaaauuacacccgggcgguaucgcaccgccaucugcggacuguacccugcucagauuaaggccagacagaugaucuccccgguuaugagcgugauuggcuuccuggcgcucgccaaagauuggucugaccggaucgagcaguggcuguccgaacccuguaaacuucugccugauacagcugccgucagccuccugggaggacccgcuaccaaccgcgacuaucuuagacaaagacagguggcccugggcaauauggagacgaaggagucuaaggccauccggcagcacgcugaagcggccgggugcuccaugauugaggauaucgaaagcccuucuuccauuuggguguuugcuggagcccccgaccgcuguccgccuacaugccccuucaucgccggcauugcugagcucggcgccuuuuucagcauccugcaagauaugcggaacaccaucauggcguccaaaacagucgggaccucugaagagaagcugagaaagaaaagcuccuuuuaccagagcuaccuccgccggacccagucuauggggauucagcuggaccaaagaaucauuguucuuuucaugguggcuuggggcaaggaggccguggauaauuuucaucugggggacgauauggacccugaacuccgcacacuggcccagucccuuaucgacgucaaagugaaggagauuagcaaccaggaaccccugaaacucuga

SEQ ID NO: 7055 - RNA, 1290 nt, Artificial Sequence
  derived and/or modified CDS sequence (opt5) from HTNV(JS1)__KP970572.1__N
auggccaccauggaggaacugcagagagagaucaacgcucacgaaggccaacucgugauugcccggcagaagguccgcgacgcggagaaacaguacgaaaaugaucccgacgagcugaacaagagagcucuuacaaaucgggaggggguugccgugagcauccaggccaaaauugaugaacugaagcgccaacucgcugacagaaucgccacgggcaaaaaccugggaaaggagcaggauccuaccgggguggaaccgggagaccaucuuaaggagcgguccaugcugucuuauggcaauguccucgaucugaaccaccuggacauugaugagcccacagggcagaccgcugacuggcucagcaucaucguguaccugacauccuucguugugccuauucuucugaaagcccucuauaugcugaccacacgcggaagacagaccacgaaggauaauaaaggcacccggauccgcuuuaaggacgauucuagcuucgaagacgucaacggcauuagaaaacccaagcaucuuuacgugucccugccuaaugcgcaaucuagcaugaaggccgaggaaaucacacccgggcgguaucgcaccgcuguuugcggacucuacccugcccagauuaaagcuagacagaugaucuccccggugaugagcgucauuggcuuucuggcccuggcgaaggacuggucugaucggaucgagcaguggcucaucgaacccuguaaacugcuuccugacacagccgcugugucccugcucgggggacccgccaccaaccgcgauuaucugagacaaagacagguggcucuuggcaauauggagacgaaggagagcaaagccauucggcagcacgccgaagcugcggggugcucuaugaucgaggacauugaauccccuagcucuaucugggucuucgccggagcucccgaucgcuguccgccuacaugccuguuuauugccggcaucgccgagcucggcgcuuucuuuuccauccugcaagacaugcggaacaccauuauggccagcaagacaguugggaccuccgaagagaaacugagaaagaagucuagcuucuaccaguccuaccuccgccggacccagagcaugggaauccagcuggaucaaagaauuaucgugcuuuuuaugguggcguggggcaaagaggcugucgacaauuuccaucugggggaugacauggaucccgaacuccgcacacuggcccagucucuuauugacgugaagguuaaagagaucuccaaccaggaaccucugaagcucuga

SEQ ID NO: 7056 - RNA, 1290 nt, Artificial Sequence
  derived and/or modified CDS sequence (opt5) from HTNV(LongquanAa-08-150)__JQ912697.1__N
auggccaccauggaggaacugcagagagagaucgacgcucacgaaggccaacucgugauugcccggcagaagguccgcgaugcggagaaacaguacgaaaaggaccccgaugagcugaacaaaagagcucuuacagaccgggaggggguugccgccagcauccaggcuaagauugaugaacugaaacgccaacucgccgacagaaucgcuacgggaaagaaucugggcaaggagcaggauccuaccgggguggaaccgggagaccaucuuaaagagcgguccaugcugucuuauggcaacgugcucgaucugaaucaccuggacauugaugagcccacagggcagaccgccgacuggcucagcaucgucguguaccugacauccuucguugugccuauccuucugaaggcgcucuauaugcugaccacacgcggaagacagaccacgaaagauaacaagggcacccggauucgcuuuaaagacgacucuagcuucgaagaugucaauggcaucagaaagcccaagcaucuuuacgugucccugccuaacgcccaaucuagcaugaaagcugaggaaauuacacccgggcgguaucgcaccgccaucugcggacucuacccugcucagauuaaggccagacagaugaucuccccgguuaugagcgugauuggcuuucuggcgcuggccaaagacugggcugaucggaucgagcaguggcucucugaacccuguaagcugcuuccugacacagccgcugucucccugcacgggggacccgccaccaaucgcgauuaucucagacaaagacagguggcccugggcaacauggagacgaaagagagcaaggcuauccggcagcaugcggaaacagccgggugcucuaugauugaggacaucgaauccccuagcucuauuuggguguucgcuggagcccccgaucgcuguccgccuaccugccuuuuuaucgccggcauugcugagcugggcgccuucuuuuccauccuccaagacaugcggaauacaaucauggcgagcaaaaccgucgggaccuccgaagagaagcugagaaagaaaucuagcuucuaccaguccuaccugcgccggacacagagcaugggcauucagcucgaucaaagaaucauuguucuguuuaugguggcuuggggaaaggaggccguggacaacuuccaccuuggggaugacauggaccccgaacugcgcacgcucgcccagucucugaucgaugucaaagugaaggagauuuccaaucaggaaccucuuaaacuguga

SEQ ID NO: 7057 - RNA, 1290 nt, Artificial Sequence
  derived and/or modified CDS sequence (opt5) from HTNV(LongquanAa-08-157)__JQ912698.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgccagcauccaggcuaagauugacgaacugaaacgccaacucgccgauagaaucgcuacgggaaagaaccugggcaaggagcaggacccuaccgggguggaaccgggagaucaucuuaaagagcgguccaugcugucuuauggcaaugugcucgaccugaaccaccuggauauugacgagcccacagggcagaccgccgauuggcucagcaucgucguguaccugacauccuucguugugccuauccuucugaaggcgcucuauaugcugaccacacgcggaagacagaccacgaaagacaauaagggcacccggauucgcuuuaaagaugacucuagcuucgaagacgucaacggcaucagaaagcccaagcaucuuuacgugucccugccuaaugcccaaucuagcaugaaagcugaggaaauuacacccgggcgguaucgcaccgccaucugcggacucuacccugcucagauuaaggccagacagaugaucuccccgguuaugagcgugauuggcuuucuggcgcuggccaaagauugggcugaccggaucgagcaguggcucucugaacccuguaagcugcuuccugauacagccgcugucucccugcacgggggacccgccaccaaccgcgacuaucucagacaaagacagguggcccugggcaauauggagacgaaagagagcaaggcuauccggcagcaugcggaaacagccgggugcucuaugauugaggauaucgaauccccuagcucuauuuggguguucgcuggagcccccgaccgcuguccgccuaccugccuuuuuaucgccggcauugcugagcugggcgccuucuuuuccauccuccaagauaugcggaacacaaucauggcgagcaaaaccgucgggaccuccgaagagaagcugagaaagaaaucuagcuucuaccaguccuaccugcgccggacacagagcaugggcauucagcucgaccaaagaaucauuguucuguuuaugguggcuuggggaaaggaggccguggauaauuuccaccuuggggacgauauggaccccgaacugcgcacgcucgcccagucucugaucgacgucaaagugaaggagauuuccaaccaggaaccucuuaaacuguga

SEQ ID NO: 7058 - RNA, 1290 nt, Artificial Sequence
  derived and/or modified CDS sequence (opt5) from HTNV(LongquanAa-08-314)__JQ912709.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgccagcaugcaggcuaagaucgacgaacugaaacgccaacucgccgauagaauugcuacgggaaagaaccugggcaaggagcaggacccuaccgggguggaaccgggagaucaucuuaaagagcgguccaugcugucuuauggcaaugugcucgaccugaaccaccuggauaucgacgagcccacagggcagaccgccgauuggcucagcauugucguguaccugacauccuucguugugccuauccuucugaaggcgcucuauaugcugaccacacgcggaagacagaccacgaaagacaauaagggcacccggauccgcuuuaaagaugacucuagcuucgaagacgucaacggcauuagaaagcccaagcaucuuuacgugucccugccuaaugcccaaucuagcaugaaagcugaggaaaucacacccgggcgguaucgcaccgccauuugcggacucuacccugcucagaucaaggccagacagaugauuuccccgguuaugagcgugaucggcuuucuggcgcuggccaaagauugggcugaccggauugagcaguggcucucugaacccuguaagcugcuuccugauacagccgcugucucccugcacgggggacccgccaccaaccgcgacuaucucagacaaagacagguggcccugggcaauauggagacgaaagagagcaaggcuauccggcagcaugcggaaacagccgggugcucuaugaucgaggauauugaauccccuagcucuaucuggguguucgcuggagcccccgaccgcuguccgccuaccugccuuuuuauugccggcaucgcugagcugggcgccuucuuuuccauucuccaagauaugcggaacacaaucauggcgagcaaaaccgucgggaccuccgaagagaagcugagaaagaaaucuagcuucuaccaguccuaccugcgccggacacagagcaugggaauccagcucgaccaaagaauuaucguucuguuuaugguggcuuggggcaaggaggccguggauaauuuccaccuuggggacgauauggaccccgaacugcgcacgcucgcccagucucugauugacgucaaagugaaggagaucuccaaccaggaaccucuuaaacuguga

SEQ ID NO: 7059 - RNA, 1290 nt, Artificial Sequence
  derived and/or modified CDS sequence (opt5) from HTNV(LongquanAa-08-573)__JQ912714.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgccagcauccaggcuaagauugacgaacugaaacgccaacucgccgauagaaucgcuacgggaaagaaccugggcaaggagcaggacccuaccgggguggaaccgggagaucaucuuaaagagcgguccaugcugucuuauggcaaugugcucgaccugaaccaccuggauauugacgagcccacagggcagaccgccgauuggcucagcaucgucguguaccugacauccuucguugugccuauccuucugaaggcgcucuauaugcugaccacacgcggaagacagaccacgaaagacaauaagggcacccggauucgcuuuaaagaugacucuagcuucgaagacgucaacggcaucagaaagcccaagcaucuuuacgugucccugccuaaugcccaaucuagcaugaaagcugaggaaauuacacccgggcgguaucgcaccgccaucugcggacucuacccugcucagauuaaggccagacagaugaucuccccgguuaugagcgugauuggcuuucuggcgcuggccaaagauugggcugaccggaucgagcaguggcucucugaacccuguaagcugcuuccugauacagccgcugucucccugcacgggggacccgccaccaaccgcgacuaucucagacaaagacagguggcccugggcaauauggagacgaaagagagcaaggcuauccggcagcaugcggccacagcugggugcucuaugauugaagauaucgaguccccuagcucuauuuggguguucgccggagcccccgaccgcuguccgccuaccugccuuuuuaucgcuggcauugccgaacugggcgcguucuuuuccauccuccaagauaugcggaacacaaucauggcuagcaaaaccgucgggaccuccgaggaaaagcugagaaagaaaucuagcuucuaccaguccuaccugcgccggacacagagcaugggcauucagcucgaccaaagaaucauuguucuguuuaugguggccuggggaaaggaggccguggauaauuuccaccuuggggacgauauggaccccgagcugcgcacgcucgcucagucucugaucgacgucaaagugaaggaaauuuccaaccaggagccucuuaaacuguga

SEQ ID NO: 7060 - RNA, 1290 nt, Artificial Sequence
  derived and/or modified CDS sequence (opt5) from HTNV(LongquanAa-09-113)__JQ912716.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgccagcauccaggcuaagauugacgaacugaaacgccaacucgccgauagaaucgcuacgggaaagaaccugggcaaggagcaggacccuaccgggguggaaccgggagaucaucuuaaagagcgguccaugcugucuuauggcaaugugcucgaccugaaccaccuggauauugacgagcccacagggcagaccgccgauuggcucagcaucgucguguaccugacauccuucguugugccuauccuucugaaggcgcucuauaugcugaccacacgcggaagacagaccacgaaagacaauaagggcacccggauucgcuuuaaagaugacucuagcuucgaagacgucaacggcacaagaaagcccaagcaucuuuacgugucccugccuaaugcccaaucuagcaugaaagcugaggaaaucacccccgggcgguaucgcacagccauuugcggacucuacccugcucagaucaaggccagacagaugauuuccccgguuaugagcgugaucggcuuucuggcgcuggccaaagauugggcugaccggauugagcaguggcucucugaacccuguaagcugcuuccugauaccgccgcugucucccugcacgggggacccgccacgaaccgcgacuaucucagacaaagacagguggcccugggcaauauggagacaaaagagagcaaggcuauccggcagcaugcggaaaccgccgggugcucuaugaucgaggauauugaauccccuagcucuaucuggguguucgcuggagcccccgaccgcuguccgccuacaugccuuuuuauugccggcaucgcugagcugggcgccuucuuuuccauucuccaagauaugcggaacaccaucauggcgagcaaaaccgucgggacauccgaagagaagcugagaaagaaaucuagcuucuaccaguccuaccugcgccggacgcagagcaugggaauccagcucgaccaaagaauuaucguucuguuuaugguggcuuggggcaaggaggccguggauaauuuccaccuuggggacgauauggaccccgaacugcgcacccucgcccagucucugauugacgucaaagugaaggagaucuccaaccaggaaccucuuaaacuguga

SEQ ID NO: 7061 - RNA, 1290 nt, Artificial Sequence
  derived and/or modified CDS sequence (opt5) from HTNV(LongquanAa-09-191)__JQ912719.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgccagcauccaggcuaagauugacgaacugaaacgccaacucgccgauagaaucgcuacgggaaagaaccugggcaaggagcaggacccuaccgggguggaaccgggagaucaucuuaaagagcgguccaugcugucuuauggcaaugugcucgaccugaaccaccuggauauugacgagcccacagggcagaccgccgauuggcucagcaucgucguguaccugacauccuucguugugccuauccuucugaaggcgcucuauaugcugaccacacgcggaagacagaccauuaaagacaauaagggcacgcggauccgcuuuaaagaugacucuagcuucgaagacgucaacggcauuagaaagcccaagcaucuuuacgugucccugccuaaugcccaaucuagcaugaaagcugaggaaaucacccccgggcgguaucgcacagccauuugcggacucuacccugcucagaucaaggccagacagaugauuuccccgguuaugagcgugaucggcuuucuggcgcuggccaaagauugggcugaccggaucgagcaguggcucucugaacccuguaagcugcuuccugauaccgccgcugucucccugcacgggggacccgccacaaaccgcgacuaucucagacaaagacagguggcccugggcaauauggagaccaaagagagcaaggcuauucggcagcaugcggaaacggccgggugcucuaugaucgaggauauugaauccccuagcucuaucuggguguucgcuggagcccccgaccgcuguccgccuacaugccuuuuuauugccggcaucgcugagcugggcgccuucuuuuccauccuccaagauaugcggaacaccauuauggcgagcaaaacagucgggaccuccgaagagaagcugagaaagaaaucuagcuucuaccaguccuaccugcgccggacccagagcaugggaauccagcucgaccaaagaauuaucguucuguuuaugguggcuuggggcaaggaggccguggauaauuuccaccuuggggacgauauggaccccgaacugcgcacacucgcccagucucugauugacgucaaagugaaggagaucuccaaccaggaaccucuuaaacuguga

SEQ ID NO: 7062 - RNA, 1290 nt, Artificial Sequence
  derived and/or modified CDS sequence (opt5) from HTNV(LongquanAa-09-192)__JQ912720.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgccagcaugcagggaaagaucgacgaacugaaacgccaacucgcugauagaauugccacgggcaagaaccuggggaaggagcaggacccuaccggaguggaaccgggcgaucaucuuaaagagcgguccaugcugucuuaugggaaugugcucgaccugaaccaccuggauaucgacgagcccacaggacagaccgcugauuggcucagcauugucguguaccugacauccuucguugugccuauccuucugaaggcccucuauaugcugaccacacgcggcagacagaccacgaaagacaauaagggcacccggauccgcuuuaaagaugacucuagcuucgaagacgucaacgggauuagaaagcccaagcaucuuuacgugucccugccuaaugcgcaaucuagcaugaaagccgaggaaaucacacccggacgguaucgcaccgcuauuugcggccucuacccugcccagaucaaggcuagacagaugauuuccccgguuaugagcgugaucggguuucuggcccuggcgaaagauugggccgaccggauugagcaguggcucucugaacccuguaagcugcuuccugauacagcugccgucucccugcacggaggccccgcuaccaaccgcgacuaucucagacaaagacagguggcccuggggaauauggagacgaaagagagcaaggccauccggcagcaugcugaaacagcgggaugcucuaugaucgaggauauugaauccccuagcucuaucuggguguucgccggcgcucccgaccgcuguccgccuaccugccuuuuuauugccggcaucgccgagcugggggcuuucuuuuccauucuccaagauaugcggaacacaaucauggccagcaaaaccgucggaaccuccgaagagaagcugagaaagaaaucuagcuucuaccaguccuaccugcgccggacacagagcaugggcauccagcucgaccaaagaauuaucguucuguuuaugguggcgugggggaaggaggcuguggauaauuuccaccuuggagacgauauggaccccgaacugcgcacgcucgcccagucucugauugacgucaaagugaaggagaucuccaaccaggaaccucuuaaacuguga

SEQ ID NO: 7063 - RNA, 1290 nt, Artificial Sequence
  derived and/or modified CDS sequence (opt5) from HTNV(LongquanAa-10-46)__JQ912754.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgccagcauccaggcuaagauugacgaacugaaacgccaacucgccgauagaaucgcuacgggaaagaaccugggcaaggagcaggacccuaccgggguggaaccgggagaucaucuuaaagagcgguccaugcugucuuauggcaaugugcucgaccugaaccaccuggauauugacgagcccacagggcagaccgccgauuggcucagcaucgucguguaccugacauccuucguugugccuauccuucugaaggcgcucuauaugcugaccacacgcggaagacagaccacgaaagacaauaagggcacccggauucgcuuuaaagaugacucuagcuucgaagacgucaacggcaucagaaagcccgagcaucuuuacgugucccugccuaaugcccaaucuagcaugaaggcugaagagauuacacccgggcgguaucgcaccgccaucugcggacucuacccugcucagauuaaagccagacagaugaucuccccgguuaugagcgugauuggcuuucuggcgcuggccaaggauugggcugaccggaucgaacaguggcucucugagcccuguaaacugcuuccugauacagccgcugucucccugcacgggggacccgccaccaaccgcgacuaucucagacaaagacagguggcccugggcaauauggagacgaaggaaagcaaagcuauccggcagcaugcggagacagccgggugcucuaugauugaagauaucgaguccccuagcucuauuuggguguucgcuggagcccccgaccgcuguccgccuaccugccuuuuuaucgccggcauugcugaacugggcgccuucuuuuccauccuccaagauaugcggaacacaaucauggcgagcaagaccgucgggaccuccgaggagaaacugagaaagaagucuagcuucuaccaguccuaccugcgccggacacagagcaugggcauucagcucgaccaaagaaucauuguucuguuuaugguggcuuggggaaaagaagccguggauaauuuccaccuuggggacgauauggaccccgagcugcgcacgcucgcccagucucugaucgacgucaaggugaaagaaauuuccaaccaggagccucuuaagcuguga

SEQ ID NO: 7064 - RNA, 1290 nt, Artificial Sequence
  derived and/or modified CDS sequence (opt5) from HTNV(LongquanAa-11-745)__KC344237.1__N
auggccaccauggaggaacugcagaaggagaucaacgcucacgaaggccaacucgugauugccagacagaaaguccgggacgcggagaagcaguacgaaaaagaucccgacgagcugaauaagcgcgcucuuacagauagagaggggguugccgccagcauccaggcuaaaauugacgaacugaagcggcaacucgccgaucgcaucgcuacgggaaagaaccugggcaaagagcaggacccuaccgggguggaaccgggagaucaucuuaaggagagauccaugcugucuuauggcaaugugcucgaccugaaccaccuggauauugacgagcccacagggcagaccgccgauuggcucagcaucgucguguaccugacauccuucguugugccuauccuucugaaagcgcucuauaugcugaccacacggggacgccagaccacgaaggacaauaaaggcacccggauuagauuuaaggaugacucuagcuucgaagacgucaacggcauccgcaagcccaaacaucuuuacgugucccugccuaaugcccaaucuagcaugaaggcugaggaaauuacacccgggagauaucggaccgccaucugcggacucuacccugcucagauuaaagcccgccagaugaucuccccgguuaugagcgugauuggcuuucuggcgcuggccaaggauugggcugacagaaucgagcaguggcucucugaacccuguaaacugcuuccugauacagccgcugucucccugcacgggggacccgccaccaaccgggacuaucuccgccaaagacagguggcccugggcaauauggagacgaaggagagcaaagcuauccggcagcaugcggaaacagccgggugcucuaugauugaggauaucgaauccccuagcucuauuuggguguucgcuggagcccccgacagauguccgccuaccugccuuuuuaucgccggcauugcugagcugggcgccuucuuuuccauccuccaagauaugcgcaacacaaucauggcgagcaagaccgucgggaccuccgaagagaagcugcggaaaaagucuagcuucuaccaguccuaccugagacgcacacagagcaugggcauucagcucgaccaacggaucauuguucuguuuaugguggcuuggggaaaagaggccguggauaauuuccaccuuggggacgauauggaccccgaacugagaacgcucgcccagucucugaucgacgucaaggugaaagagauuuccaaccaggaaccucuuaagcuguga

SEQ ID NO: 7065 - RNA, 1290 nt, Artificial Sequence
  derived and/or modified CDS sequence (opt5) from HTNV(ROKA14-11)__KU207207.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucguggucccuauccuucugaaggcccucuauaugcugaccacacgcggaagacagaccacgaaagacaauaagggcacccggauucgcuuuaaagaugacucuagcuucgaagacgugaacggcaucagaaagcccaagcaucuuuacguuucccugccuaaugcgcaaucuagcaugaaagccgaggaaauuacacccgggcgguaucgcaccgcugugugcggacucuacccugcccagaucaaggcuagacagaugauuuccccggucaugagcgugaucggcuuucuggcccuggcgaaagauuggucugaccggauugagcaguggcucuccgaacccuguaagcugcuuccugauacagccgcugugagccugcucgggggacccgccaccaaccgcgacuaucugagacaacggcaggucgcucuuggcaauauggagacgaaagagucuaaggccaucagacagcacgccgaagcugcggggugcuccaugaucgaggauauugaaagcccuucuuccaucuggguuuucgccggagcucccgaccgcuguccgccuacaugccuguuuguggccggcauugccgagcucggcgcuuucuuuagcauccugcaagauaugcggaacaccauuauggccuccaaaacaguggggaccucugaagagaagaugagaaagaaaagcuccuucuaccagagcuaccugcgccggacccagucuaugggaauccagcucgaccaaagaaucauuguccuguuuaugguggcguggggcaaggaggcuguugauaauuuccaucuuggggacgauauggaccccgaacugcgcacacucgcccagucccugaucgacgugaaagucaaggagauuagcaaccaggaaccucuuaaacuguga

SEQ ID NO: 7066 - RNA, 1290 nt, Artificial Sequence
  derived and/or modified CDS sequence (opt5) from HTNV(US8A14-2)__KU207208.1__N
auggccaccauggaggaacugcagagagagaucaacgcucacgaaggccaacucgugauugcccggcagaagguccgcgacgcggagaaacaggaugggaaggaccccgaugaacugaauaaaagagcucuuacagaccgggagggaguugccgugagcauccaggccaagauugaugagcugaaacgccaacucgcugacagaaucgccacgggcaagaaccuggggaaggaacaggauccuaccggaguggagccgggcgaccaucuuaaagaacgguccaugcugucuuacgggaauguccucgaucugaaccaccuggacauugaugagcccacaggacagaccgcugacuggcucagcaucgugguuuaucugacauccuucguggucccuauccuucugaaggcccucuacaugcugaccacacgcggcagacagaccacgaaagauaauaagggcacccggauucgcuuuaaagacgacucuagcuucgaggaugugaacgggaucagaaagcccaagcaucuuuauguuucccugccuaaugcgcaaucuagcaugaaagccgaagagauuacacccggacgguaccgcaccgcugugugcggccucuauccugcccagaucaaggcuagacagaugauuuccccggucaugagcgugaucggguuucuggcccuggcgaaagacuggucugaucggauugaacaguggcucuccgagcccuguaagcugcuuccugacacagccgcugugagccugcucggaggccccgccaccaaccgcgauuaccugagacaacggcaggucgcucuugggaauauggaaacgaaagagucuaaggccaucagacagcacgccgaggcugcgggaugcuccaugaucgaagacauugagagcccuucuuccaucuggguuuucgccggcgcucccgaucgcuguccgccuacaugccuguuuauugccggcaucgccgaacucggggcuuucuuuagcauucugcaagacaugcggaacaccaucauggccuccaaaacagugggaaccucugaggaaaagcugagaaagaaaagcuccuucuaucagagcuaccuccgccggacccagucuaugggcauccagcuggaucaaagaauuaucgugcuuuuuauggucgcgugggggaaggaggcuguggacaauuuccaucugggagaugacauggaccccgagcuccgcacacuggcccagucccuuauugauguuaaagugaaggaaaucagcaaccaggagccucugaaacucuga

SEQ ID NO: 7067 - RNA, 1290 nt, Artificial Sequence
  derived and/or modified CDS sequence (opt5) from HTNV(US8A15-1)__KU207209.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucguggucccuauccuucugaaggcccucuauaugcugaccacacgcggaagacagaccacgaaagacaauaagggcacccggauucgcuuuaaagaugacucuagcuucgaagacgugaacggcaucagaaagcccaagcaucuuuacguuucccugccuaaugcgcaaucuagcaugaaagccgaggaaauuacacccgggcgguaucgcaccgcugugugcggacucuacccugcccagaucaaggcuagacagaugauuuccccggucaugagcgugaucggcuuucuggcccuggcgaaagauuggucugaccggauugagcaguggcucuccgaacccuguaagcugcuuccugauacagccgcugugagccugcucgggggacccgccaccaaccgcgacuaucugagacaacggcaggucgcucuuggcaauauggagacgaaagagucuaaggccaucagacagcacgccgaagcugcggggugcuccaugaucgaggauauugaaagcccuucuuccaucuggguuuucgccggagcucccgaccgcuguccgccuacaugccuguuuauugccggcaucgccgagcucggcgcuuucuuuagcauucugcaagauaugcggaacaccaucauggccuccaaaaucguggggacaucugaagagaagcugagaaagaaaagcuccuucuaccagagcuaccuccgccggacccagucuaugggcauucagcuggaccaaagaaucauugugcuuuuuauggucgcguggggaaaggaggcuguggauaauuuccaucugggggacgauauggaccccgaacuccgcacccuggcccagucccuuaucgacguuaaagugaaggagauuagcaaccaggaaccucugaaacucuga

SEQ ID NO: 7068 - RNA, 1290 nt, Artificial Sequence
  derived and/or modified CDS sequence (opt5) from HTNV(YaluRiver13)__HQ611981.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucguggucccuauccuucugaaggcccucuauaugcugaccacacgcggaggccagaccacgaaagacaauaagggcacccggauuagauuuaaagaugacucuagcuucgaagacgugaacgggauccgcaagcccaagcaucuuuacguuucccugccuaaugcgcaaucuagcaugaaagccgaggaaauuacacccggaagauaucggaccgcuaucugcggccucuacccugcccagauuaaggcucgccagaugaucuccccggugaugagcgucauuggguuucuggcccuggcgaaagauuggucugacagaaucgagcaguggcucuccgaacccuguaagcugcuuccugauacagccgcugugagccugcucggaggccccgccaccaaccgggacuaucugcgccaaagacagguggcucuugggaauauggagacgaaagagucuaaggccauccggcagcacgccgaagcugcgggaugcuccaugauugaggauaucgaaagcccuucuuccauuugggucuucgccggcgcucccgacagauguccgccuacaugccuguuuaucgccagcauuggcgagcucggggccuucuuuuccauccugcaagauaugcgcaacaccaucauggcuucuaaaacaguuggaaccagcgaagagaagcugcggaagaaauccagcuucuaccagucuuaccucagacgcacccaguccaugggcauucagcuggaccaacggaucauugugcuuuuuauggugagcugggggaaggaggccgucgauaauuuccaucugggagacgauauggaccccgaacucagaacacuggcgcagucucuuaucgacgugaaaguuaaggagauuccuaaccaggaaccccugaaacucuga

SEQ ID NO: 7069 - RNA, 1290 nt, Artificial Sequence
  derived and/or modified CDS sequence (opt5) from HTNV(84FLi)__AY017064.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugccagcauccaggccaagauugacgaacugaaacgccaacucgcugauagaaucgccaccggaaagaaccugggcaaggagcaggacccuacagggguggaaccgggagaucaucuuaaagagcgguccaugcugucuuauggcaaugugcucgaccugaacuaccuggauauugacgagcccaccgggcagacagcugauuggcucagcaucgucaucuaucugaccuccuucgugguuccuauucuucugaaggcccucuacaugcugacaacccgcggaagacagacgaccaaagacaauaagggcacacggauccgcuuuaaagaugacucuagcuucgaagacgugaacggcauuagaaagcccaagcaccuuuaugucucccugccuaaugcgcaaucuagcaugaaagccgaggaaaucacccccgggcgguaccgcacagcuauuugcggacucuauccugcccagaucaaggcuagacagaugauuuccccggugaugagcguuaucggcuuucuggcccuggcgaaagauuggucugaccggaucgagcaguggcucuccgaacccuguaagcugcuuccugauaccgccgcugugagccugcaugggggacccgccacgaaccgcgacuaccucagacaacggcaggucgcucugggcaauauggagacaaaagagucuaaggccauuagacagcacgccgaauccgcugggugcagcaugaucgaggauauugaaucuccuuccagcaucuggguguucgcgggagcccccgaccgcuguccgccuaccugccuuuuuauugcuggcaucgccgagcugggcgccuucuuuuccauccuccaagauaugcggaacacaauuauggcuucuaaaaccguggggaccagcgaagagaagcugagaaagaaauccagcuucuaccagucuuaucugcgccggacacaguccaugggaauccagcucgaccaaagaauuaucguccuguuuaugguugccuggggcaaggaggcgguggauaauuuccaucuuggggacgauauggaccccgaacugcgcacgcucgcucagagccugauugacgugaaagucaaggagaucucuaaccaggaaccucuuaaacuguga

SEQ ID NO: 7070 - RNA, 1290 nt, Artificial Sequence
  derived and/or modified CDS sequence (opt5) from HTNV(Bao14)__AB127998.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugugagcauccaggccaagauugacgaacugaaacgccaacucgccgauagaaucgcuaccggaaagaaccugggcaaggagcaggacccuacagggguggaaccgggagaucaucuuaaagagcgguccaugcugucuuauggcaauguccucgaccugaaccaccuggauauugacgagcccaccgggcagacagccgauuggcucagcaucgugguuuaccugaccuccuucguggucccuauccuucugaaggcucucuauaugcugacaacccgcggaagacagacgaccaaagacaauaagggcacacggauucgcuuuaaagaugacucuagcuucgaagacgugaacggcaucagaaagcccaagcaucuuuacguuucccugccuaaugcccaaucuagcaugaaagcggaggaaauuacccccgggcgguaucgcacagccaucugcggacucuacccugcucagauuaaggccagacagaugaucuccccggugaugagcgucauuggcuuucuggcucuggccaaagauuggucugaccggaucgagcaguggcucuccgaacccuguaagcugcuuccugauaccgcggccgugagccugcucgggggacccgcuacgaaccgcgacuaucugagacaaagacagguggcccuuggcaauauggagacaaaagagucuaaggcuauccggcagcacgccgaagccgcugggugcuccaugauugaggauaucgaaagcccuucuuccauuugggucuucgcgggagcccccgaccgcuguccgccuaccugccuguuuaucgcuggcauugccgagcucggcgccuucuuuagcauccugcaagauaugcggaacacaaucauggcuuccaaaaccguugggaccucugaagagaagcugagaaagaaaagcuccuucuaccagagcuaccuccgccggacacagucuaugggcauucagcuggaccaaagaaucauugugcuuuuuaugguggccuggggaaaggaggcggucgauaauuuccaucugggggacgauauggaccccgaacuccgcacgcuggcucagucccuuaucgacgugaaaguuaaggagauuagcaaccaggaaccucugaaacucuga

SEQ ID NO: 7071 - RNA, 1290 nt, Artificial Sequence
  derived and/or modified CDS sequence (opt5) from HTNV(Chen4)__AB027101.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugccagcauccaggccaagauugacgaacugaaacgccaacucgcugauagaaucgccaccggaaagaaccugggcaaggagcaggacccuacagggguggaaccgggagaucaucuuaaagagcgguccaugcugucuuauggcaaugugcucgaccugaaccaccuggauauugacgagcccaccgggcagacagcugauuggcucagcaucgucaucuaccugaccuccuucgugguuccuauucuucugaaggcccucuauaugcugacaacccgcggaagacagacgaccaaagacaauaagggcacacggauccgcuuuaaagaugacucuagcuucgaagacgugaacggcauuagaaagcccaagcaucuuuacgucucccugccuaaugcgcaaucuagcaugaaagccgaggaaaucacccccgggcgguaucgcacagcuauuugcggacucuacccugcccagaucaaggcuagacagaugauuuccccggugaugagcguuaucggcuuucuggcccuggcgaaagauuggucugaccggaucgagcaguggcucuccgcccccuguaagcugcuuccugauaccgcugccgugagccugcacgggggacccgcuacgaaccgcgacaaucucagacaacggcaggucgcccugggcaacauggaaacaaaagagucuaaggccauuagacagcaugcugaguccgcggggugcagcaugaucgaagauauugagucuccuuccagcaucuggguguucgccggagcucccgaccgcuguccgccuaccugccuuuuuauugccggcaucgccgaacugggcgcuuucuuuuccauccuccaagauaugcggaauacaauuauggccucuaaaaccguggggaccagcgaggaaaagcugagaaagaaauccagcuucuaucagucuuaccugcgccggacacaguccaugggaauccagcucgaccaaagaauuaucguccuguuuaugguugcguggggcaaggaggcuguggauaacuuccgccuuggggacgauauggaccccgagcugcggacgcucgcccagagccugauugacgugaaagucaaggaaaucucuaaucaggagccucuuaaacuguga

SEQ ID NO: 7072 - RNA, 1290 nt, Artificial Sequence
  derived and/or modified CDS sequence (opt5) from HTNV(Hu)__AB027111.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgccagcauccaggcuaagauugacgaacugaaacgccaacucgccgauagaaucgcuacgggaaagaaccugggcaaggagcaggacccuaccgggguggaaccgggagaucaucuuaaagagcgguccaugcugucuuauggcaaugugcucgaccugaaccaccuggauauugacgagcccacagggcagaccgccgauuggcucagcaucgucaucuaccugacauccuucgugguuccuauucuucugaaggcgcucuauaugcugaccacacgcggaagacagaccacgaaagacaauaagggcacccggauccgcuuuaaagaugacucuagcuucgaagacgugaacggcauuagaaagcccaagcaucuuuacgucucccugccuaaugcccaaucuagcaugaaagcugaggaaaucacacccgggcgguaucgcaccgccauuugcggacucuacccugcucagaucaaggccagacagaugauuuccccggugaugagcguuaucggcuuucuggcgcuggccaaagauuggucugaccggaucgagcaguggcucuccgaacccuguaagcugcuuccugauacagcugccgugagccugcacgggggacccgcuaccaaccgcgacuaucucagacaacggcaggucgcccugggcaauauggagacgaaagagucuaaggccauuagacagcaugcugaagcggccgggugcuccaugaucgaggauauugaaagcccuucuuccaucuggguguucgcuggagcccccgaccgcagcccgccuacauguauguuuauugccggcaucgaugagcuuggcgcuuucuuuuccauccugcaagacaugcggaacaccauuauggccucuaaaacaguggggaccagcgaagagaagcucagaaagaaauccagcuucuaccagucuuaccugcgccggacccaguccaugggaauccagcuggaucaaagaauuaucguccucuuuaugguugcguggggcaaggaggcuguggacaauuuccaccugggggaugacauggaccccgaacuucgcacacuggcccagagccucauugauaucaaagugaaggagaucucuaaccaggaaccucugaaacuuuga

SEQ ID NO: 7073 - RNA, 1290 nt, Artificial Sequence
  derived and/or modified CDS sequence (opt5) from HTNV(HubeiHu02)__JQ665905.1__N
auggccaccauggaggaacugcagaaggagaucaacgcucacgaaggccaacucgugauugccagacagaaaguccgggacgcggagaagcaguacgaaaaagaucccgacgagcugaauaagcgcacacuuacggauagagaggggguugcugccagcauccaggccaaaauugacgaacugaagcggcaacucgcugaucgcaucgccaccggaaagaaccugggcaaagagcaggacccuacagggguggaaccgggagaucaucuuaaggagagauccaugcugucuuauggcaaugugcucgaccugaaccaccuggauauugacgagcccaccgggcagacagcugauuggcucagcaucgucaucuaccugaccuccuucgugguuccuauucuucugaaagcccucuauaugcugacaacccggggacgccagacgaccaaggacaauaaaggcacaagaauccgguuuaaggaugacucuagcuucgaagacgugaacggcauucgcaagcccaaacaucuuuacgucucccugccuaaugcgcaaucuagcaugaaggccgaggauaucacccccgggagauaucggacagcuauuugcggacucuacccugcccagaucaaagcucgccagaugauuuccccggugaugagcguuaucggcuuucuggcccuggcgaaggacuggucugauagaaucgaacaguggcucuccgagcccuguaaacugcuuccugacaccgccgcugugagccugcacgggggacccgccacgaaccgggauuaucuccgccaaagacaggucgcucugggcaauauggaaacaaaggagucuaaagccauucggcagcaugccgaguccgcugggugcagcaugaucgaagacauugagucuccuuccagcaucuggguguucgcgggagcccccgauagauguccgccuaccugccuuuuuauugcuggcaucgccgaacugggcgccuucuuuuccauccuccaagacaugcgcaacacaauuauggcuucuaagaccguggggaccagcgaggaaaagcugcggaaaaaguccagcuucuaccagucuuaccugagacgcacacaguccaugggaauccagcucgaucaacggauuaucguccuguuuaugguugccuggggcaaagaggcgguggacaauuuccaccuuggggaugacauggaccccgagcugagaacgcucgcucagagccugauugaugugaaggucaaagaaaucucuaaccaggagccucuuaagcuguga

SEQ ID NO: 7074 - RNA, 1290 nt, Artificial Sequence
  derived and/or modified CDS sequence (opt5) from HTNV(HV004)__JQ083395.1__N
auggccaccauggaggaacugcagaaggagaucaacgcucacgaaggccaacucgugauugccagacagaaaguccgggacgcggagaagcaguacgaaaaagaucccgacgagcugaauaagcgcgcucuuacagauagagaggggguugccgccagcauccaggcuaaaauugacgaacugaagcggcaacucgccgaucgcaucgcuacgggaaagaaccugggcaaagagcaggacccuaccgggguggaaccgggagaucaucuuaaggagagauccaugcugucuuauggcaaugugcucgaccugaaccaccuggauauugacgagcccacagggcagaccgccgauuggcucagcaucgucaucuaccugacauccuucgugguuccuauucuucugaaagcgcucuauaugcugaccacacggggacgccagaccacgaaggacaauaaaggcaccagaauccgguuuaaggaugacucuagcuucgaagacgugaacggcauucgcaagcccaaacaucuuuacgucucccugccuaaugcccaaucuagcaugaaggcugaggaaaucacacccgggagauaucggaccgccauuugcggacucuacccugcucagaucaaagcccgccagaugauuuccccggugaugagcguuaucggcuuucuggcgcuggccaaggauuggucugacagaaucgagcaguggcucuccgaacccuguaaacugcuuccugauacagcugccgugagccugcacgggggacccgcuaccaaccgggacuaucuccgccaaagacaggucgcccugggcaauauggagacgaaggagucuaaagccauucggcagcaugcugaauccgcggggugcagcaugaucgaggauauugaaucuccuuccagcaucuggguguucgccggagcucccgacagauguccgccuacaugccuuuuuauugccggcaucgccgagcugggcgcuuucuuuuccauccuccaagauaugcgcaacaccauuauggccucuaagacaguggggaccagcgaagagaagcugcggaaaaaguccagcuucuaccagucuuaccugagacgcacccaguccaugggaauccagcucgaccaacggauuaucguccuguuuaugguugcguggggcaaagaggcuguggauaauuuccaccuuggggacgauauggaccccgaacugagaacacucgcccagagccugauugacgugaaggucaaagagaucucuaaccaggaaccucuuaagcuguga

SEQ ID NO: 7075 - RNA, 1290 nt, Artificial Sequence
  derived and/or modified CDS sequence (opt5) from HTNV(Maaji-1)__AF321094.1__N
auggccaccauggaggaacugcagaaggagaucaacgcucacgaaggccaacucgugauugccagacagaaaguccgggacgcggagcgccaguacgaaaaggaucccgacgagcugaauaaaagaacacuuacggaucgggaggggguugcugccagcauccaggccaagauugacgaacugaaacgccaacucgcugauagaaucgccaccggaaagaaccugggcaaggagcaggacccuacagggguggaaccgggagaucaucuuaaagagcgguccaugcugucuuauggcaaugugcucgaccugaaccaccuggauauugacgagcccaccgggcagacagcugauuggcucagcaucgucaucuaccugaccuccuucgugguuccuauucuucugaaggcccucuauaugcugacaacccgcggaagacagacgaccaaagacaauaagggcacacggauccgcuuuaaagaugacucuagcuucgaagacgugaacggcauuagaaagcccaagcaucuuuacgucucccugccuaaugcgcaaucuagcaugaaagccgaggaaaucacccccgggcgguaucgcacagcugugugcggacucuacccugcccagauuaaggcuagacagaugaucuccccgguuaugagcgugauuggcuuuauggcccuggcgaaagauuggucugagcggaucgaacaguggcuguccgagcccuguaagcuccugccugacaccagcgccgucucucuucucgggggacccgcuacgaacaaagauuaucugcgccaaagacagguggcccugggcaauauggagacaaaggaauccaaagcuauccggcagcaagccgaggccagcgggugcucuaugauugaagacaucgaguccccuagcuccauuuggguguucgcuggagcgcccgauagauguccgccuaccugccuuuuuaucgccggcauggcugaacugggcgccuucuuuucuauucuccaggacaugcgcaacacaaucauggccagcaagaccgucgggaccuccgaggagaagcugcggaaaaagagcucuuucuaccaguccuaccugagacgcacacagagcaugggaauccaacucgaucagcggauuaucguucuguuuaugguggcuuggggcaaagaagccguggacaauuuccaccuuggggaugacauggaucccgagcugagaacgcucgcgcagucucugauugacgucaaggugaaagaaaucagcaaccaggagccucuuaagcuguga

SEQ ID NO: 7076 - RNA, 1290 nt, Artificial Sequence
  derived and/or modified CDS sequence (opt5) from HTNV(Maaji-2)__AF321095.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugugagcauccaggccaagauugacgaacugaaacgccaacucgccgauagaaucgcuaccggaaagaacuucggcaaggagcaggacccuacagggguggaaccgggagaucaucugaaagagcgguccaugcuuucuuauggcaauguccuggaccucaaccaccuggauauugacgagcccaccgggcagacagccgauuggcugagcaucgugguuuaccucaccuccuuuguggucccuauccugcuuaaggcucuguauaugcucacaacccgcggaagacagacgaccaaagacaauaagggcacacggauucgcuucaaagaugacucuagcuuugaagacgugaacggcaucagaaagcccaagcaucuguacguuucccuuccuaaugcccaaucuagcaugaaagcggaggaaauuacccccgggcgguaucgcacagccgugugcggacuguacccugcucagaucaaggccagacagaugauuuccccggucaugagcgugaucggcuuccucgcucuggccaaagauuggucugaccggauugagcaguggcuguccgaacccuguaagcuccugccugauaccgcggccgugagccuucucgggggacccgcuacgaaccgcgacuaucugagacaacggcaggucgcccugggcaauauggagacaaaagagucuaaggcuaucagacagcacgccgaagccgcugggugcuccaugaucgaggauauugaaagcccuucuuccaucuggguuuuugcgggagcccccgaccgcuguccgccuaccugccuuuucauugcuggcaucgccgagcugggcgccuuuuucagcauucuccaagauaugcggaacacaaucauggcuuccaaaaccguggggaccucugaagagaagcugagaaagaaaagcuccuuuuaccagagcuaccugcgccggacacagcucaugggaauccagcuggaccaaagaauuaucgugcuuuucauggucgccuggggcaaggaggcgguggauaauuuucaucugggggacgauauggaccccgaacuccgcacgcuggcucagucucuuauugacguuaaagugaaggagaucuccaaccaggaaccucugaaacucuga

SEQ ID NO: 7077 - RNA, 1290 nt, Artificial Sequence
  derived and/or modified CDS sequence (opt5) from HTNV(N8)__DQ658415.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugccagcauccaggccaagauugacgaacugaaacgccaacucgcugauagaaucgccaccggaaagaaccugggcaaggagcaggacccuacagggguggaaccgggagaucaucuuaaagagcgguccaugcugucuuauggcaaugugcucgaccugaaccaccuggauauugacgagcccaccgggcagacagcugauuggcucagcaucgucaucuaccugaccuccuucgugguuccuauucuucugaaggcccucuauaugcugacaacccgcggaagacagacgaccaaagacaauaagggcacacggauccgcuuuaaagaugacucuagcuucgaagacgugaacggcauuagaaagcccaagcaucuuuaccugucccucccuaaugcgcaaucuagcaugaaagccgaggaaaucacccccgggcgguaucgcacagcuauuugcggacuguacccugcccagaucaaggcuagacagaugauuuccccggucaugagcgugaucggcuuucuggcccucgcgaaagauuggucugaccggaucgagcaguggcuguccgaacccuguaaacuucugccugaugccgcugccguuagccuccacgggggacccgcuaccaaccgcgacuaucugagacaaagacagguggcccuuggcaauauggagacgaaggagucuaaggccauucggcagcaugcugaaacagcggggugcuccaugaucgaugacauugagagcccuucuuccaucugggucuucgccggagcucccgaucgcuguccgccuaccugccuguuuauugccggcaucgccgaacucggcgcuuucuuuagcauccugcaagacaugcggaacacaauuauggccuccaaaaccguggggaccucugaggaaaagcugagaaagaaaagcuccuucuaccagagcuaccuccgccggacacagucuaugggaauccagcuggaucaaagaauuaucgugcuuuuuauggucgcguggggcaaggaggcuguugacaauuuccaccugggggaugacauggaccccgagcuccgcacgcuggcccagucccuuauugaugugaaagugaaggaaaucagcaaccaggagccucugaaacucuga

SEQ ID NO: 7078 - RNA, 1290 nt, Artificial Sequence
  derived and/or modified CDS sequence (opt5) from HTNV(Q32)__AB027097.1__N
auggccaccauggaggaacugcagagagagaucaacgcucacgaaggccaacucgugauugcccggcugaagguccgcgacgcggagaaacccuacgaaaaggauccugacgagcuuaauaugagaacacugacggaucgggaggggguugcugccagcauccaggccaaaauugacgaacucaagcgccagcuggcugauagaaucgccaccggcaaaaaccuuggaaaggagcaggacccgacagggguggaacccggagaucaucugaaggagcgguccaugcucucuuauggcaaugugcuggaccugaaccaccucgauauugacgagccuaccgggcaaacagcugauuggcugagcaucgucaucuaccuuaccuccuucgugguucccauucugcucaaagcccuguauaugcuuacaacccgcggaagacagacgaccaaggacaauaaaggcacacggauccgcuuuaaggaugacucuagcuucgaagacgugaacggcauuagaaaaccuaagcaucuguacgucucccuccccaaugcgcagucuagcaugaaggccgaggaaaucaccccugggcgguaucgcacagcuauuugcggacuguacccggcccagaucaaagcuagacaaaugauuucccccgugaugagcguuaucggcuuucuggcccucgcgaaggauuggucugaccggaucgagcaguggcuguccgaaccuuguaaacuucugcccgauaccgccgcugugagccuccacgggggaccugccacgaaccgcgacuaucugagacagcggcaggucgcucuuggcaauauggagacaaaggagucuaaagccauuagacaacaugccgaauccgcugggugcagcaugguggaggauaucgaaucucccuccagcauuuggguguucgcgggagccccggaccgcuguccuccuaccugccuguuuaucgcuggcauugccgagcucggcgccuucuuuuccauccugcaggauaugcggaacacaaucauggcuucuaagaccgucgggaccagcgaagagaaacugagaaagaaguccagcuucuaccagucuuaccuccgccggacacaauccaugggcauucagcuggaccagagaaucauuguucuuuuuaugguggccuggggaaaagaggcgguggauaauuuccagcccggggacgauauggaccccgaacugcgcacgcucgcucaaagccugaucgacgucaaggugaaagagauuucuaaccaggaaccccuuaagcuguga

SEQ ID NO: 7079 - RNA, 1290 nt, Artificial Sequence
  derived and/or modified CDS sequence (opt5) from HTNV(SXHu2012B1)__KC844226.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgccagcauccaggcuaagauugacgaacugaaacgccaacucgccgauagaaucgcuacgggaaagaaccugggcaaggagcaggacccuaccgggguggaaccgggagaucaucuuaaagagcgguccaugcugucuuauggcaaugugcucgaccugaaccaccuggauauugacgagcccacagggcagaccgccgauuggcucagcaucgucaucuaccugacauccuucgugguuccuauucuucugaaggcgcucuauaugcugaccacacgcggaagacagaccacgaaagacaauaagggcacccggauccgcuuuaaagaugacucuagcuucgaagacgugaacggcauuagaaagcccaagcaucuuuacgucucccugccuaaugcccaaucuagcaugaaagcugaggaaaucacacccgggcgguaucgcaccgccauuugcggacucuacccugcucagaucaaggccagacagaugauuuccccggugaugagcguuaucggcuuucuggcgcuggccaaagauuggucugaccggaucgagcaguggcucuccgaacccuguaagcugcuuccugauacagcugccgugagccugcacgggggacccgcuaccaaccgcgacuaucucagacaacggcaggucgcccugggcaauauggagacgaaagagucuaaggccauuagacagcaugcugaauccgcggggugcagcaugguggaggauaucgaaucuccuuccagcauuuggguguucgccggagcucccgaccgcuguccgccuacaugccuuuuuaucgccggcauugccgagcugggcgcuuucuuuuccauccuccaagauaugcggaacaccaucauggccucuaaaacagucgggaccagcgaagagaagcugagaaagaaauccagcuucuaccagucuuaccugcgccggacccaguccaugggcauucagcucgaccaaagaaucauuguucuguuuaugguggcguggggaaaggaggcuguggauaauuuccaccuuggggacgauauggaccccgaacugcgcacacucgcccagagccugaucgacgucaaagugaaggagauuucuaaccaggaaccucuuaaacuguga

SEQ ID NO: 7080 - RNA, 1290 nt, Artificial Sequence
  derived and/or modified CDS sequence (opt5) from HTNV(TJJ16)__AY839871.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggcuggccgccagcauccaggcuaagauugacgaacucaaacgccaacuggccgauagaaucgcuacgggaaagaaccuuggcaaggagcgggacccuaccgggguugaaccgggagaucaucugaaagagcgcuccaugcucucuuauggcaaugugcuggaccugaaccaccucgauauugacgagcccacagggcagaccgccgauuggcugagcaucgugaucuaccuuacauccuucgucgugccuauucugcucaaggcgcuguauaugcuuaccacaagaggacggcagaccacgaaagacaauaagggcacccgcaucagauuuaaagaugacucuagcuucgaagacguuaacggcauucggaagcccaagcaucuguacgugucccucccuaaugcccagucuagcaugaaagcugaggaaaucacacccgggcgcuauagaaccgccauuugcggacuguacccugcucaaaucaaggcccggcagaugauuuccccggucaugagcgugaucggcuuucuggcgcucgccaaagauuggucugaccgcaucgagcaguggcuguccgaacccuguaaacuucugccugauacagcugccguuagccuccacgggggacccgcuaccaacagagacuaucugcggcagagacaaguggcccuuggcaauauggagacgaaggagucuaaggccauucgccagcaugcugaauccgcggggugcagcauggucgaggauaucgaaucuccuuccagcauuuggguguucgccggagcucccgaccgguguccgccuacaugccuguacaucgccggcauugccgagcucggcgccuuuuucuccauccugcaggauaugagaaacaccaucauggcuucuaaaacaguggggaccagcgaagagaagcugcgcaagaaauccagcuuuuaccaaucuuaucuccggagaacccaguccaugggcauucagcuggaccagcgcaucauuguccuuuucaugguugcguggggaaaggaggcuguggauaauuuucaccugggggacgauauggaccccgaacuccggacacuggcccaaagccuuaucgacgugaaagucaaggagauuucuaaccaggaaccucugaaacucuga

SEQ ID NO: 7081 - RNA, 1290 nt, Artificial Sequence
  derived and/or modified CDS sequence (opt5) from HTNV(WCL)__KM355414.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacuggagcgccaacucgcugauagaaucgccacgggaaagaaccugggcaaggaacaggacccuaccgggguggagccgggagaucaucuuaaggagcgguccaugcugucuuauggcaauguccucgaccugaaccaccuggauauugacgaacccacagggcagaccgcugauuggcucagcaucgugguuuaccugacauccuucguggucccuauccuucugaaagcccucuauaugcugaccacacgcggaagacagaccacgaaggacaauaaaggcacccggauucgcuuuaaggaugacucuagcuucgaggacgugaacggcaucagaaaacccaagcaucuuuacguuucccugccuaaugcgcaaucuagcaugaaggccgaagagauuacacccgggcgguaucgcaccgcuaucugcggacucuacccugcccagauuaaagcuagacagaugaucuccccggugaugagcgucauuggcuuucuggcccuggcgaaggauuggucugaccggaucgaacaguggcucuccgagcccuguaaacugcuuccugauacagccgcugugagccugcucgggggacccgccaccaaccgcgacuaucugagacaaagacagguggcucuuggcaauauggagacgaaggaaucuaaagccauccggcagcacgccgaggcugcggggugcuccaugauugaagauaucgagagcccuucuuccauuugggucuucgccggagcucccgaccgcuguccgccuacaugccuguuuaucgccggcauugccgaacucggcgcuuucuuuagcauccugcaagauaugcggaacaccaucauggccuccaagacaguugggaccucugaggagaaacugagaaagaaaagcuccuucuaccagagcuaccuccgccggacccagucuaugggcauucagcuggaccaaagaaucauugugcuuuuuaugguggcguggggaaaagaagcugucgauaauuuccaucugggggacgauauggaccccgagcuccgcacacuggcccagucccuuaucgacgugaagguuaaagaaauuagcaaccaggagccucugaagcucuga

SEQ ID NO: 7082 - RNA, 1290 nt, Artificial Sequence
  derived and/or modified CDS sequence (opt5) from HTNV(YN509)__GU329991.1__N
auggccaccauggaggaacugcagaaggagaucaacgcucacgaaggccaacucauuaucgccaaacagaaggugaaagacgcggagaagcaguacgaaaaagaucccgacgagcugaauaagagagcucuuacagaucgggagggggucgccgccagcauucaggcuaagaucgacgaacugaaacgccaacucgccgauagaauugcuacgggaaagaaccugggccaggaccgggauccuaccgggguugagccgggagaccaucuuaaagaacgcuccaugcugucuuauggcaauauccucgaucugaaccaccuggacaucgaugagcccacagggcagaccgccgacuggcucagcauuaucguguaccugacauccuucguggucccuauucuucugaaggcgcucuauaugcugaccacaagaggacggcagaccgccaaagauaauaagggcacgcgcaucagauuuaaggacgacucuagcuucgaggaugugaacggcauucggaaacccaagcaucuuuacguuuccaugccuaaugcucaaucuagcaugaaagccgaagagaucacccccgggcgcuauagaacagcugugugcggacuguacccugcccagauuaaggcgcggcagauggucuccccggugaugagcguuaucggcuuuauggcccucgcuaaagacuggaccgaucgcaucgaaaacuggcugggggagcccuguaagcugcucccugacacaucuuccgugauucugcuuggaggccccgccaccaauagagauuauauccggcagcgccaagucgcucuggggaacauggaaacgaaagaggccaaggccgugagacagcacgcugagagcgcgggaugcucuaugauugacaauaucgauuccccuagcucuauuuggguguucgccggcgcucccgaccgguguccgccuacaugccucuuugucgccggccuggccgaacuuggggcuuucuuuuccauccugcaggauaugagaaacaccaucauggccagcaagacaguuggaaccuccgaggagaaaaugcgcaagaaaucuagcuucuaccaauccuaccuccggagaacccagagcaugggcauucagcuggaccagcgcaucauugugcuguuuaugguggcgugggggaaggaagcugucgauaauuuccaucucggagacgacauggaucccgaacugcggaaccuugcccaaucucugaucgaccagaaagugaaggagauuuccaaucaggagccucucaagcuguga

SEQ ID NO: 7083 - RNA, 1290 nt, Artificial Sequence
  derived and/or modified CDS sequence (opt5) from HTNV(YU62)__AY748309.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggcuggccgccagcauccaggcuaagauugacgaacucaaacgccaacuggccgauagaaucgcuacgggaaagaaccuuggcaaggagcaggacccuaccgggguugaaccgggagaucaucugaaagagcgguccaugcucucuuauggcaaugugcuggaccugaaccaccucgauauugacgagcccacagggcagaccgccgauuggcugagcaucgugaucuaccuuacauccuucgucgugccuauucugcucaaggcgcuguauaugcuuaccacacgcggaagacagaccacgaaagacaauaagggcacccggauccgcuuuaaagaugacucuagcuucgaagacguuaacggcauuagaaagcccaagcaucuguacgugucccucccuaaugcccaaucuagcaugaaagcugaggaaaucacacccgggcgguaucgcaccgccauuugcggacuguacccugcucagaucaaggccagacagaugauuuccccggucaugagcgugaucggcuuucuggcgcucgccaaagauuggucugaccggaucgagcaguggcuguccgaacccuguaaacuucugccugauacagcugccguuagccuccacgggggacccgcuaccaaccgcgacuaucugagacaaagacagguggcccuuggcaauauggagacgaaggagucuaaggccauucggcagcaugcugaauccgcggggugcagcauggucgaggauaucgaaucuccuuccagcauuuggguguucgccggagcucccgaccgcuguccgccuacaugccuguuuaucgccggcauugccgagcucggcgcuuucuuuuccauccugcaagauaugcggaacaccaucauggccucuaaaacaguggggaccagcgaagagaagcugagaaagaaauccagcuucuaccagucuuaccuccgccggacccaguccaugggcauucagcuggaccaaagaaucauuguccuuuuuaugguugcguggggaaaggaggcuguggauaauuuccaccugggggacgauauggaccccgaacuccgcacacuggcccagagccuuaucgacgugaaagucaaggagauuucuaaccaggaaccucugaaacucuga

SEQ ID NO: 7084 - RNA, 1290 nt, Artificial Sequence
  derived and/or modified CDS sequence (opt5) from HTNV(ZLS6-11)__FJ753396.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgccagcauccaggcuaagauugacgaacugaaacgccaacucgccgauagaaucgcuacgggaaagaaccugggcaaggagcaggacccuaccgggguggaaccgggagaucaucuuaaagagcgguccaugcugucuuauggcaaugugcucgaccugaaccaccuggauauugacgagcccacagggcagaccgccgauuggcucagcaucgucaucuaccugacauccuucgugguuccuauucuucugaaggcgcucuauaugcugaccacacgcggaagacagaccacgaaagacaauaagggcacccggauccgcuuuaaagaugacucuagcuucgaagacauuaacggcaucagaaagcccaagcaucuuuacgugucccugccuaaugcccaaucuagcaugaaagcugaggaaauuacacccgggcgguaucgcaccgccaucugcggacucuacccugcucagauuaaggccagacagaugaucuccccggucaugagcgugaucggcuuucuggcgcuggccaaagauuggucugaccggauugagcaguggcucuccgaacccuguaagcugcuuccugauacagcugccguuagccugcacgggggacccgcuaccaaccgcgacuaucucagacaaagacagguggcccugggcaauauggagacgaaagagucuaaggccauccggcagcaugcugaaacagcggggugcuccaugauugaggauaucgaaagcccuucuuccauuugggucuucgccggagcucccgaccgcuguccgccuaccugccuuuuuaucgccggcaucgccgagcugggcgcuuucuuuagcauucuccaagauaugcggaacacaaucauggccuccaaaaccguggggaccucugaagagaagcugagaaagaaaagcuccuucuaccagagcuaccugcgccggacacagucuaugggcauucagcucgaccaaagaaucauugugcuguuuauggucgcguggggaaaggaggcuguugauaauuuccaccuuggggacgauauggaccccgaacugcgcacgcucgcccagucccugaucgacgugaaagugaaggagaucagcaaccaggaaccucuuaaacuguga

SEQ ID NO: 7085 - RNA, 1290 nt, Artificial Sequence
  derived and/or modified CDS sequence (opt5) from HTNV__AB027523.1__N
auggccaccauggaggaacugcagaaggagaucaacgcucacgaaggccaacucauuaucgccaaacagaaggugaaagacgcggagaagcaguacgaaaaagaucccgacgagcugaauaagagagcucuuacagaucgggagggggucagcgccuccauucaggccaagaucgacgaacugaaacgccaacucgcugauagaauugccacgggaaagaaccugggccaggaccgggauccuaccgggguugagccgggagaccaucuuaaagaacgcucuaugcugagcuauggcaauauccucgaucugaaccaccuggacaucgaugagcccacagggcagaccgcugacuggcucuccauuaucguguaccugacaucuuucguggucccuauucuucugaaggcccucuauaugcugaccacaagaggacggcagaccgcgaaagauaauaagggcacgcgcaucagauuuaaggacgacagcuccuucgaggaugugaacggcauucggaaacccaagcaucuuuacguuucuaugccuaaugcccaaagcuccaugaaagcugaagagaucacccccgggggauaucgcacagccgugugcggccuguuuccugcucagauuaaggccagacagauggucagcccggugaugucuguuaucggguucauggcgcucgccaaagacuggaccgaucggaucgaauccuggcugggagagcccuguaagcugcucccugacacaagcgcugugucucugcuuggcgggcccgccaccaaccgcgauuacauuagacagcggcaagucgcucugggaaauauggaaacgaaagaggccaaggccgugcgccagcacgcugaguccgcgggcugcagcaugaucgacaacauugauucuccuuccagcaucuggguguuugccggcgcucccgacagauguccgccuacaugccucuucauugccgggaucgccgaacugggagccuuuuucuccauccuucaggauaugcggaauaccauuauggcuucuaagacagucggcaccagcgaggagaaaaugagaaagaaauccagcuuuuaucaaucuuaccugcgccggacccaguccauggggauccagcucgaccagagaauuaucguucuguucaugguggcguggggaaaggaagcugccgauaacuuucaacauggcgacgacauggaucccgaacugcgcacacucgcccagagccugauugaccagaaagugaaggagaucucuaaucaggagccucuuaagcuguga

SEQ ID NO: 7086 - RNA, 1293 nt, Artificial Sequence
  derived and/or modified CDS sequence (opt5) from HTNV__D25530.1__N
augauggccaccauggaggaacugcagagagagaucaacgcucacgaaggccaacucgugauugcccggcagaagguccgcgacgcggagaaacaguacgaaaaggaucccgacgagcugaauaaaagagcucuuacaaaccgggaggggguugccgugagcauccaggccaagauugaugaacugaaaaugcaacucgcugaccgcaucgccacgggaaagaaucugggcaaggagcaggauccuaccgggguggaaccgggagaccaucuuaaagagagauccaugcugucuuauggcaacguccucgaucugaaucaccuggacauugaugagcccacagggcagaccgcugacuggcucagcaucaucguguaccugacauccuucguugugccuauucuucugaaggcccucuauaugcugaccacacggggacgccagaccacgaaagauaacaagggcaccagaauccgguuuaaagacgauucuagcuucgaagacgucaauggcauucgcaagcccaagcaucuuuacgugucccugccuaacgcgcaaucuagcaugaaagccgaggaaaucacacccgggagauaucggaccgcuguuugcggacucuacccugcccagauuaaggcucgccagaugaucuccccggugaugagcgucauuggcuuucuggcccuggcgaaagacuggucugauagaaucgagcaguggcucaucgaacccuguaagcugcuuccugacacagccgcugugucccugcucgggggacccgccaccaaucgggauuaucugcgccaaagacagguggcucuuggcaacauggagacgaaagagagcaaggccauucggcagcacgccgaagcugcggggugcucuaugaucgaggacauugaauccccuagcucuaucugggucuucgccggagcucccgauagauguccgccuacaugccuguuuauugccggcaucgccgagcucggcgcuuucuuuuccauccugcaagacaugcgcaauaccauuauggccagcaaaacaguugggaccuccgaagagaagcugcggaagaaaucuagcuucuaccaguccuaccucagacgcacccagagcaugggaauccagcuggaucaacggauuaucgugcuuuuuaugguggcguggggcaaggaggcugucgacaacuuccaucugggggaugacauggaucccgaacucagaacacuggcccagucucuuauugacgugaaaguuaaggagaucuccaaucaggaaccucugaaacucuga

SEQ ID NO: 7087 - RNA, 1290 nt, Artificial Sequence
  derived and/or modified CDS sequence (opt5) from HTNV__M14626.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugugagcauccaggccaagauugacgaacugaaacgccaacucgccgauagaaucgcuaccggaaagaaccugggcaaggagcaggacccuacagggguggaaccgggagaucaucuuaaagagcgguccaugcugucuuauggcaauguccucgaccugaaccaccuggauauugacgagcccaccgggcagacagccgauuggcucagcaucaucguguaccugaccuccuucguugugccuauucuucugaaggcucucuauaugcugacaacccgcggaagacagacgaccaaagacaauaagggcacacggauccgcuuuaaagaugacucuagcuucgaagacgucaacggcauuagaaagcccaagcaucuuuacgugucccugccuaaugcccaaucuagcaugaaagcggaggaaaucacccccgggcgguaucgcacagccguuugcggacucuacccugcucagauuaaggccagacagaugaucuccccggugaugagcgucauuggcuuucuggcucuggccaaagauuggucugaccggaucgagcaguggcucaucgaacccuguaagcugcuuccugauaccgcggccgugucccugcucgggggacccgcuacgaaccgcgacuaucugagacaaagacagguggcccuuggcaauauggagacaaaagagagcaaggcuauucggcagcacgccgaagccgcugggugcucuaugaucgaggauauugaauccccuagcucuaucugggucuucgcgggagcccccgaccgcuguccgccuaccugccuguuuauugcuggcaucgccgagcucggcgccuucuuuuccauccugcaagauaugcggaacacaauuauggcuagcaaaaccguugggaccuccgaagagaagcugagaaagaaaucuagcuucuaccaguccuaccuccgccggacacagagcaugggaauccagcugggccaaagaauuaucgugcuuuuuaugguggccugggggaaggaggcggucgacaauuuccaucugggagaugacauggaucccgaacuccgcacgcuggcucagucucuuauugacgugaaaguuaaggagaucuccaaccaggaaccucugaaacucuga

SEQ ID NO: 7088 - RNA, 1290 nt, Artificial Sequence
  derived and/or modified CDS sequence (opt5) from HTNV__X95077.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugugagcauccaggccaagauugacgaacugaaacgccaacucgccgauagaaucgcuaccggaaagaaccugggcaaggagcaggacccuacagggguggaaccgggagaucaucuuaaagagcgguccaugcugucuuauggcaauguccucgaccugaaccaccuggauauugacgagcccaccgggcagacagccgauuggcucagcaucgugguuuaccugaccuccuucguggucccuacacuucugaaggcucucuauaugcugaccacgcgcggaagacagaccacaaaagacaauaagggcacccggauccgcuuuaaagaugacucuagcuucgaagacgugaacggcauuagaaagcccaagcaucuuuacguuucccugccuaaugcccaaucuagcaugaaagcggaggaaaucacacccgggcgguaucgcaccgccgugugcggacucuacccugcucagauuaaggccagacagaugaucuccccggucaugagcgugauuggcuuucuggcucuggccaaagauuggucugaccggaucgagcaguggcucuccgaacccuguaagcugcuuccugauacgacagcggugagccugcucgggggacccgccaccaaccgcgacuaucugagacaacggcaggucgcucuuggcaauauggagacaaaagagucuaaggccauuagacagcacgcugaagccgccgggugcuccaugaucgaggauaucgaaagcccuucuuccauuuggguuuucgcuggagcgcccgaccgcuguccgccuaccugccuguuuaucgccggcauugcugagcucggcgccuucuuuagcauccugcaagauaugcggaacaccauuauggccuccaaaacaguggggacgucugaagagaagcugagaaagaaaagcuccuucuaccagagcuaccuccgccggacccagucuaugggaauccagcuggaccaaagaaucauugugcuuuuuauggucgcuuggggcaaggaggccguggauaauuuccaucugggggacgauauggaccccgaacuccgcacacuggcgcagucccuuaucgacguuaaagugaaggagauuagcaaccaggaaccucugaaacucuga

SEQ ID NO: 7089 - RNA, 1290 nt, Artificial Sequence
  derived and/or modified CDS sequence (opt5) from HTNV(CGAa1011)__EF990913.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugccagcauccaggccaagauugacgaacugaaacgccaacucgcugauagaaucgccaccggaaagaaccugggcaaggagcaggacccuacagggguggaaccgggagaucaucuuaaagagcgguccaugcugucuuauggcaaugugcucgaccugaaccaccuggauauugacgagcccaccgggcagacagcugauuggcucagcaucgucaucuaccugaccuccuucgugguuccuauucuucugaaggcccucuauaugcugacaacccgcggaagacagacgaccaaagacaauaagggcacacggauccgcuuuaaagaugacucuagcuucgaagacgugaacggcauuagaaagcccaagcaucuugaugucucccugccuaaugcgcaaucuagcaugaaagccgaggaaaucacccccgggcgguaccgcacagcuauuugcggacucuauccugcccagaucaaggcuagacagaugauuuccccggugaugagcguuaucggcuuucuggcccuggcgaaagacuggucugaucggaucgagcaguggcucggggaacccuguaagcugcuuccugacaccgccgcugugucccugcucggaggccccgccacgaaccgcgauuaccugagacaacggcaggucgcucuugggaauauggagacaaaagagagcaaggccauuagacagcacgccgaaaccgcuggaugcucuaugaucgaggacauugaauccccuagcucuaucuggguguucgcgggcgcccccgaucgcuguccgccuacaugccuguuuauugcuggcaucgccgagcucggggccuucuuuuccgugcugcaagacaugcggaacaccaucauggcuagcaaaaccgucggaacauccgaagagaagcugagaaagaaaucuagcuucuaucaguccuaccucggccgcacgcagagcauggggauucagcuggaucaacggaucauuguucuuuuuaugguggccuggggaaaggaggcgguggacaauuuccaucugggcgaugacgucgaccccgaacucagaacccuggcucagucucuuaucgaugugaaaguuaaggagauuuccgaccaggaaccucugaaacucuga

SEQ ID NO: 7090 - RNA, 1290 nt, Artificial Sequence
  derived and/or modified CDS sequence (opt5) from HTNV(CGAa1015)__EF990912.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugccagcauccaggccaagauugacgaacugaaacgccaacucgcugauagaaucgccaccggaaagaaccugggcaaggagcaggacccuacagggguggaaccgggagaucaucuuaaagagcgguccaugcugucuuauggcaaugugcucgaccugaaccaccuggauauugacgagcccaccgggcagacagcugauuggcucagcaucgucaucuaccugaccuccuucgugguuccuauucuucugaaggcccucuauaugcugacaacccgcggaagacagacgaccaaagacaauaagggcacacggauccgcuuuaaagaugacucuagcuucgaagacgugaacggcauuagaaagcccaagcaucuugaugucucccugccuaaugcgcaaucuagcaugaaagccgaggaaaucacccccgggcgguaccgcacagcuauuugcggacucuauccugcccagaucaaggcuagacagaugauuuccccggugaugagcguuaucggcuaccuggcccuggcgaaagacuggucugaucggaucgagcaguggcucggggaacccuguaagcugcuuccugacaccgccgcugugucccugcucggaggccccgccacgaaccgcgauuaucugagacaacggcaggucgcucuugggaauauggagacaaaagagagcaaggccauuagacagcacgccgaaaccgcuggaugcucuaugaucgaggacauugaauccccuagcucuaucuggguguuugcgggcgcccccgaucgcuguccgccuacaugccuguucauugcuggcaucgccgagcucggggccuuuaucuccgugcugcaagacaugcggaacaccauuauggcuagcaaaaccgucggaacauccgaagagaagcugagaaagaaaucuagcuucuaccaguccuaccucggccgcacgcagagcauggggauccagcuggaucaacggauuaucguucuuuuuaugguggccuggggaaaggaggcgguggacaauuuccaucugggcgaugacgucgaccccgaacucagaacccuggcucagucucuuauugaugugaaaguuaaggagaucuccgaccaggaaccucugaaacucuga

SEQ ID NO: 7091 - RNA, 1290 nt, Artificial Sequence
  derived and/or modified CDS sequence (opt5) from HTNV(CGAa2)__EU092219.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugccagcauccaggccaagauugacgaacugaaacgccaacucgcugauagaaucgccaccggaaagaaccugggcaaggagcaggacccuacagggguggaaccgggagaucaucuuaaagagcgguccaugcugucuuauggcaaugugcucgaccugaaccaccuggauauugacgagcccaccgggcagacagcugauuggcucagcaucgucaucuaccugaccuccuucgugguuccuauucuucugaaggcccucuauaugcugacaacccgcggaagacagacgaccaaagacaauaagggcacacggauccgcuuuaaagaugacucuagcuucgaagacgugaacggcauuagaaagcccaagcaucuuuacgucucccugccuaaugcgcaaucuagcaugaaagccaaggagaucacccccgggcgguaucgcacagcuauuugcggacucuacccugcccagaucaaagcuagacagaugauuuccccggugaugagcguuaucggcuuucuggcccuggcgaaggauuggucugaccggaucgaacaguggcucuccgagcccuguaaacugcuuccugauaccgccgcugugagccugcacgggggacccgccacgaaccgcgacuaucucagacaacggcaggucgcucugggcaauauggaaccuaaggagucuaaagccauuagacagcaugccgaguccgcugggugcagcaugguggaagauaucgagucucccuccagcauuuggguguucgcgggagccccggaccgcuguccucccacaugccuuuuuaucgcuggcauugccgaacugggcgccuucuuuuccauccuccaagauaugcggaacaccaucauggcuucuaagacagucgggaccagcgaggaaaagcugcgcaaaaaguccagcuucuaccagucuuaccugagacggacccaguccaugggcauucagcucgaccaaagaaucauuguucuguuuaugguggccuggggaaaagaggcgguggauaauuuccaccuuggggacgauauggacccugagcugcgcacacucgcucagagccugaucgacgucaaggugaaagaaauuucuaaccaggagccccuuaagcuguga

SEQ ID NO: 7092 - RNA, 1290 nt, Artificial Sequence
  derived and/or modified CDS sequence (opt5) from HTNV(CGAa31MP7)__EF990911.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugccagcauccaggccaagauugacgaacugaaacgccaacucgcugauagaaucgccaccggaaagaaccugggcaaggagcaggacccuacagggguggaaccgggagaucaucuuaaagagcgguccaugcugucuuauggcaaugugcucgaccugaaccaccuggauauugacgagcccaccgggcagacagcugauuggcucagcaucgucaucuaccugaccuccuucgugguuccuauucuucugaaggcccucuauaugcugacaacccgcggaagacagacgaccaaagacaauaagggcacacggauccgcuuuaaagaugacucuagcuucgaagacgugaacggcauuagaaagcccaagcaucuuuacgucucccugccuaaugcgcaaucuagcaugaaagccgaggaaaucacccccgggcgguaucgcacagcuauuugcggacucuacccugcccagaucaaggcuagacagaugauuuccccggugaugagcguuaucggcuuucuggcccuggcgaaagauuggucugaccggaucgagcaguggcucuccgaacccuguaagcugcuuccugauaccgccgcugugagccugcacgggggacccgccacgaaccgcgacuaucucagacaacggcaggucgcucugggcaauauggagacaaaagagucuaaggccauuagacagcaugccgaauccgcugggugcagcaugguggaggauaucgaaucuccuuccagcauuuggguguucgcgggagcccccgaccgcuguccgccuaccugccuuuuuaucgcuggcauugccgagcugggcgccuucuuuuccauccuccaagauaugcggaacacaaucauggcuucuaaaaccgucgggaccagcgaagagaagcugagaaagaaauccagcuucuaccagucuuaccugcgccggacacaguccaugggcauucagcucgaccaaagaaucauuguucuguuuaugguggccuggggaaaggaggcgguggauaauuuccaccuuggggacgauauggaccccgaacugcgcacgcucgcucagagccugaucgacgucaaagugaaggagauuucuaaccaggaaccucuuaaacuguga

SEQ ID NO: 7093 - RNA, 1290 nt, Artificial Sequence
  derived and/or modified CDS sequence (opt5) from HTNV(CGAa31P9)__EF990910.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugccagcauccaggccaagauugacgaacugaaacgccaacucgcugauagaaucgccaccggaaagaaccugggcaaggagcaggacccuacagggguggaaccgggagaucaucuuaaagagcgguccaugcugucuuauggcaaugugcucgaccugaaccaccuggauauugacgagcccaccgggcagacagcugauuggcucagcaucgucaucuaccugaccuccuucgugguuccuauucuucugaaggcccucuauaugcugacaacccgcggaagacagacgaccaaagacaauaagggcacacggauccgcuuuaaagaugacucuagcuucgaagacgugaacggcauuagaaagcccaagcaucuuuacgucucccugccuaaugcgcaaucuagcaugaaagccgaggaaaucacccccgggcgguaucgcacagcuauuugcggacucuacccugcccagaucaaggcuagacagaugauuuccccggugaugagcguuaucggcuuucuggcccuggcgaaagauuggucugaccggaucgagcaguggcucuccgaacccuguaagcugcuuccugauaccgccgcugugagccugcacgggggacccgccacgaaccgcgacuaucucagacaacggcaggucgcucugggcaauauggagacaaaagagucuaaggccauuagacagcaugccgaauccgcugggugcagcaugguggaggauaucgaaucuccuuccagcauuuggguguucgcgggagcccccgaccgcuguccgccuaccugccuuuuuaucgcugagauugccgaacugggcgccuucuuuuccauccuccaagauaugcggaacacaaucauggcuucuaaaaccgucggcaccagcgaggagaagcugagaaagaaauccagcuucuaccagucuuaccugcgccggacacaguccauggggauucagcucgaccaaagaaucauuguucuguuuaugguggccuggggaaaggaagcgguggauaauuuccaccuuggcgacgauauggaccccgagcugcgcacgcucgcucagagccugaucgacgucaaagugaaggaaauuucuaaccaggagccucuuaaacuguga

SEQ ID NO: 7094 - RNA, 1290 nt, Artificial Sequence
  derived and/or modified CDS sequence (opt5) from HTNV(CGAa4MP9)__EF990915.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugccagcauccaggccaagauugacgaacugaaacgccaacucgcugauagaaucgccaccggaaagaaccugggcaaggagcaggacccuacagggguggaaccgggagaucaucuuaaagagcgguccaugcugucuuauggcaaugugcucgaccugaaccaccuggauauugacgagcccaccgggcagacagcugauuggcucagcaucgucaucuaccugaccuccuucgugguuccuauucuucugaaggcccucuauaugcugacaacccgcggaagacagacgaccaaagacaauaagggcacacggauccgcuuuaaagaugacucuagcuucgaagacgugaacggcauuagaaagcccaagcaucuuuacgucucccugccuaaugcgcaaucuagcaugaaagccgaggaaaucacccccgggcgguaucgcacagcuauuugcggacucuacccugcccagaucaaggcuagacagaugauuuccccggugaugagcguuaucggcuuucuggcccuggcgaaagauuggucugaccggaucgagcaguggcucggggaacccuguaagcugcuuccugauaccgccgcugugucccugcucggaggccccgccacgaaccgcgacuaucugagacaacggcaggucgcucuugggaauauggagacaaaagagagcaaggccauuagacagcacgccgaaaccgcuggaugcucuaugaucgaggauauugaauccccuagcucuaucuggguguucgcgggcgcccccgaccgcuguccgccuacaugccuguuuauugcuggcaucgccgagcucggggccuucuuuuccgugcugcaagauaugcggaacaccaucauggcuagcaaaaccgucggaacauccgaagagaagcugagaaagaaaucuagcuucuaccaguccuaccuccgccggacgcagagcaugggcauucagcuggaccaaagaaucauuguucuuuuuaugguggccugggggaaggaggcgguggauaauuuccaucugggagacgauauggaccccgaacuccgcacccuggcucagucucuuaucgacgucaaagugaaggagauuuccaaccaggaaccucugaaacucuga

SEQ ID NO: 7095 - RNA, 1290 nt, Artificial Sequence
  derived and/or modified CDS sequence (opt5) from HTNV(CGAa75)__EU092220.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugccagcauccaggccaagauugacgaacugaaacgccaacucgcugauagaaucgccaccggaaagaaccugggcaaggagcaggacccuacagggguggaaccgggagaucaucuuaaagagcgguccaugcugucuuauggcaaugugcucgaccugaaccaccuggauauugacgagcccaccgggcagacagcugauuggcucagcaucgucaucuaccugaccuccucugugguuccuauucuucugaaggcccucuauaugcugacaacccgcggaagacagacgaccaaagacaauaagggcacacggauccgcuucaaagaugacagcuccuuugaagacgugaacggcauuagaaagcccaagcaucuuuacgucucucugccuaaugcgcaaagcuccaugaaagccgaggaaaucacccccgggcgguaucgcacagcuauuugcggacucuacccugcccagaucaaggcuagacagaugauuagcccggugaugaacguuaucggcuuccuggcccuggcgaaagauuggucugaccggaucgagcaguggcucuccgaacccuguaagcugcuuccugauaccgccgcugugagccugcacgggggacccgccacgaaucgcgacuaucucagacaacggcaggucgcucugggcaacauggagacaaaagagucuaaggccauuagacagcaugccgaauccgcugggugcagcaugguggaggauaucgaaucuccuuccagcauuuggguguuugcgggagcccccgaccgcuguccgccuaccugccuuuucaucgcuggcauugccgagcugggcgccuuuuucuccauccuccaagauaugcggaauacaaucauggcuucuaaaaccgucgggaccagcgaagagaagcugagaaagaaauccagcuuuuaccagucuuaccugcgccggacacaguccaugggcauucagcucgaccaaagaaucauuguucuguucaugguggccuggggaaaggaggcgguggauaacuuucaccuuggggacgauauggaccccgaacugcgcacgcucgcucagagccugaucgacgucaaagugaaggagauuucuaaucaggaaccucuuaaacuguga

SEQ ID NO: 7096 - RNA, 1290 nt, Artificial Sequence
  derived and/or modified CDS sequence (opt5) from HTNV(CGHu1)__EU092218.1__N
auggccaccauggaggaacugcagagagagaucaacgcucacgaaggccaacucgugauugcccggcagaagguccgcgacgcggagaaacaguacgaaaaggauagcgacgagcugaauaaaagaacacuuacggaucgggaggggguugcuguguccauccaggccaagauugacgaacugaaacgccaacucgccgauagaaucgcuaccggaaagaaccugggcaaggagcaggaccccacagggguggaaccuggagaucaucuuaaagagcggucuaugcugagcuauggcaauguccucgaccugaaccaccuggauauugacgagccgaccgggcagacagccgauuggcucuccaucgugguuuaccugaccucucuugugguccccauccugcucaaggcucuguauaugcuuacaaccaaaggacgccagacgaccaaggacaauaaaggcacacggauuagauucaaggaugacagcuccuuugaagacgugaacggcauccgcaagccuaaacaucuguacguuucucuccugaaugcccaaagcuccaugaaggcggaggaaauuacccccgggagauaucggacagccaucugcggaccuuaccccgcucagauuaaagcccgccagaugaucagcccugugaugucugucauuggcuuccuggcucucgccaaggauugguccgacagaaucgagcaguggcugagcgaaccguguaaacuucugcccgauaccgcggccgugucucuccugggaggaccugcuacgaaccgggacuaucuucgccaaagacagguggcccugggcaauauggagacaaaggaguccaaagcuauccggcagcacgccgaagccgcugggugcagcaugauugaggauaucgaaucucccuccagcauuugggucuccgcgggagccccugacagaugucccccgaccugccucuuuaucgcuggcauugccgagcugggcgccuucuuuucuauccugcaagauaugcgcaacacaaucauggcuagcaagaccguugggaccuccgaagagaagcuccggaaaaagagcucuuucuaccaguccuaccugagacgcacacagagcauggggauucagcuugaccaacggaucauugugcuguuuaugguggccuggggcaaagaggcggucgauaauuuccaucucggggacgauauggacccugaacugagaacgcuugcucagucucugaucgacgugaagguuaaagagauuagcaaccaggaaccccucaagcuguga

SEQ ID NO: 7097 - RNA, 1290 nt, Artificial Sequence
  derived and/or modified CDS sequence (opt5) from HTNV(CGHu2)__EU363813.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugccagcauccaggccaagauugacgaacugaaacgccaacucgcugauagaaucgccaccggaaagaaccugggcaaggagcaggacccuacagggguggaaccgggagaucaucuuaaagagcgguccaugcugucuuauggcaaugugcucgaccugaaccaccuggauauugacgagcccaccgggcagacagcugauuggcucagcaucgucaucuaccugaccucccuugugguuccuauucugcucaaggcccuguauaugcuuacaacccgcggaagacagacgaccaaagacaauaagggcacacggauccgcuucaaagaugacucuagcuuugaagacgugaacggcauuagaaagcccaagcaucuguacgucucccucccuaaugcgcaaucuagcaugaaagccgaggaaaucacccccgggcgguaucgcacagcuauuugcggacuguacccugcccagaucaaggcuagacagaugauuuccccggugaugagcguuaucggcuuccuggcccucgcgaaagauuggucugaccggaucgagcaguggcuguccgaacccuguaaacuucugccugauaccgccgcugugagccuccacgggggacccgccacgaaccgcgacuaucugagacaacggcaggucgcucuuggcaauauggagacaaaggagucuaaggccauuagacagcaugccgaauccgcugggugcagcaugguggaggauaucgaaucuccuuccagcauuuggguguuugcgggagcccccgaccgcuguccgccuaccugccuguucaucgcuggcauugccgagcucggcgccuuuuucuccaucucucaagauaugcggaacacaaucauggcuagcaaaaccgucgggaccuccgaagagaagcugagaaagaaaagcucuuuuuaccaguccuaccugcgccggacacagagcaugggcauucagcucgaccaaagaaucauuguucuguucaugguggccuggggaaaggaggcgguggauaauuuucaccuuggggacgauauggaccccgaacugcgcacgcucgcucagucucugaucgacgucaaagugaaggagauuagcaaccaggaaccucuuaaacuguga

SEQ ID NO: 7098 - RNA, 1290 nt, Artificial Sequence
  derived and/or modified CDS sequence (opt5) from HTNV(CGHu3612)__EF990909.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggcuggccgccagcauccaggcuaagauugacgaacucaaacgccaacuggccgauagaguugcuacgggaaagaaccuuggcaaggagcaggacccuaccgggguggaaccgggagaucaucugaaagagcgguccaugcucucuuauggcaaugugcuggaccugaaccaccucgauaucgacgagcccacagggcagaccgccgauuggcugagcauugucaucuaccuuacauccuucgugguuccuauccugcucaaggcgcuguauaugcuuaccacacgcggaagacagaccacgaaagacaauaagggcacccggauucgcuuuaaagaugacucuagcuucgaagacgugaacggcaucagaaagcccaagcaucuguacgucucccucccuaaugcccaaucuagcaugaaagcugaggaaauuacacccgggcgguaucgcaccgccaucugcggacuguacccugcucagauuaaggccagacagaugaucuccccggugaugagcguuauuggcuuucuggcgcucgccaaagauuggucugaccggaucgagcaguggcuguccgaacccuguaaacuucugccugauacagcugccgugagccuccacgggggacccgcuaccaaccgcgacuaucugagacaacggcaggucgcccuuggcaauauggagacgaaggagucuaaggccaucagacagcaugcugaauccgcggggugcagcaugguggaggauauugaaucuccuuccagcaucuggguguucgccggagcucccgaccgcuguccgccuacaugccuguuuauugccggcaucgccgagcucggcgcuuucuuuuccauucugcaagauaugcggaacaccaucauggccucuaaaacagucgggaccagcgaagagaagcugagaaagaaauccagcuucuaccagucuuaccuccgccggacccaguccaugggaauccagcuggaccaaagaauuaucguucuuuuuaugguggcguggggcaaggaggcuguggauaauuuccaccugggggacgauauggaccccgaacuccgcacacuggcccagagccuuauugacgucaaagugcgggagaucucuaaccaggaaccucugaagcucuga

SEQ ID NO: 7099 - RNA, 1290 nt, Artificial Sequence
  derived and/or modified CDS sequence (opt5) from HTNV(CGRn15)__EU363810.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugccagcauccaggccaagauugacgaacugaaacgccaacucgcugauagaaucgccaccggaaagaaccugggcaaggagcaggacccuacagggguggaaccgggagaucaucuuaaagagcgguccaugcugucuuauggcaaugugcucgaccugaaccaccuggauauugacgagcccaccgggcagacagcugauuggcucagcaucgucaucuaccugaccuccuucgugguuccuauucuucugaaggcccucuauaugcugacaacccgcggaagacagacgaccaaagacaauaagggcacacggauccgcuuuaaagaugacucuagcuucgaagacgugaacggcauuagaaagcccaagcaucuuuacgucacccugccuaaugcgcaauccucuaugaaagccgaggaaaucacacccgggcgguaucgcaccgcuauuugcggacucuacccugcccagaucaaggcuagacagaugauuagcccggugauguccguuaucggcuuucuggcccuggcgaaagauuggagcgaccggaucgagcaguggcucucugaacccuguaagcugcuuccugauacggccgcugugucccugcacgggggacccgccacaaaccgcgacuaucucagacaacggcaggucgcucugggcaauauggagaccaaagagagcaaggccauuagacagcaugccgaaucugcugggugcuccaugguggaggauaucgaaagcccuucuuccauuuggguguucgcgggagcccccgaccgcuguccgccuacaugccuuuuuaucgcuggcauugccgagcugggcgccuucuuuagcauccuccaagauaugcggaacaccaucauggcuuccaaaaccgucgggacaucugaagagaagcugagaaagaaaagcuccuucuaccagagcuaccugcgccggacgcagucuaugggcauucagcucgaccaaagaaucauuguucuguuuaugguggccuggggaaaggaggcgguggauaauuuccaccuuggggacgauauggaccccgaacugcgcacccucgcucagucccugaucgacgucaaagugaaggagauuagcaaccaggaaccucuuaaacuguga

SEQ ID NO: 7100 - RNA, 1290 nt, Artificial Sequence
  derived and/or modified CDS sequence (opt5) from HTNV(CGRn2616)__EU363811.1__N
auggccaccauggaggaacugcagagagagaucaacgcucacgaaggccaacucgugauugcccggcagaagguccgcgacgcggggaaacaguacgagaaggaucccgacgaacugaauaaaagaacacuuacggaucgggagggaguugcugccagcauccaggccaagauugacgagcugaaacgccaacucgcugauagaaucgccaccggcaagaaccuggggaaggaacaggacccuacaggaguggagccgggcgaucaucuuaaagaacgguccaugcugucuuaugggaaugugcucgaccugaaccaccuggauauugacgagcccaccggacagacagcugauuggcucagcaucgucaucuaccugaccuccuucgugguuccuauucuucugaaggcccucuauaugcugacaacccgcggcagacagacgaccaaagacaauaagggcacacggauccgcuuuaaagaugacucuagcuucgaggacgugaacgggauuagaaagcccaagcaucuuuacgucucccugccuaaugcgcaaucuagcaugaaagccgaagagaucacccccggacgguaucgcacagcuauuugcggccucuacccugcccagaucaaggcuagacagaugauuuccccggugaugagcguuaucggguuucuggcccuggcgaaagauuggucugaccggaucgaacaguggcucuccgagcccuguaagcugcuuccugauaccgccgcugugagccugcacggaggccccgccacgaaccgcgacuaucucagacaacggcaggucgcucuggggaauauggaaacaaaagagucuaaggccauuagacagcaugccgaguccgcuggaugcagcaugguggaagauaucggcucuccuuccagcauuuggguguucgcgggcgcccccgaccgcuguccgccuaccugccuuuuuaucgcugggauugccgagcugggagccuucuuuuccauccuccaagauaugcggaacacaaucauggcuucuaaaaccgucggcaccagcgaagagaagcugagaaagaaauccagcuucuaccagucuuaccugcgccggacacaguccauggggauucagcucgaccaaagaaucauuguucuguuuaugguggccuggggaaaggaagcgguggauaauuuccaccuuggcgacgauauggaccccgagcugcgcacgcucgcucagagccugaucgacgucgaggugaaagaaauuucuaaccaggagccucuuaagcuguga

SEQ ID NO: 7101 - RNA, 1290 nt, Artificial Sequence
  derived and/or modified CDS sequence (opt5) from HTNV(CGRn53)__EF990907.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgccagcauccaggcuaagauugacgaacugaaacgccaacucgccgauagaaucgcuacgggaaagaaccugggcaaggagcaggacccuaccgggguggaaccgggagaucaucuuaaagagcgguccaugcugucuuauggcaaugugcucgaccugaaccaccuggauauugacgagcccacagggcagaccgccgauuggcucagcaucgucaucuaccugacauccuucgugguuccuauucuucugaaggcgcucuauaugcugaccacacgcggaagacagaccacgaaagacaauaagggcacccggauccgcuuuaaagaugacucuagcuucgaagacgugaacggcauuagaaagcccaagcaucuuuacgucucccugccuaaugcccaaucuagcaugaaagcugaggaaaucacacccgggcgguaucgcaccgccauuugcggacucuacccugcucagaucaaggccagacagaugauuuccccggugaugagcguuaucggcuuucuggcgcuggccaaagauuggucugaccggaucgagcaguggcucuccgaacccuguaagcugcuuccugauacagcugccgugagccugcacgggggacccgcuaccaaccgcgacuaucucagacaacggcaggucgcccugggcaauauggagacgaaagagucuaaggccauuagacagcaugcugaagcggccgggugcuccaugaucgaggauauugaaagcccuucuuccaucuggguguucgcuggagcccccgaccgcuguccgccuacaugccuuuuuauugccggcaucgcugagcugggcgccuucuuuagcauccuccaagauaugcggaacaccauuauggcguccaaaacaguggggaccucugaagagaagcugagaaagaaaagcuccuucuaccagagcuaccugcgccggacccagucuaugggaauccagcucgaccaaagaauuaucguccuguuuaugguugcuuggggcaaggaggccguggauaauuuccaccuuggggacgauauggaccccgaacugcgcacacucgcccagucccugauugacgugaaagucaaggagaucagcaaccaggaaccucuuaaacuguga

SEQ ID NO: 7102 - RNA, 1290 nt, Artificial Sequence
  derived and/or modified CDS sequence (opt5) from HTNV(CGRn5310)__EF990906.1__N
auggccaccauggaggaacugcagagagagaucaacgcucacgaaggccaacucgugauugcccggcagaagguccgcgacgcggagaaacaguacgaaaaggaucccgacgagccuaauaaaagagcucugacagaucgggaggggguugccgccagcauccaggcuaagauugacgaacuuaaacgccaacuggccgauagaaucgcuacgggaaagaaccucggcaaggagcaggacccgaccgggguggaacccggagaucaucugaaagagcgguccaugcuuucuuauggcaaugugcuggaccucaaccaccuggauauugacgagccuacagggcagaccgccgauuggcugagcaucgucaucuaccucacauccuucgugguucccauucugcuuaaggcgcuguauaugcucaccacacgcggaagacagaccacgaaagacaauaagggcacccggauccgcuuuaaagaugacucuagcuucgaagacgugaacggcauuagaaagccuaagcaucuguacgucucccuucccaaugcccaaucuagcaugaaagcugaggaaaucacaccugggcgguaucgcaccgccauuugcggacuguacccggcucagaucaaggccagacagaugauuucccccgugaugagcguuaucggcuuucucgcgcuggccaaagauuggucugaccggaucgagcaguggcuguccgaaccuuguaagcuccugcccgauacagcugccgugagccuucacgggggaccugcuaccaaccgcgacuaucugagacaacggcaggucgcccucggcaauauggagacgaaagagucuaaggccauuagacagcaugcugaagcggccgggugcuccaugaucgaggauauugaaagccccucuuccaucuggguguucgcuggagccccggaccgcuguccucccacaugccuguuuauugccggcaucgcugagcuuggcgccuucuuuagcauccugcaagauaugcggaacaccauuauggcguccaaaacaguggggaccucugaagagaagcucagaaagaaaagcuccuucuaccagagcuaccugcgccggacccagucuaugggaauccagcuggaccaaagaauuaucguccucuuuaugguugcuuggggcaaggaggccguggauaauuuccaccugggggacgauauggacccugaacuucgcacacuggcccagucccucauugacgugaaagucaaggagaucagcaaccaggaaccccugaaacuuuga

SEQ ID NO: 7103 - RNA, 1290 nt, Artificial Sequence
  derived and/or modified CDS sequence (opt5) from HTNV(CGRn93MP8)__EF990905.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgccccuauccaggcuaagauugacgaacugaaacgccaacucgccgauagaaucgcuacgggaaagaaccugggcaaggagcaggacccgaccgggguggaacccggagaucaucuuaaagagcggagcaugcuguccuauggcaaugugcucgaccugaaccaccuggauauugacgagccuacagggcagaccgccgauuggcucucuaucgucaucuaccugaccagcuucgugguucccauucuucugaaggcgcucuauaugcugacaacacgcggaagacagaccacgaaagacaauaagggcucccggauccgcuuuaaagaugacucuagcuucgaagacgugaacggcauuagaaagccuaagcaucuuuacgucucccugcccaaugcccaaucuagcaugaaagcugaggaaaucaccccugggcgguaucgcacagccauuugcggacucuacccggcucagaucaaggccagacagaugauuucccccgugaugagcguuaucggcuuucuggcgcuggccaaagauuggucugaccggaucgagcaguggcucuccgaaccuuguaagcugcuucccgauaccgcugccgugagccugcacgggggaccugcuacaaaccgcgacuaucucagacaacggcaggucgcccugggcaauauggagaccaaagagucuaaggccauuagacagcaugcugaagcggccgggugcuccaugaucgaggauauugaaagccccucuuccaucuggguguucgcuggagccccggaccgcuguccucccacgugccuuuuuauugccggcaucgcugagcugggcgccuucuuuagcauccuccaagauaugcggaacacaauuauggcguccaaaaccguggggacaucugaagagaagcugagaaagaaaagcuccuucuaccagagcuaccugcgccggacccagucuaugggaauccagcucgaccaaagaauuaucguccuguuuaugguugcuuggggcaaggaggccguggauaauuuccaccuuggggacgauauggacccugaacugcgcacccucgcccagucccugauugacgugaaagucaaggagaucagcaaccaggaaccccuuaaacuguga

SEQ ID NO: 7104 - RNA, 1290 nt, Artificial Sequence
  derived and/or modified CDS sequence (opt5) from HTNV(CGRn93P8)__EF990904.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgccagcauccaggcuaagauugacgaacugaaacgccaacucgccgauagaaucgcuacgggaaagaaccugggcaaggagcaggacccuaccgggguggaaccgggagaucaucuuaaagagcgguccaugcugucuuauggcaaugugcucgaccugaaccaccuggauauugacgagcccacagggcagaccgccgauuggcucagcaucgucaucuaccugacauccuucgugguuccuauucuucugaaggcgcucuauaugcugaccacacgcggaagacagaccacgaaagacaauaagggcacccggauccgcuuuaaagaugacucuagcuucgaagacgugaacggcauuagaaagcccaagcaucuuuacgucucccugccuaaugcccaaucuagcaugaaagcugaggaaaucacacccgggcgguaucgcaccgccauuugcggacucuacccugcucagaucaaggccagacagaugauuuccccggugaugagcguuaucggcuuucuggcgcuggccaaagauuggucugaccggaucgagcaguggcucuccgaacccuguaagcugcuuccugauacagcugccgugagccugcacgggggacccgcuaccaaccgcgacuaucucagacaacggcaggucgcccugggcaauauggagacgaaagagucuaaggccauuagacagcaugcugaagcggccgggugcuccaugaucgaggauauugaaagcccuucuuccaucuggguguucgcuggagcccccgaccgcuguccgccuacaugccuuuuuauugccggcaucgcugagcugggcgccuucaucagcauucuccaagauaugcggaacaccaucauggcguccaaaacaguggggaccucugaagagaagcugagaaauaagagcuccuuuuaccagagcuaccugcgccggacccagucuaugggcauucagcucgaccaaagaaucauuguccuguucaugguugcuuggggaaaagaggccguggauaacuuucaccuuggggacgauauggaccccgaacugcgcacacucgcccagucccugaucgacgugaaggucaaagagaucagcaaucaggaaccucuuaagcuguga

SEQ ID NO: 7105 - RNA, 1290 nt, Artificial Sequence
  derived and/or modified CDS sequence (opt5) from HTNV(CGRni1)__EU363812.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugccagcauccaggccaagauugacgaacugaaacgccaacucgcugauagaaucgccaccggaaagaaccugggccgggagcaggacccuacagggguggaaccgggagaucaucuuaaggagcgcuccaugcugucuuauggcaaugugcucgaccugaaccaccuggauauugacgagcccaccgggcagacagcugauuggcucagcaucgucaucuaccugaccuccuucgugguuccuauucuucugaaagcccucuauaugcugacaaccagaggacggcagacgaccaaggacaauaaaggcacacgcaucagauuuaaggaugacucuagcuucgaagacauuaacggcauccggaaacccaagcaucuuuacgugucccugccuaaugcgcaaucuagcaugaaggccgaggaaauuacccccgggcgcuauagaacagcuaucugcggacucuacccugcccagauuaaagcucggcagaugaucuccccggucaugagcgugaucggcuuucuggcccuggcgaaggauuggucugaccgcauugagcaguggcucuccgaacccuguaaacugcuuccugauaccgccgcuguuagccugcacgggggacccgccacgaacagagacuaucuccggcaaagacagguggcucugggcaauauggagacaaaggagucuaaagccauccgccagcaugccgaauccgcugggugcagcauggucgaggauauugaaucuccuuccagcaucuggguguucgcgggagcccccgaccgguguccgccuaccugccuuuuuauugcuggcaucgccgagcugggcgccuucuuuuccauccuccaagauaugagaaacacaauuauggcuucuaagaccguggggaccagcgaagagaaacugcgcaagaaguccagcuucuaccagucuuaccugcggagaacacaguccaugggaauccagcucgaccaacgcauuaucguccugcuuaugguugccuggggcaaagaggcgguggauaauuuucaccugggggacgauauggaccccgaacuccggacgcuggcucagagccuuauugacgugaaggucaaagagaucucuaaccaggaaccucugaagcucuga

SEQ ID NO: 7106 - RNA, 1290 nt, Artificial Sequence
  derived and/or modified CDS sequence (opt5) from HTNV(CJAp93)__EF208929.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugugagcauccaggccaagauugacgaacugaaacgccaacucgccgauagaaucgcuaccggaaagaaccugggcaaggagcaggacccuacagggguggaaccgggagaucaucuuaaagagcgguccaugcugucuuauggcaauguccucgaccugaaccaccuggauauugacgagcccaccgggcagacagccgauuggcucagcaucgugguuuaccugaccuccuucguggucccuauccuucugaaggcucucuauaugcugacaacccgcggaagacagacgaccaaagacaauaagggcacacggauucgcuuuaaagaugacucuagcuucgaagacgugaacggcaucagaaagcccaagcaucuuuacguuucccugccuaaugcccaaucuagcaugaaagcggaggaaauuacccccgggcgguaucgcacagccaucugcggacucuacccugcucagauuaaggccagacagaugaucuccccggugaugagcgucauuggcuuucuggcucuggccaaagauuggucugaccggaucgagcaguggcucuccgaacccuguaagcugcuuccugauaccgcggccguggggcugcucggaggccccgcuacgaaccgcgacuaucugagacaaagacagguggcccuugggaauauggagacaaaagagagcaaggcuauccggcagcacgccgaagccgcuggaugcucuaugauugaggauaucgaauccccuagcucuauuugggucuucgcgggcgcccccgaccgcuguccgccuaccugccuguuuaucgcuggcauugccgagcucggggccuucuuuuccauccugcaagauaugcggaacacaaucauggcuagcaaaaccguuggaaccuccgaagagaagcugagaaagaaaucuagcuucuaccaguccuaccuccgccggacacagagcaugggcauucagcuggaccaaagaaucauugugcuuuuuaugguggccugggggaaggaggcggucaauaacuuccaucugggagaugacauggaucccgaacuccgcacgcuggcucagucucuuaucgacgugaaaguuaaggagauuuccaaucaggaaccucugaaacucuga

SEQ ID NO: 7107 - RNA, 1290 nt, Artificial Sequence
  derived and/or modified CDS sequence (opt5) from HTNV(Aa14_207)__KX687234.1__N
auggccaccauggaggaacugcagagagagaucaacgcucacgaaggccaacucgugauugcccggcagaagguccgcgacgcggagaaacaguacgggaaggaucccgacgaacugaauaaaagagcucuuacagaucgggagggaguugccgugagcauccaggccaagauugacgagcugaaacgccaacucgcugauagaaucgccacgggcaagaaccuggggaaggaacaggacccuaccggaguggagccgggcgaucaucuuaaagaacgguccaugcugucuuaugggaauguccucgaccugaaccaccuggauauugacgagcccacaggacagaccgcugauuggcucagcaucgugguuuaccugacauccuucguggucccuauccuucugaaggcccucuauaugcugaccacacgcggcagacagaccacgaaagacaauaagggcacccggauucgcuuuaaagaugacucuagcuucgaggacgugaacgggaucagaaagcccaagcaucuuuacguuucccugccuaaugcgcaaucuagcaugaaagccgaagagauuacacccggacgguaucgcaccgcugugugcggccucuacccugcccagaucaaggcuagacagaugauuuccccggucaugagcgugaucggguuucuggcccuggcgaaagauuggucugaccggauugaacaguggcucuccgagcccuguaagcugcuuccugauacagccgcugugagccugcucggaggccccgccaccaaccgcgacuaucugagacaacggcaggucgcucuugggaauauggaaacgaaagagucuaaggccaucagacagcacgccgaggcugcgggaugcuccaugaucgaagauauugagagcccuucuuccaucuggguuuucgccggcgcucccgaccgcuguccgccuacaugccuguuuguggccggcauugccgaacucggggcuuucuuuagcauccugcaagauaugcggaacaccauuauggccuccaaaacagugggaaccucugaggaaaagcugagaaagaaaagcuccuucuaccagagcuaccuccgccggacccagucuaugggcauccagcuggaccaaagaaucauuguccuuuuuaugguggcgugggggaaggaggcuguugauaauuuccaucugggagacgauauggaccccgagcuccgcacacuggcccagucccuuaucgacgugaaagucaaggaaauuagcaaccaggagccucugaaacucuga

SEQ ID NO: 7108 - RNA, 1290 nt, Artificial Sequence
  derived and/or modified CDS sequence (opt5) from HTNV(Aa14_234)__KX687235.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgugagcauccaggccaagauugacgaacugaaacgccaacucgcugauagaaucgccacgggaaagaaccugggcaaggagcaggacccuaccgggguggaaccgggagaucaucuuaaagagcgguccaugcugucuuauggcaauguccucgaccugaaccaccuggauauugacgagcccacagggcagaccgcugauuggcucagcaucgugguuuaccugacauccuucguggucccuauccuucugaaggcccucuauaugcugaccacacgcggaagacagaccacgaaagacaauaagggcacccggauucgcuuuaaagaugacucuagcuucgaagacgugaacggcaucagaaagcccaagcaucuuuacguuucccugccuaaugcgcaaucuagcaugaaagccgaggaaauuacacccgggcgguaucgcaccgcugugugcggacucuacccugcccagaucaaggcuagacagaugauuuccccggucaugagcgugaucggcuuucuggcccuggcgaaagauuggucugaccggauugagcaguggcucggggaacccuguaagcugcuuccugauacagccgcugugucccugcucggaggccccgccaccaaccgcgacuaucugagacaacggcaggucgcucuugggaauauggagacgaaagagagcaaggccaucagacagcacgccgaagcugcgggaugcucuaugaucgaggauauugaauccccuagcucuaucuggguuuucgccggcgcucccgaccgcuguccgccuacaugccuguuuauugccggcaucgccgagcucggggcuuucuuuuccauucugcaagauaugcggaacaccaucauggccagcaaaacagugggaaccuccgaagagaagcugagaaagaaaucuagcuucuaccaguccuaccuccgccggacccagagcaugggcauccagcuggaccaaagaauuaucgugcuuuuuauggucgcgugggggaaggaggcuguggauaauuuccaucugggagacgauauggaccccgaacuccgcacacuggcccagucucuuauugacguuaaagugaaggagaucuccaaccaggaaccucugaaacucuga

SEQ ID NO: 7109 - RNA, 1290 nt, Artificial Sequence
  derived and/or modified CDS sequence (opt5) from HTNV(Aa14_239)__KX687236.1__N
auggccaccauggaggaacugcagagagagaucaacgcucacgaaggccaacucgugauugcccggcagaagguccgcgacgcggagaaacaggaugggaaggaccccgaugaacugaauaaaagagcucuuacagaccgggagggaguugccgugagcauccaggccaagauugaugagcugaaacgccaacucgcugacagaaucgccacgggcaagaaccuggggaaggaacaggauccuaccggaguggagccgggcgaccaucuuaaagaacgguccaugcugucuuacgggaauguccucgaucugaaccaccuggacauugaugagcccacaggacagaccgcugacuggcucagcaucgugguuuaucugacauccuucguggucccuauccuucugaaggcccucuacaugcugaccacacgcggcagacagaccacgaaagauaauaagggcacccggauucgcuuuaaagacgacucuagcuucgaggaugugaacgggaucagaaagcccaagcaucuuuauguuucccugccuaaugcgcaaucuagcaugaaagccgaagagauuacacccggacgguaccgcaccgcugugugcggccucuauccugcccagaucaaggcuagacagaugauuuccccggucaugagcgugaucggguuucuggcccuggcgaaagacuggucugaucggauugaacaguggcucggagagcccuguaagcugcuuccugacacagccgcugugucccugcucggcgggcccgccaccaaccgcgauuaccugagacaacggcaggucgcucuuggaaauauggaaacgaaagagagcaaggccaucagacagcacgccgaggcugcgggcugcucuaugaucgaagacauugaguccccuagcucuaucuggguuuucgccggcgcucccgaucgcuguccgccuacaugccuguuuauugccgggaucgccgaacucggagcuuucuuuuccauucugcaagacaugcggaacaccaucauggccagcaaaacagugggcaccuccgaggaaaagcugagaaagaaaucuagcuucuaucaguccuaccuccgccggacccagagcauggggauccagcuggaucaaagaauuaucgugcuuuuuauggucgcguggggaaaggaggcuguggacaauuuccaucugggcgaugacauggaccccgagcuccgcacacuggcccagucucuuauugauguuaaagugaaggaaaucuccaaccaggagccucugaaacucuga

SEQ ID NO: 7110 - RNA, 1290 nt, Artificial Sequence
  derived and/or modified CDS sequence (opt5) from HTNV(AY133/2011)__KY807166.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgccagcauccaggcuaagauugacgaacugaaacgccaacucgccgauagaaucgcuacgggaaagaacauuggcaaggagcaggacccuaccgggguggaaccgggagaucaucugaaagagcgguccaugcuuucuuauggcaaugugcuggaccucaaccaccuggauaucgacgagcccacagggcagaccgccgauuggcugagcaucgucauuuaccucacauccuucgugguuccuauccugcuuaaggcgcuguauaugcucaccacacgcggaagacagaccacgaaagacaauaagggcacccggauucgcuuuaaagaugacucuagcuucgaagacguguccggcaucagaaagcccaagcaucuguaccuuucucugccuaacgcccaaagcuccaugaaagcugaggaaauuacacccgggcgguaucgcaccgccaucugcggacucuacccugcucagauuaaggccagacagaugaucagcccggucaugucugugaucggcuuucuggcgcuggccaaagauugguccgaccggauugagcaguggcucagcgaacccuguaagcugcuuccugauacagcugccguuucucugcacgggggacccgcuaccaaucgcgacuaucucagacaaagacagguggcccugggcaacauggagacgaaagaguccaaggccauccggcagcaugcugaaacagcggggugcagcaugauugaugacaucgagucuccuuccagcauuugggucuucgccggagcucccgaucgcuguccgccuaccugccuuuuuaucgccggcaucgccgaacugggcgcuuucuuuuccauucuccaagacaugcggaauacaaucauggccucuaaaaccguggggaccagcgaggaaaagcugagaaagaaauccagcuucuaccagucuuaccugcgccggacacaguccaugggcauucagcucgaucaaagaaucauugugcuguuuauggucgcguggggaaaggaggcuguugacaacuuccaccuuggggaugacauggaccccgagcugcgcacgcucgcccagagccugaucgaugugaaagugaaggaaaucucuaaucaggagccucuuaaacuguga

SEQ ID NO: 7111 - RNA, 1290 nt, Artificial Sequence
  derived and/or modified CDS sequence (opt5) from HTNV(GAN13/2011)__KY807168.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgccagcauccaggcuaagauugacgaacugaaacgccaacucgccgauagaaucgcuacgggaaagaaccugggcaaggagcaggacccuaccgggguggaaccgggagaucaucuuaaagagcgguccaugcugucuuauggcaaugugcucgaccugaaccaccuggauauugacgagcccacagggcagaccgccgauuggcucagcaucgucaucuaccugacauccuucgugguuccuauucuucugaaggcgcucuauaugcugaccacacgcggaagacagaccacgaaagacaauaagggcacccggauccgcuuuaaagaugacucuagcuucgaagacgugaacggcauuagaaagcccaagcaucuuuaccugucccucccuaaugcccaaucuagcaugaaagcugaggaaaucacacccgggcgguaucgcaccgccauuugcggacuguacccugcucagaucaaggccagacagaugauuuccccggucaugagcgugaucggcuuucuggcgcucgccaaagauuggucugaccggaucgagcaguggcuguccgaacccuguaaacuucugccugauacagcugccguuagccuccacgggggacccgcuaccaaccgcgacuaucugagacaaagacagguggcccuuggcaauauggagacgaaggagucuaaggccauucggcagcaugcugaaacagcggggugcuccaugaucgaugacauugagagcccuucuuccaucugggucuucgccggagcucccgaucgcuguccgccuaccugccuguuuauugccggcaucgccgaacucggcgcuuucuuuagcauccugcaagacaugcggaacacaauuauggccuccaaaaccguggggaccucugaggaaaagcugagaaagaaaagcuccuucuaccagagcuaccuccgccggacacagucuaugggaauccagcuggaucaaagaauuaucgugcuuuuuauggucgcguggggcaaggaggcuguugacaauuuccaccugggggaugacauggaccccgagcuccgcacgcuggcccagucccuuauugaugugaaagugaaggaaaucagcaaccaggagccucugaaacucuga

SEQ ID NO: 7112 - RNA, 1290 nt, Artificial Sequence
  derived and/or modified CDS sequence (opt5) from HTNV(GAN19/2011)__KY807172.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacagaucgggaggggguugccgccagcauccaggcuaagauugacgaacugaaacgccaacucgccgauagaaucgcuacgggaaagaaccugggcaaggagcaggacccuaccgggguggaaccgggagaucaucuuaaagagcgguccaugcugucuuauggcaaugugcucgaccugaaccaccuggauauugacgagcccacagggcagaccgccgauuggcucagcaucgucaucuaccugacauccuucgugguuccuauucuucugaaggcgcucuauaugcugaccacacgcggaagacagaccacgaaagacaauaagggcacccggauccgcuuuaaagaugacucuagcuucgaagacgugaacggcauuagaaagcccaagcaucuuuaccugucccucccuaaugcccaaucuagcaugaaagcugaggaaaucacacccgggcgguaucgcaccgccauuugcggacuguacccugcucagaucaaggccagacagaugacauccccggucaugagcgugauuggcuuucuggcgcucgccaaagauuggucugaccggaucgagcaguggcuguccgaacccuguaaacuucugccugauaccgcugccguuagccuccacgggggacccgcuacgucucgcgacuaucugagacaaagacagguggcccuuggcaacauggagacaaaggaguccaaggccauccggcagcaugcugaaaccgcggggugcagcaugauugaugacaucgagucuccuuccagcauuugggucuucgccggagcucccgaucgcuguccgccuacaugccuguuuaucgccggcauugccgaacucggcgcuuucuuuuccauccugcaagacaugcggaauaccaucauggccucuaaaaccguggggacaagcgaggaaaagcugagaaagaaauccagccucuaccagucuuaccugcgccggacgcaguccaugggcauucagcuugaucaaagaaucauugugcuguucauggucgcguggggaaaggaggcuguugacaacuuucaccucggggaugacauggaccccgagcugcgcacccuugcccagagccugaucgaugugaaagugaaggaaauuucuaaucaggagccucucaaacuguga

SEQ ID NO: 7113 - RNA, 1290 nt, Artificial Sequence
  derived and/or modified CDS sequence (opt5) from HTNV(LR1)__AF288294.1__N
auggccaccauggaggaacugcagagagagaucaacgcucacgaaggccaacucgugauugcccggcagaagguccgcgacgcggagaaacaguacgaaaaggaucccgacgagcugaauaaaagagcucuuacaaaccgggaggggguugccgugagcauccaggccaagauugaugaacugaaaaugcaacucgcugaccgcaucgccacgggaaagaaucugggcaaggagcaggauccuaccgggguggaaccgggagaccaucuuaaagagagauccaugcugucuuauggcaacguccucgaucugaaucaccuggacauugaugagcccacagggcagaccgcugacuggcucagcaucaucguguaccugacauccuucguugugccuauucuucugaaggcccucuauaugcugaccacacggggacgccagaccacgaaagauaacaagggcaccagaauccgguuuaaagacgauucuagcuucgaagacgucaauggcauucgcaagcccaagcaucuuuacgugucccugccugacgcgcaaucuagcaugaaagccgaggaaaucacacccgggagauaucggaccgcuguuugcggacucuacccugcccagauuaaggcucgccagaugaucuccccggugaugagcgucauuggcuuucuggcccuggcgaaagauuggucugacagaaucgagcaguggcucaucgaacccuguaagcugcuuccugauacagccgcugugucccugcucgggggacccgccaccaaccgggacuaucugcgccaaagacagguggcucuuggcaauauggagacgaaagagagcaaggccauucggcagcacgccgaagcugcggggugcucuaugaucgaggauauugaauccccuagcucuaucugggucuucgccggagcucccgacagauguccgccuacaugccuguuuauugccggcaucgccgagcucggcgcuuucuuuuccauccugcaagauaugcgcaacaccauuauggccagcaaaacaguugggaccuccgaagagaagcugcggaagaaaucuagcuucuaccaguccuaccucagacgcacccagagcaugggaauccagcuggaccaacggauuaucgugcuuuuuaugguggcguggggcaaggaggcugucgauaauuuccaucugggggacgauauggaccccgaacucagaacacuggcccagucucuuauugacgugaaaguuaaggagaucuccaaccaggaaccucugaaacucuga

SEQ ID NO: 7114 - RNA, 1290 nt, Artificial Sequence
  derived and/or modified CDS sequence (opt5) from HTNV(RG9)__AF288296.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugccagcauccaggccaagauugacgaacugaaacgccaacucgcugauagaaucgccaccggaaagaaccugggcaaggagcaggacccuacagggguggaaccgggagaucaucuuaaagagcgguccaugcugucuuauggcaaugugcucgaccugaaccaccuggauauugacgagcccaccgggcagacagcugauuggcucagcaucgucaucuaccugaccuccuucgugguuccuauucuucugaaggcccucuauaugcugacaacccgcggaagacagacgaccaaagacaauaagggcacacggauccgcuuuaaagaugacucuagcuucgaagacgugaacggcauuagaaagcccaagcaucuuuacgucucccugccuaaugcgcaaucuagcaugaaagccgaggaaaucacccccgggcgguaucgcacagcuauuugcggacucuacccugcccagaucaaggcuagacagaugauuuccccggugaugagcguuaucggcuuucuggcccuggcgaaagauuggucugaccggaucgagcaguggcucuccgaacccuguaagcugcuuccugauaccgccgcugugagccugcacgggggacccgccacgaaccgcgacuaucucagacaacggcaggucgcucugggcaauauggagacaaaagagucuaaggccauuagacagcaugccgaauccgcugggugcagcaugaucgaggauauugaaucuccuuccagcaucuggguguucgcgggagcccccgaccgcuguccgccuaccugccuuuuuauugcuggcaucgccgagcugggcgccuucuuuuccauccuccaagauaugcggaacacaauuaccgcuucuaaaaccguggggacaagcgaagagaagcugagaaagaaauccagcuucuaccagucuuaccugcgccggacgcaguccaugggaauccagcucgaccaaagaauuaucguccuguuuaugguugccuggggcaaggaggcgguggauaauuuccaccuuggggacgauauggaccccgaacugcgcacccucgcucagagccugauugacgugaaagucaaggagaucucuaaccaggaaccucuuaaacuguga

SEQ ID NO: 7115 - RNA, 1290 nt, Artificial Sequence
  derived and/or modified CDS sequence (opt5) from HTNV(S85-46)__AF288659.1__N
auggccaccauggaggaacugcagagagagaucaacgcucacgaaggccaacucgugauugcccggcagaagguccgcgacgcggagaaacaguacgaaaaggaucccgacgagcugaauaaaagcgcucuuacaaacagagaggggguugccguguccauccaggccaagauugaugaacugaaaaugcaacucgcugaccggaucgccacgggaaagaaucugggcaaggagcaggauccuaccgggguggaaccgggagaccaucuuaaagagcgcucuaugcugagcuauggcaacguccucgaucugaaucaccuggacauugaugagcccacagggcagaccgcugacuggcucuccaucaucguguaccugacaucuuucguugugccuauucuucugaaggcccucuauaugcugaccacaagaggacggcagaccacgaaagauaacaagggcacccgcaucagauuuaaagacgauagcuccuucgaagacgucaauggcauucggaagcccaagcaucuuuacgugucucugccuaacgcgcaaagcuccaugaaagccgaggaaaucacacccgggcgcuauagaaccgcuguuugcggacucuacccugcccagauuaaggcucggcagaugaucagcccggugaugucugucauuggcuuucuggcccuggcgaaagacugguccgaucgcaucgagcaguggcucaucgaacccuguaagcugcuuccugacacagccgcugugagccugcucgggggacccgccaccaauagagauuaucugcggcaacgccagguggcucuuggcaacauggagacgaaagagucuaaggccauuagacagcacgccgaagcugcggggugcuccaugaucgaggacauugaaagcccuucuuccaucugggucuucgccggagcucccggccgguguccgccuacaugccuguuuauugccggcaucgccgagcucggggcuuucuuuagcauccugcaagauaugagaaauaccauuauggccuccaaaacaguuggaaccucugaagagaagcugcgcaagaaaagcuccuucuaccagagcuaccuccggagaacccagucuaugggcauccagcuggaccaacgcauuaucgugcuuuuuaugguggcgugggggaaggaggcugucgauaacuuccaucugggagacgauauggaccccgaacuccggacacuggcccagucccuuauugaugugaaaguuaaggagaucagcaaucaggaaccucugaaacucuga

SEQ ID NO: 7116 - RNA, 1290 nt, Artificial Sequence
  derived and/or modified CDS sequence (opt5) from HTNV(SN7)__AF288657.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugccagcauccaggccaagauugacgaacugaaacgccaacucgcugauagaaucgccaccggaaagaaccugggcaaggagcaggacccuacagggguggaaccgggagaucaucuuaaagagcgguccaugcugucuuauggcaaugugcucgaccugaaccaccuggauauugacgagcccaccgggcagacagcugauuggcucagcaucgucaucuaccugaccuccuucgugguuccuauucuucugaaggcccucuauaugcugacaacccgcggaagacagacgaccaaagacaauaagggcacacggauccgcuuuaaagaugacucuagcuucgaagacgugaacggcauuagaaagcccaagcaucuuuacgucucccugccuaaugcgcaaucuagcaugaaaaccgaggaaaucacacccgggcgguaucgcaccgccauuugcggacucuacccugcucagaucaaggccagacagaugauuuccccggugaugagcguuaucggcuuucuggcucuggccaaagauuggucugaccggaucgagcaguggcucuccgaacccuguaagcugcuuccugauacggcggccgugagccugcacgggggacccgcuacaaaccgcgacuaucucagacaacggcaggucgcccugggcaauauggagaccaaagagucuaaggcuauuagacagcaugccgaauccgccgggugcagcaugaucgaggauauugaaucuccuuccagcaucuggguguucgcuggagcgcccgaccgcuguccgccuacaugccuuuuuauugccggcaucgcugagcugggcgccuucuuuuccauccuccaagauaugcggaacaccauuauggccucuaaaaccguggggacaagcgaagagaagcugagaaagaaauccagcuucuaccagucuuaccugcgccggacgcaguccaugggaauccagcucgaccaaagaauuaucguccuguuuaugguugcuuggggcaaggaggccguggauaauuuccaccuuggggacgauauggaccccgaacugcgcacccucgcgcagagccugauugacgugaaagucaaggagaucucuaaccaggaaccucuuaaacuguga

SEQ ID NO: 7117 - RNA, 1290 nt, Artificial Sequence
  derived and/or modified CDS sequence (opt5) from HTNV(84FLi)__AF366568.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugccagcauccaggccaagauugacgaacugaaacgccaacucgcugauagaaucgccaccggaaagaaccugggcaaggagcaggacccuacagggguggaaccgggagaucaucuuaaagagcgguccaugcugucuuauggcaaugugcucgaccugaaccaccuggauauugacgagcccaccgggcagacagcugauuggcucagcaucgucaucuaccugaccuccuucgugguuccuauucuucugaaggcccucuauaugcugacaacccgcggaagacagacgaccaaagacaauaagggcacacggauccgcuuuaaagaugacucuagcuucgaagacgugaacggcauuagaaagcccaagcaucuuuacgucucccugccuaaugcgcaaucuagcaugaaagccgaggaaaucacccccgggcgguaucgcacagcuauuugcggacucuacccugcccagaucaaggcuagacagaugauuuccccggugaugagcguuaucggcuuucuggcccuggcgaaagauuggucugaccggaucgagcaguggcucuccgaacccuguaagcugcuuccugauaccgccgcugugagccugcacgggggacccgccacgaaccgcgacuaucucagacaacggcaggucgcucugggcaauauggagacaaaagagucuaaggccauuagacagcaugccgaauccgcugggugcagcaugaucgaggauauugaaucuccuuccagcaucuggguguucgcgggagcccccaaccgcuguccgccuaccugccuuuuuauugcuggcaucgccgagcugggcgccuucuuuuccauccuccaagacaugcggaauacaauuauggcuucuaaaaccguggggaccagcgaagagaagcugagaaagaaauccagcuucuaccagucuuaccugcgccggacacaguccaugggaauccagcucgaucaaagaauuaucguccuguuuaugguugccuggggcaaggaggcgguggacaacuuccaccuuggggaugacauggaucccgaacugcgcacgcucgcucagagccugauugacgugaaagucaaggagaucucuaaucaggaaccucuuaaacuguga

SEQ ID NO: 7118 - RNA, 1290 nt, Artificial Sequence
  derived and/or modified CDS sequence (opt5) from HTNV(KHF,clone:4)__LC209206.1__N
auggccaccauggaggaacugcagagagagaucaacgcucacgaaggccaacucgugauugcccggcagaagguccgcgacgcggagaaacaguacgaaaaggaucccgacgagcugaauaaaagaacacuuacggaucgggaggggguugcugugagcauccaggccaagauugacgaacugaaacgccaacucgccgauagaaucgcuaccggaaagaaccugggcaaggagcaggacccuacagggguggaaccgggagaucaucuuaaagagcgguccaugcugucuuauggcaauguccucgaccugaaccaccuggauauugacgagcccaccgggcagacagccgauuggcucagcaucgugguuuaccugaccuccuucguggucccuauccuucugaaggcucucuauaugcugacaacccgcggaagacagacgaccaaagacaauaagggcacacggauucgcuuuaaagaugacucuagcuucgaagacgugaacggcaucagaaagcccaagcaucuuuacguuucccugccuaaugcccaaucuagcaugaaagcggaggaaauuacccccgggcgguaucgcacagccgugugcggacucuacccugcucagaucaaggccagacagaugauuuccccggucaugagcgugaucggcuuucuggcucuggccaaagauuggucugaccggauugagcaguggcucuccgaacccuguaagcugcuuccugauaccgcggccgugagccugcucgggggacccgcuacgaaccgcgacuaucugagacaacggcaggucgcccuuggcaauauggagacaaaagagucuaaggcuaucagacagcacgccgaagccgcugggugcuccaugaucgaggauauugaaagcccuucuuccaucuggguuuucgcgggagcccccgaccgcuguccgccuaccugccuguuuauugcuggcaucgccgagcucggcgccuucuuuagcauucugcaagauaugcggaacacaaucauggcuuccaaaaccguggggaccucugaagagaagcugagaaagaaaagcuccuucuaccagagcuaccuccgccggacacagucuaugggaauccagcuggaccaaagaauuaucgugcuuuuuauggucgccuggggcaaggaggcgguggauaauuuccaucugggggacgauauggaccccgaacuccgcacgcuggcucagucccuuauugacguuaaagugaaggagaucagcaaccaggaaccucugaaacucuga

SEQ ID NO: 7119 - RNA, 1287 nt, Artificial Sequence
  derived and/or modified CDS sequence (opt5) from LANV(510B)__AF005727.1__N
augagcaaccugcaggaggugcaagaaggcaucacccuccacgagcagcagcuggucgccgcuagacagaaacuuaaggacgccgaaaaggcgguugagguggaucccgacgaugugaauaaguccacacugcaaucucggcgcgcugccgucagcgcccucgaaaacaagcuggcugagcuuaaaagacagcuggccgaccucguggcugcccagaagcuggcggccaagccuguugauccgacggggcuggagcccgacgaucaucucaaagaaaaguccgcucugcgguacggaaaugugcuugacgucaacgccauugaucuggaggaaccuucuggccagaccgcugacuggaaagccaucggggcguauauucucggauucgugauccccauuauccugaaggcccuuuacaugcugagcacacgcggcagacaaaccguuaaagagaauaaggggacacggauccgcuuuaaggaugacuccucuuucgaggaagugaacggaauuagaaaaccuaagcaccucuaugucagcaugcccaccgcucaguccacaaugaaagccgaugagaucaccccuggccgguuucgcacgauugcuugcggccuguucccggcccagaucaaggccagaaauauuaucagccccgugaugggggugauuggauuuggccauuucgucaaagacuggauggaacggaucgacaacuuucugggggaggauuguccuuuccuccccaaggcucgcguucagucugaagcguuuauguccaccaauagagccuacuuccugaaccggcaacgccagguggacgagagcagaauccaggauauuguggaccuuauccaagcugccgaggccucuuccgcuacacuguuuaaugauauugccaccccucacagcgcgugggucuucgcuugcgcccccgaccgguguccgccuacagcccucuauguggcuggaguucccgaacugggcgccuuuuucgcuauccuucaggauaugagaaacaccauuauggccucuaaauccguggggacggcggaggaaaagcugaagaaaaagagcgccuucuaccaguccuaucuccgccggacacagucuaugggaauccaacuggaccagaaaaucauuauccuguacaugcucagcuggggcaaggaggcugucaaucauuuucaccugggcgaugacauggauccugaacuuagacagcuggcccagacccucauugacgcuaaagugaaggagaucuccaaccaagagccccugaaacuuuga

SEQ ID NO: 7120 - RNA, 1287 nt, Artificial Sequence
  derived and/or modified CDS sequence (opt5) from LANV(12234)__ALD61435.1__N
augagcacccugcaggaggugcaagaaggcaucacacuccacgagcagcagcuggucgccgcuagacagaaacuuaaggacgccgaaaaggcgguugagguggaucccgacgaugugaacaaauccacgcugcaaucucggcgcgcugccgucagcgcccucgaaaauaagcuggcugagcuuaaaagacagcuggccgaccucguggcugcccagaagcuggcggccaagccuguugauccgaccgggcuggagcccgacgaucaucucaaagaaaaguccgcucugcgguacggaaacgugcuugacgucaaugccauugaucuggaggaaccuucuggccagacagcugacuggaaagccaucggggcguauauucucggauucgugauccccauuauccugaaggcccuuuacaugcugagcacccgcggcagacaaacaguuaaagagaacaaggggacccggauccgcuuuaaggaugacuccucuuucgaggaagugaauggaauuagaaaaccuaagcagcucuaugucagcaugcccacagcucaguccaccaugaaagccgaugagaucacgccuggccgguuucgcaccauugcuugcggccuguucccggcccagaucaaggccagaaacauuaucagccccgugaugggggugauuggauuuucucacuucgucaaagacuggauggaacggaucgacgauuuucuggcugcggacuguccuuuccuccccaagccucgcguucaauccgaggccuuuauggcuacaaauagagccuacuucaucaaccggcagcgccagauugaugaaagcagaaugcccgacaucauggaucugauucaagccgcugaggccggcucugcgacccuuuuuaaugacaucgcuacaccgcauuccgccuggguguucgccugcgcuccugaucggugucccccuaccgcccuguauguggcugggguccccgagcucggagccuuuuucgcgauucugcaggacaugagaaacacgaucauggccagcaaaucugugggcacagcugaagagaaacuuaagaagaaguccgccuucuaccagagcuaucugcgccggacccaguccauggggauccaacucgaucagaaaauuaucauucuguacaugcugucuuggggaaaggaagcuguuaaucacuuucaucucggcgacgauauggaccccgagcugagacagcuugcccagacacugaucgacaccaaagugaaggaaauuagcaaccaagagccucucaagcuguga

SEQ ID NO: 7121 - RNA, 1272 nt, Artificial Sequence
  derived and/or modified CDS sequence (opt5) from LQUV(Longquan-Rs-32)__JX465422.1__N
auggccaccggcagagaccugcaggaugagcucgaacaaaucgagcaggaaauuacacaggcuaaggccaaauacgagaagcagaaagcggcuaucggggaggaacccgacacgauugagcugaaggugcuucaacagcgggaagagaccauccacaugcuggaagagaaacgcaaggagcuccugcagagaauugcccagcaaaugaaaagcccucggcagccggucaagggacgcgaucuugacgaagaugagcaucuguccgaaagaucuacacuccgguauggcaacguuaucgaccuggaggaacuggauaucgacgagcccgccgggggaagcgcugauuggcucgccauuggcaucuacauuuucuccuuuccugugcagcugcuucugaagacccucuauauccugacaacccgcgggagacagacaauuaaagagaauaagggaaaccggcuucgcuucaaagacucuagcuccaccauggaugugaauggcgucaagacgcccagacaccuguacaucucucucccuaccgcucaaagcuccaugaagacagaagagauuacccccggccgguaucgcacaguggccugcgggauccugagcggagaaaugagagcgcggaaacugguuucuccugugaugggcgucaucggguuuaacuaccucgccgagaaguggggagaauauauugacgcuuuccugaugaaacaguccccgcaucuucccgugagcaccggcucuccugaguccgccacgaauuuugcuuaccugauccagcgccaagauguucucaacaagagcaaaacaguggaguaccuggaacuuugggagcaggccgaaaaggcggggagacaccuggucgaccggauugagucuccccucaccccuuggcuguucgccggaucccccgacagauguccgccuacaagccuguauguggcuggcaucgccgaacucggcgccuuuuucuccauucugcaggauauccgcaaugcuaucauggccucuaaacuuguggggaccgcugaggagaagcugaagcggaaaagcuccuuuuaccagagcuaucucagacgcacccaaucuaugggaguccagcuggaccagcggauuaucauucuuuacaugauggaauggggcaagaugaugguugaucauuuccaccugggggacgauauggacuccgagcucagaaaagcgugccagagccugaucgaugaaaagguggcccaagugucuaaccaggaggcucugaaacucuga

SEQ ID NO: 7122 - RNA, 1272 nt, Artificial Sequence
  derived and/or modified CDS sequence (opt5) from LQUV(Longquan-Ra-14)__JX465414.1__N
auggccaccggcagagaccugcaggaugagcucgaacaaaucgagcaggaaauuacacaggcuaaggccaaauacgagaagcagaaagcggcuaucggggaggaacacgacacgauugagcugaaggugcuucaacagcgggaagagaccauccauaugcuggaagagaaacgcaaggagcuccugcagagaauugcccagcaaaugaaaagcccccggcagccugucaagggacgcgaucuugacgaagaugagcaccuguccgaaagaucuacacuccgguauggcaacguuaucgaccuggaggaacuggauaucgacgagccggccgggggaagcgcugauuggcucgccauuggcaucuacauuuucuccuuucccgugcagcugcuucugaagacccucuauauccugacaacccgcgggagacagacaauuaaagagaauaagggaaaccggcuucgcuucaaagacucuagcuccaccauggaugugaauggcgucaagacgccuagacaucuguacaucucucuccccaccgcucaaagcuccaugaagacagaagagauuaccccuggccgguaucgcacaguggccugcgggauccugagcggagaaaugagagcgcggaaacugguuucucccgugaugggcgucaucggguuuaacuaccucgccgagaaguggggagaauauauugacgcuuuccugaugaaacaguccccucaccuuccggugagcaccggcucucccgaguccgccacgaauuuugcuuaccugauccagcgccaagauguucucaacaagagcaaaacaguggaguaccuggaacuuugggagcaggccgaaaaggcggggagacaucuggucgaccggauugagucuccucucacccccuggcuguucgccggauccccugacagaugucccccgacaagccuguauguggcuggcaucgccgaacucggcgccuuuuucuccauucugcaggauauccgcaaugcuaucauggccucuaaacuuguggggaccgcugaggagaagcugaagcggaaaagcuccuuuuaccagagcuaucucagacgcacccaaucuaugggaguccagcuggaccagcggauuaucauucuuuacaugauggaauggggcaagaugaugguugaucacuuccaccugggggacgauauggacuccgagcucagaaaagcgugccagagccugaucgaugaaaagguggcccaagugucuaaccaggaggcucugaaacucuga

SEQ ID NO: 7123 - RNA, 1272 nt, Artificial Sequence
  derived and/or modified CDS sequence (opt5) from LQUV(Longquan-Ra-25)__JX465415.1__N
auggccaccggcagagaccugcaggaugagcucgaacaaaucgagcaggaaauuacacaggcuaaggccaaauacgagaagcagaaagcggcuaucggggaggaacccgacacgauugagcugaaggugcuucaacagcgggaagagaccauccacaugcuggaagagaaacgcaaggagcuccugcagagaauugcccagcaaaugaaaagcccuaagcagccggucaagggacgggaucuugacgaagaugagcaucuguccgaacgcucuacacucagauauggcaacguuaucgaccuggaggaacuggauaucgacgagcccgccgggggaagcgcugauuggcucgccauuggcaucuacauuuucuccuuuccugugcagcugcuucugaaaacccucuauauccugacaacccgggggcgccagacaauuaaggagaauaaaggaaacagacuucgguucaaggacucuagcuccaccauggaugugaauggcgucaagacgccccgccaccuguacaucucucucccuaccgcucaaagcuccaugaaaacagaagagauuacccccggcagauaucggacaguggccugcgggauccugagcggagaaaugcgcgcgagaaagcugguuucuccugugaugggcgucaucggguuuaacuaccucgccgagaaauggggagaauauauugacgcuuuccugaugaagcaguccccgcaucuucccgugagcaccggcucuccugaguccgccacgaauuuugcuuaccugauccagcggcaagauguucucaacaaaagcaagacaguggaguaccuggaacuuugggagcaggccgaaaaagcggggcgccaccuggucgacagaauugagucuccccucaccccuuggcuguucgccggaucccccgaccgguguccgccuacaagccuguauguggcuggcaucgccgaacucggcgccuuuuucuccauucugcaggauaucagaaaugcuaucauggccucuaaacuuguggggaccgcugaggagaagcugaagcgcaagagcuccuuuuaccagagcuaucuccggagaacccaaucuaugggcauucagcuggaccagcgcaucauuauccuuuacaugauggaauggggaaaaaugauggucgaucauuuccaccugggggacgauauggacuccgagcuccggaaggcgugccagagccugauugaugaaaaaguugcccaagugucuaaccaggaggcucugaagcucuga

SEQ ID NO: 7124 - RNA, 1287 nt, Artificial Sequence
  derived and/or modified CDS sequence (opt5) from NYV(RI-1)__U09488.1__N
augagcacccugaaggaggugcaggacaacaucacacuccacgaacaacagcuggucacggccagacagaaacuuaaggaugcugagaaagccguugaaguggaccccgaugacgugaauaaguccacccugcagggccggcgcgcggcugucucugcccucgagacaaaacugggggaacuuaagagacaacuggccgaucucauugcugcccagaagcuggcuagcaaaccuaucgacccgaccggaauugagcccgaugaccaucugaaggagaaauccucucuccgguacggcaacgugcuggauguuaauagcaucgaccuugaagaaccuuccgggcagacagccgauuggaaggcgauuggaauguauauccugucuuucgccauccccauuauccucaaagcucuguacaugcuuagcacccgcggcagacagacagugaaggaaaacaaggggacccggauucgcuuuaaagacgauuccagcuaugaggaggucaauggaaucagaaagccucggcaccuguacgugucuaugcccacggcccaauccaccaugaaagcugacgaaauuacaccuggccgcuucagaaccaucgccugcggccucuuuccggcgcagguuaaggcccggaacauuaucagccccgugaugggggucaucggauucaacuuuuucgugaaagacuggauggaucgcauugacgauuuucuggcugagagauguccuuuccugcccgaaccucgggaccccaaggaugccgcucucggcacaaaucgcgccuauuuuaucaccagacaggcccagguggacgagucuaaagucguugauauugaggagcugaucguggacgcucgggcggaguccgccacgcuuuucgcugauauugccacaccgcauagcgugugggucuuugccugcgcuccugacagaugucccccuaccgcccuguacguggcggggaugcccgaacucggagcuuucuuugccauccugcaagauaugcgcaauacaaucauggccucuaaguccguuggcaccgcugaggaaaaacuuaagaagaaaagcgccuucuaucaguccuaccugcggagaacccagucuauggggauucaacucgaccagaagaucauuauccuguacaugauucacuggggaaaagaggcugugaaccauuuccaccugggcgacgauauggaccccgaacuccgcgagcuggcccaggcgcuugucgaugccaaggugaaggagaucagcaaucaggaaccucugaaacucuga

SEQ ID NO: 7125 - RNA, 1302 nt, Artificial Sequence
  derived and/or modified CDS sequence (opt5) from PUUV(K27)__L08804.1__N
augagcgaccugaccgauauccaggaggaaauuacaagacacgagcaacagcucguggucgcccggcagaagcugaaagacgcugaacgcgccguugagguguaccccgaugacgugaucaagaacacgcuucaggcgagacaacagaccgucuccgcucuggaagauaaacucgccgacuauaagcggcgcauggccgaugcugugucucggaaaaagauggacacaaagccuaccgauccgacaggcauugagcccgacgaucaucugaaagagagaagcucccuucgcuacgggaauguucuggacgugaacgccaucgauauugaagaaccuucuggacagaccgcugacugguauacaaucggcgucuacgugaucggguucaccauucccaucauucucaaggcccuguauaugcugagcacgagaggacggcagaccguuaaagaaaauaagggcacacgcaucagauuuaaagacgauaccuccuucgaggacauuaacgggauccggcgcccuaagcaccucuacgugucuaugcccacagcgcaaagcaccaugaaggccgaggaacugacgccuggaagauuucggacaauugucugcggccuuuucccgacccagauccaggugcgcaauaucaugucccccgugaugggcgucauuggguuuagcuucuuuguuaaagauuggccugagaagaucagagaguucauggagaaagaaugucccuuuauuaagccugaggugaaacccggaacaccggcucaggagguggaguuccugaagcggaacagagucuauuuuaugacccgccaagacgugcucgauaaaaaucauguugccgacaucgauaagcugauugacuacgcugccucuggcgauccuaccucccccgacgauaucaagagcccuaacgcgcccuggguguucgccugcgcucccgaccggucuccuccgacauguaucuacgucgccgggauggcugaacuuggagccuuuuucuccauucugcaggacaugagaaauacgaucauggccagcaaaaccgugggcacagcugaagagaagcucaaacgcaagucuuccuucuaucagagcuaccugcggagaacccaauccauggggauucagcuggaucagcgcaucauucuccuguauaugcuugaauggggaaaagagaugguugaccacuuucaucugggcgaugacauggaucccgagcuccggggccuggcgcagucucuuaucgaccaaaaggugaaggaaaucagcaaccaggagccucugaaaauuuga

SEQ ID NO: 7126 - RNA, 1302 nt, Artificial Sequence
  derived and/or modified CDS sequence (opt5) from PUUV(KS13/855)__KX815394.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaccgauccgacaggcaucgaacccgacgaucaucugaaggagagaagcucccuucgguacgggaacgugcuggacguuaaugccauugacaucgaggaaccuucuggacagaccgcugauugguauacaauuggcguguacgucaucggguuuacccuccccaucauucugaaagcccuguauaugcucagcacgcgcggaagacagaccgugaaggagaacaaaggcacacggauccgcuucaaggacgauaccuccuuugaagacauuaaugggaucagacggccuaagcaccuguacguuucuaugcccacagcgcaaagcaccaugaaagccgaggagcuuacgccuggacgcuucagaacaauugugugcggccuguuuccgacccagauccagguccggaacauuaugucccccgugaugggcgugaucggguucagcuuuuucgucaaggauugggcugaacgcaucagagaguuuauggaaaaagaguguccuuucauuaagcccgaaguuaaaccuggaacacccgcccaggagguggaguuucucaagaaaaauaagguguauuucaugcaacggcaggacguccuggauaagaaccauguggcugacaucgauaaacuuauugacuacgccgcgucuggcgauccgaccuccccugacaauaucgaaagccccaacgccccuuggguuuuugcuugcgcccccgacagaugucccccuaccugcauuuauguggcugggauggccgagcugggagccuucuucucuauccuccaggauaugcgcaauacaaucauggcuuccaagacggucggcaccgcggaagagaaacugaagaaaaagagcucuuuuuaccaauccuaccugcggagaacacagagcauggggauucagcucgaccagcgcaucauucugcuuuauaugcuggaauggggaaaggagaugguggaucacuuccaucucggcgacgauauggacccggagcugcggggccuugcccaagcucugaucgaucagaaaguuaaggaaauuuccaaccaggagccccucaaaaucuga

SEQ ID NO: 7127 - RNA, 1302 nt, Artificial Sequence
  derived and/or modified CDS sequence (opt5) from PUUV(KS14/118)__KX815395.1__N
augagcgaccugaccgauauccaggaggacauuacaagacacgaacaacagcucguggucgcccggcagaagcugaaagaugcugagcgcgccguugaaguggaccccgaugacgugaacaagaauacgcuucaggcgagacaacagaccgucuccgcucuggaggauaaacucgccgacuucaagcggcgcauggccgaugcugugucucggaaaaagauggacacaaagccuaccgauccgacaggcaucgaacccgacgaucaucugaaagagagaagcucccuucgcuacgggaacguucuggacgugaaugccauugacaucgaggaaccuucuggacagaccgcugauugguauacaauuggcgucuacgugaucggguuuaccauccccauuauccucaaggcccuguauaugcugagcacgagaggacggcagaccguuaaagagaacaagggcacacgcauuagauucaaagacgauaccuccuuugaagacaucaaugggauucggcgcccuaagcaccucuacgugucuaugcccacagcgcaaagcaccaugaaggccgaggagcugacgccuggaagauuccggacaaucgucugcggccuuuuuccgacccagauucaggugcgcaacaucaugucccccgugaugggcgucaucggguucagcuuuuucguuaaaaauuggccugaaagaauuaaggaguuuauggaaaaagagugucccuucaucaagccugaagugaaacccggaacaccggcucaggagguggaguuucugaagcggaacaaagucuauuucaugaauagacaagaugugcucgacaagaaccauguugccgauauugacaagcugaucgauuacgcugccucuggcgacccuaccucccccgaugacauugaaagcccuaaugcgcccuggguguuugccugcgcucccgaccgcuguccuccgaccugcaucuaugucgccgggauggcugagcuuggagccuucuucucuauccugcaggauaugcggaacacaauuauggccuccaaaacggugggcaccgcugaagagaagcucaaaaagaaaagcucuuuuuaccaguccuaccugagacgcacacaaagcauggggauccagcuggaccagcggauuauccuccuguauaugcuugaauggggaaaggagaugguugaucacuuccaucugggcgacgauauggaccccgagcucagaggccuggcgcaggcccuuauugaucaaaaggugaaagaaaucuccaaucaggagccucugaagaucuga

SEQ ID NO: 7128 - RNA, 1302 nt, Artificial Sequence
  derived and/or modified CDS sequence (opt5) from PUUV(LT15/201)__KX757841.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaucgauccgaccggcauugaacccgacgaucaucugaaggagagaagcucccuucgguacgggaacgugcuggacguuaaugccaucgacauugaggaaccuucuggacagacagcugauugguauaccaucggcguguacgucaucggguuuacacuccccauuauccugaaagcccuguauaugcucagcacccgcggaagacagacggugaaggagaacaaaggcacccggauucgcuucaaggacgauacauccuuugaagacaucaaugggauuagacggccuaagcaccuguacguuucuaugcccaccgcgcaaagcacaaugaaagccgaggagcuuaccccuggacgcuucagaacgaucgugugcggccuguuuccgacacagauucagguccggaacaucaugucccccgugaugggcgugaucggguucagcuuuuucgucaaggauugggcugaacgcauuagagaguuuauggaaaaagaguguccuuucaucaagcccgaaguuaaaccuggaacccccgcccaggagguggaguuucucaagaaaaauaagguguauuucaugcaacggcaggacguccuggauaagaaccauguggcugacauugauaaacuuaucgacuacgccgcgucuggcgauccgacauccccugacaauauugaaagccccaacgccccuuggguuuuugcuugcgcccccgacagaugucccccuaccugcaucuauguggcugggauggccgagcugggagccuucuucucuauccuccaggauaugcgcaauaccauuauggcuuccaagacagucggcacggcggaagagaaacugaagaaaaagagcucuuuuuaccaauccuaccugcggagaacccagagcauggggauccagcucgaccagcgcauuauccugcuuuauaugcuggaauggggaaaggagaugguggaucacuuccaucucggcgacgauauggacccggagcugcggggccuugcccaagcucugauugaucagaaaguuaaggaaaucuccaaccaggagccccucaaaaucuga

SEQ ID NO: 7129 - RNA, 1302 nt, Artificial Sequence
  derived and/or modified CDS sequence (opt5) from PUUV(PUU/Ernstbrunn/Cg641/1995)__AJ888752.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaccgauccgacaggcaucgaacccgacgaucaucugaaggagagaagcucccuucgguacgggaacgugcuggacguuaaugccauugacaucgaggaaccuucuggacagaccgcugauugguauacaauuggcguguacgucaucggguuuacccuccccaucauucugaaagcccuguauaugcucagcacgcgcggaagacagaccgugaaggagaacaaaggcacacggauccgcuucaaggacgauaccuccuuugaagacauuaaugggaucaagagaccuaaacaccuguacguuucuaugcccacagcgcaaagcaccaugaaggccgagaaacuuacgccuggacgguuccgcacaauugugugcggccuguuuccgacccagauccaggucagaaacauuaugucccccgugaugggcgugaucggguucagcuuuuucgucaaggauuggucugagcggguucgcgacuuuauggaaaaagaguguccuuucaucaagcccgaaauuaaaccuggaacacccccgcaggaggcugaauuucucaagagaaauaagguguauuucaugcaacggcaggaugugcuggacaaaaaccaugucgccgauaucgacaaacuuauugauuacgcugccuccggcgacccuaccagccccgacaaucuggagucuccuaacgcgcccuggguguuugccugcgcucccgauagauguccuccgaccugcaucuauguugccgggauggcugagcucggagccuucuucuccauucugcaggacaugcgcaauacaaucauggccagcaagacggugggcaccgcugaagagaagcugaaaaagaagucuuccuuuuaccaaagcuaccuccggagaacacaguccauggggauccagcuggaucagcgcauuauccuucuguauaugcucgaauggggaaaagagauggucgaccacuuccaucugggcgaugacauggaucccgaacuucggggccuggcgcaagcccucauugaccagaaggugaaagagaucucuaaccaggagccucugaagauuuga

SEQ ID NO: 7130 - RNA, 1302 nt, Artificial Sequence
  derived and/or modified CDS sequence (opt5) from PUUV(PUU/Klippitztoerl/Cg9/1995)__AJ888751.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaccgauccgacaggcaucgaacccgacgaucaucugaaggagagaagcucccuucgguacgggaacgugcuggacguuaaugccauugacaucgaggaaccuggaggccagaccgcugauugguauacaauugggguguacgucaucggauuuacccuccccaucauucugaaagcccuguauauguucucuacgcgcggcagacagaccgugaaggagaacaaagggacacggauccgcuuuaaggacgauaccagcuucgaagacauuaauggaaucagacggccuaagcaccucuacguuuccaugcccacagcgcaaucuaccaugaaagccgaggagcugacgccuggccgcuuuagaacaauugugugcggccuuuucccgacccagauccagguccggaacauuaugagccccgugaugggggugaucggauuuuccuucuuugucaaggauuggagcgaacgcguuagagacuucauggagaaagaauguccuuuuaucaagcccgagauuaaaccuggcacacccccgcaggaagcugaguuccugaagcggaauaaaguguauuuuaugcaaagacaggaugugcucgacaagaaccaugucgccgauaucgacaagcugauugauuacgcugccucuggggacccuaccucccccgacaaucuugagagcccuaacgcgcccuggguguucgccugcgcucccgaucgcuguccuccgaccugcaucuauguugccggaauggcugaacugggcgccuucuuuucuauucuccaggacaugcggaauacaaucauggccuccaaaacgguggggaccgcugaggaaaagcugaaaaagaaaagcucuuucuaccaauccuaccugagacgcacacagagcaugggaauccagcucgaucagcggauuauccugcuuuauaugcuggaguggggcaaggaaauggucgaccacuuucaucucggcgaugacauggaucccgagcugagagggcuugcgcaagcccugauugaccagaaggugaaagagaucuccaaccaggaaccucucaagauuuga

SEQ ID NO: 7131 - RNA, 1302 nt, Artificial Sequence
  derived and/or modified CDS sequence (opt5) from PUUV(Balkan-1)__AJ314600.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaccgauccgacaggcaucgaacccgacgaucaucugaaggagagaagcucccuucgguacgggaacgugcuggacguuaaugccauugacaucgaggaaccuucuggacagaccgcugauugguauacaauuggcguguacgucaucggguuuacccuccccaucauucugaaagcccuguauaugcucagcacgcgcggaagacagaccgugaaggagaacaaaggcacacggauccgcuucaaggacgauaccuccuuugaagacauuaaugggaucagacggccuaagcaccuguacguuucuaugcccacagcgcaaagcaccaugaaagccgaggagcuuacgccuggacgcuucagaacaauugugugcggccuguuuccgacccagauccagguccggaacauuaugucccccgugaugggcgugaucggguucagcuuuuucgucaaggauuggucugaacgcguuagagaguuuauggaaaaagaguguccuuucaucaagcccgaaauuaaaccuggaacacccccgcaggaggcugaguuucucaagcggaauaaaguguauuucaugcaaagacaggacgugcuggauaagaaccaugucgccgacaucgauaaacuucuggacuacgcugccuccggcgauccuaccagccacgacaauauugaaucucccaacgcgccuuggguguuugccugcgcucccgaccgcugucccccuaccugcaucuauguugccgggauggcugagcucggagccuucuucuccauucugcaggauaugcggaauacaaucauggccagcaagacggugggcaccgcugaagagaagcugaaaaagaaaucuuccuuuuaccaaagcuaccucagacgcacacaguccauggggauccagcuggaccagcggauuauccuucuguauaugcucgaauggggaaaggagauggucgaucauuuccaccugggcgacgauauggacccggagcuuagaggccuggcgcaagcccucauugaucagaaggugaaagaaaucucuaaccaggagccccugaagauuuga

SEQ ID NO: 7132 - RNA, 1302 nt, Artificial Sequence
  derived and/or modified CDS sequence (opt5) from PUUV(Balkan-2)__AJ314601.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaccgauccgacaggcaucgaacccgacgaucaucugaaggagagaagcucccuucgguacgggaacgugcuggacguuaaugccauugacaucgaggaaccuucuggacagaccgcugauugguauacaauuggcguguacgucaucggguuuacccuccccaucauucugaaagcccuguauaugcucagcacgcgcggaagacagaccgugaaggagaacaaaggcacacggauccgcuucaaggacgauaccuccuuugaagacauuaaugggaucagacggccuaagcaccuguacguuucuaugcccacagcgcaaagcaccaugaaagccgaggagcuuacgccuggacgcuucagaacaauuguguuuggccuguucccgacccagauccagguccggaacauuaugucccccgugaugggcgugaucggguuuagcuucuuugucaaggauuggucugaacgcguuagagaguucauggaaaaagagugcccuuuuaucaagcccgaaauuaaaccuggagcucccccgcaggaggccgaguuccucaagcggaauaaaguguauuuuaugcaaagacaggacgugcuggauaagaaccaugucgcugacaucgauaaacuuauugacuacgccgcguccggcgauccuacaagccccgacaauaucgaaucuccuaacgcccccuggguguucgcuugugcccccgaccgcugcccuccgaccuguauuuauguugcugggauggccgagcugggagccuucuuuuccauccuccaggauaugcggaauaccaucauggcuagcaagacagugggcacggcggaagagaagcugaaaaagaaaucuuccuucuaccaaagcuaccugagacgcacccaguccauggggauucagcucgaccagcggaucauucugcuuuauaugcuggaauggggaaaggagauggucgaucacuuucaucucggcgacgauauggaccccgagcugagaggccuugcccaagcucugaucgaucagaaggugaaagaaauuucuaaccaggagccucucaagaucuga

SEQ ID NO: 7133 - RNA, 1302 nt, Artificial Sequence
  derived and/or modified CDS sequence (opt5) from PUUV(Baltic/205Cg/00)__AJ314599.1__N
augagcgaccuggccgauauccaggaggacauuaccagacacgaacaacagcucguggucgcucggcagaagcugaaagaugccgagcgcgcgguugaaguggaccccgaugacgugaacaagaauacacuucaggcuagacaacagacggucuccgcccuggaggauaaacucgccgacuacaagcggcgcauggcugaugccgugucuagaaagaagauggacaccaagccuacagauccgaccggcaucgaacccgacgaucaucugaaagagcggagcucccuucgcuaugggaacguucuggacgugaaugcuauugacaucgaggaaccuucuggacagacagccgauugguacaccauuggcgucuaugugaucggguucacacuccccaucauucugaaggcgcuguacaugcucagcaccagaggacggcagacgguuaaagagaacaagggcacccgcaucagauuuaaagacgauacauccuucgaagacauuaaugggauccggcgcccuaagcaccuguaugugucuaugcccaccgcccaaagcacaaugaaggcugaggagcuuaccccuggaagauuucggacgauugucugcggccuguucccgacacagauccaggugcgcaacauuaugucccccgugaugggcgucaucggguuuagcuucuuuguuaaagauuggccugaaagaaucaaggaguucauggaaaaagagugucccuuuauuaagccugaagugaaacccggaaccccgacacaggagguggaguuccucaagcggaauaaagucuacuuuaugaacagacaagacgugcuggauaagaaucauguugccgacaucgauaaacuuauugacuaugcugccucuggcgauccuaccucccccgacgacaucgaaagcccuaacgcgcccuggguguucgccugcgcucccgaucgcuguccuccgaccugcauuuacgucgccgggauggcugagcugggagccuuuuucucuauccuccaggacaugcgguccacaaucauggccagcaaaacggugggcaccgcugaagagaagcugaaaaagaaaucuuccuucuaccagagcuaucugagacgcacacaauccauggggauucagcucgaucagcggaucauucugcuuuacaugcuggaauggggaaaggagaugguugaccacuuucaucucggcgaugacauggaucccgagcugagaggccuugcgcaggcccugaucgaccaaaaggugaaagaaauuucuaaucaggagccucucaagaucuga

SEQ ID NO: 7134 - RNA, 1302 nt, Artificial Sequence
  derived and/or modified CDS sequence (opt5) from PUUV(Baltic/49Cg/00)__AJ314598.1__N
augagcgaccuggccgauauccaggaggacauuaccagacacgaacaacagcucguggucgcucggcagaagcugaaagaugccgagcgcgcgguugaaguggaccccgaugacgugaacaagaauacacuucaggcuagacaacagacggucuccgcccuggaggauaaacucgccgacuacaagcggcgcauggcugaugccgugucuagaaagaagauggacaccaagccuacagauccgaccggcaucgaacccgacgaucaucugaaagagcggagcucccuucgcuaugggaacguucuggacgugaaugcuauugacaucgaggaaccuucuggacagacagccgauugguacaccauuggcgucuaugugaucggguucacacuccccaucauucugaaggcgcuguacaugcucagcaccagaggacggcagacgguuaaagagaacaagggcacccgcaucagauuuaaagacgauacauccuucgaagacauuaaugggauccggcgcccuaagcaccuguaugugucuaugcccaccgcccaaagcacaaugaaggcugaggagcuuaccccuggaagauuucggacgauugucugcggccuguucccgacacagauccaggugcgcaacauuaugucccccgugaugggcgucaucggguuuagcuucuuuguuaaagauuggccugaaagaaucaaggaguucauggaaaaagagugucccuuuauuaagccugaagugaaacccggaaccccggcccaggagguggaguuccucaagcggaauaaagucuacuuuaugaacagacaagacgugcuggauaagaaucauguugcugacaucgauaaacuuauugacuaugccgcgucuggcgauccuacaucccccgacgacaucgaaagcccuaacgcccccuggguguucgcuugcgcccccgaucgcuguccuccgaccugcauuuacgucgcugggauggccgagcugggagccuuuuucucuauccuccaggacaugcggaauaccaucauggcuuccaaaacagugggcacggcggaagagaagcugaaaaagaaaagcucuuucuaccaguccuaucugagacgcacccaaagcauggggauucagcucgaucagcggaucauucugcuuuacaugcuggaauggggaaaggagaugguugaccacuuucaucucggcgaugacauggaucccgagcugagaggccuugcccaggcucugaucgaccaaaaggugaaagaaauuuccaaccaggagccucucaagaucuga

SEQ ID NO: 7135 - RNA, 1302 nt, Artificial Sequence
  derived and/or modified CDS sequence (opt5) from PUUV(Pallasjarvi/63Cg/98)__AJ314597.1__N
augagcgaccugaccgauauccaggaggacauuacaagacacgaacaacagcucguggucgcccggcagaagcugaaagaugcugagcgcgccguugaaguggaccccgaugacgugaacaagaauacgcuucaggcgagacaacagaccgucuccgcucuggaggauaaacucgccgacuacaagcggcgcauggccgaugcugugucuagaaagaagauggacacaaagccuaccgauccgacaggcaucgaacccgacgaucaucugaaagagcggagcucccuucgcuaugggaacguucuggacgugaaugccauugacaucgaggaaccuucuggacagaccgcugauugguacacaauuggcgucuaugugaucggguucacccuccccaucauucugaaggcccuguacaugcucagcacgagaggacggcagaccguuaaagagaacaagggcacacgcaucagauuuaaagacgauaccuccuucgaagacauuaaugggauccggcgcccuaagcaccuguaugugucuaugcccacagcgcaaagcaccaugaaggccgaggagcuuacgccuggaagauuucggacaauugucugcggccuguucccgacccagauccaggugcgcaacauuaugucccccgugaugggcgucaucggguuuagcuucuuuguuaaagauuggucugaaagaauccgggaguucauggaaaaggaguguccuuuuauuaaacccgaagugaagccuggaacacccgcucaggagguggagaugcucaaaagaaauaagaucuacuucaugcaacgccaggacguccuggauaaaaaccauguggccgacauugauaaacuuaucgacuaugcugccuccggcgauccgaccagcccugacaauauugacucucccaacgcgccuuggguuuuugccugcgcucccgaucggugucccccuaccugcaucuacguggccgggauggcugaacugggagccuucuuuuccauccuccaggacaugagaaauacaauuauggccagcaagacggucggcaccgcugaggaaaaacugaagaaaaagucuuccuucuaccaaagcuaucugcgccggacacaguccauggggauccagcucgaucagagaauuauccugcuuuucaugcuggaguggggaaaagaaaugguggaccacuuucaucucggcgaugacauggauccggagcugcgcggccuugcgcaagcccugauugaccagaagguuaaggagaucucuaaccaggaaccccucaaaaucuga

SEQ ID NO: 7136 - RNA, 1302 nt, Artificial Sequence
  derived and/or modified CDS sequence (opt5) from PUUV(Sotkamo 2009)__HE801633.1__N
augagcgaccugaccgauauccaggaggacauuacaagacacgaacaacagcucaucguggcccggcagaagcugaaagaugcugagcgcgccgucgaaguugaccccgaugacgugaacaagaauacgcuucaggcgagacaacagaccguguccgcucuggaggauaaacucgccgacuacaagcggcgcauggccgaugcugucucuagaaagaagauggacacaaagccuaccgauccgacaggcauugaacccgacgaucaucugaaagagcggagcucccuucgcuaugggaacgugcuggacguuaaugccaucgacauugaggaaccuucuggacagaccgcugauugguacacaaucggcguguaugucaucggguucacccuccccauuauccugaaggcccuguacaugcucagcacgagaggacggcagaccgugaaagagaacaagggcacacgcauuagauuuaaagacgauaccuccuucgaagacaucaaugggauucggcgcccuaagcaccuguauguuucuaugcccacagcgcaaagcaccaugaaggccgaggagcuuacgccuggaagauuucggacaaucgugugcggccuguucccgacccagauucagguccgcaacaucaugucccccgugaugggcgugaucggguuuagcuucuuugucaaagauuggucugaacggauuagagaguucauggaaaaggaguguccuuuuaucaaacccgaaguuaagccuggaacacccgcucaggagauugagaugcucaaaagaaauaagaucuacuucaugcaacgccaggacgugcuggauaaaaaccauguggccgacauugauaaacuuaucgacuaugcugccuccggcgauccgaccagcccugacaauaucgacucucccaacgcgccuugggucuuugccugcgcucccgaucggugucccccuaccugcauuuacguggccgggauggcugaacugggagccuucuuuuccauccuccaggacaugagaaauacaauuauggccagcaagacgguuggcaccgcugaggaaaaacugaagaaaaagucuuccuucuaccaaagcuaucugcgccggacacaguccauggggauccagcucgaucagagaauuauccugcuuuucaugcuggaguggggaaaagaaaugguggaccacuuucaucucggcgaugacauggauccggagcugcgcggccuugcgcaagcccugaucgaccagaaggucaaggagauuucuaaccaggaaccccucaaaaucuga

SEQ ID NO: 7137 - RNA, 1302 nt, Artificial Sequence
  derived and/or modified CDS sequence (opt5) from PUUV(CG 13891)__U22423.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacagauggccgaugcugucucucggaagaagauggacacaaaaccuaccgauccgacaggcaucgaacccgacgaucaucugaaggagcgcagcucccuuagauacgggaacgugcuggacguuaaugccauugacaucgaggaaccuucuggacagaccgcugauugguauacaauuggcguguacgucaucggguuuacccuccccaucauucugaaagcccuguauaugcucagcacgcggggacgccaaaccgugaaggagaacaaaggcacaagaauccgguucaaggacgauaccuccuuugaagacauuaaugggauccgcagaccuaagcaccuguacguuucuaugcccacagcgcagagcaccaugaaagccgaggagcuuacgccuggacgguuccgcacaauugugugcggccuguuuccgacccagauccaggucagaaacauuaugucccccgugaugggcgugaucggguucagcuuuuucgucaaggauugggcugaccggauccgcgaaucuauggagaaagaauguccuuuucucaagcccgauguuaaaccuggaacacccgcccaagagaccgaguuccugaagagaaauaaaauuuauuuuaugcagcggcaggaagugcuugacaagaaccauguggcugagaucgauaagcugauugacuacgccgcguccggcgauccgaccagcccugacaauaucgaaucucccaacgccccuugggucuucgcuugcgcccccgacagaugucccccuacaugcauuuauguggcugggauggccgagcucggagccuuuuucuccauccugcaagauaugcgcaauacgaucauggcuagcaaaaccguuggcacagcggaagagaagcugaaaaagaaaucuuccuucuaccagagcuaccuccggagaacccaguccauggggauucagcuggaccaacgcaucauucuucuguauaugcucgaauggggaaaggagaugguggaucacuuucaucugggcgacgauauggacccggagcuucggggccuggcccaggcucucaucgaucagaaggucaaagaaauuucuaaccaggagccccugaagaucuga

SEQ ID NO: 7138 - RNA, 1302 nt, Artificial Sequence
  derived and/or modified CDS sequence (opt5) from PUUV(CG1820)__M32750.1__N
augagcgaccugaccgauauccaggaggaaauuacaagacacgagcaacagcucguggucgcccggcagaagcugaaagacgcugaacgcgccguugagguggaucccgacgaugugaacaaguccacgcuucaggcgagacaacagaccgucucugcucuggaagacaaacucgccgauuacaagcggcgcauggccgacgcugugagccggaaaaagauggauacaaagccuaccgacccgacaggcaucgagcccgaugaccaucugaaagagagauccucucuucgcuaugggaauguucuggaugugaacgccauugacaucgaagaaccuagcggacagaccgcugacugguacacaauuggcgucuaugugaucggguucaccauccccauuauccucaaggcccuguacaugcuguccacgagaggacggcagaccguuaaagaaaauaagggcacacgcauuagauuuaaagaugacaccucuuucgaggauaucaacgggauucggcgcccuaagcaccucuaugugagcaugcccacagcgcaauccaccaugaaggccgaggaacugacgccuggaagauuucggacaaucgucugcggccuuuucccgacccagauucaggugcgcaauaucaugagccccgugaugggcgucaucggguuuucuuucuuuguuaaagacuggccugagaagauuagagaguucauggagaaagaaugucccuuuaucaagccugaggugaaacccggaacaccggcucaggagguggaguuccugaagcggaacagagucuacuuuaugacccgccaagaugugcucgacaaaaaucauguugccgauauugacaagcugaucgauuaugcugccuccggcgacccuaccagccccgaugacauugaaucuccuaacgcgcccuggguguucgccugcgcucccgaccgguguccuccgacaugcaucuacgucgccgggauggcugaacuuggagccuuuuucuccauccugcaggauaugagaaauacgauuauggccagcaagaccgugggcacagcugaggaaaaacucaagaaaaagucuuccuucuaccagagcuaucugcgccggacccaauccauggggauccagcuggaccagagaauuauccuccuguacaugcuugaguggggacgcgagaugguugaucacuuucaucugggcgacgauauggaccccgaacuccggggccuggcgcagucucuuauugaucaaaaagugaaggagaucagcaaccaggaaccucugaagaucuga

SEQ ID NO: 7139 - RNA, 1302 nt, Artificial Sequence
  derived and/or modified CDS sequence (opt5) from PUUV(Bussjo_95-1)__AM746297.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaccgauccgacaggcaucgaacccgacgaucaucugaaggagagaagcucccuucgguacgggaacgugcuggacguuaaugccauugacaucgaggaaccuucuggacagaccgcugauugguauacaauuggcguguacgucaucggguuuacccuccccaucauucugaaagcccuguauaugcucagcacgcgcggaagacagaccgugaaggagaacaaaggcacacggauccgcuucaaggacgauaccuccuuugaagacauuaaugggaucagacggccuaagcaccuguacguuucuaugcccacagcgcaaagcaccaugaaagccgaggagcuuacgccuggacgcuucagaacaauugugugcggccuguuuccgacccagauccagguccggaacauuaugucccccgugaugggcgugaucggguucagcuuuuucgucaaggauuggccugaccgcaucagagaauuuauggagaaagaaugucccuucauuaagccugagguuaaacccggaacaccgacccaggaaaucgaguuucucaagaaaaauaagguguauuucauggaucggcaaaacgugcuggacaagaaucaugucgcugauauugacaaacuuaucgauuacgccgcuucuggcgacccuaccucccccgacaacauugagagcccuaaugcccccuggguguuugcgugcgcccccgauagauguccuccgacaugcaucuauguugcugggauggccgaacugggagcuuucuucucuauccuccaggacaugcgcaacacgauuauggccuccaagaccgugggcacagccgaggaaaaacugaagaaaaagagcucuuuuuaccaguccuaccugcggagaacccaaagcauggggauccagcucgaucagcgcauuauccugcuuuauaugcuggaguggggaaaggaaauggucgaccacuuccaucucggcgaugacauggaucccgagcugcggggccuugcucaggcgcugauugaccaaaaagugaaggagaucuccaaucaggauccucucaaaaucuga

SEQ ID NO: 7140 - RNA, 1302 nt, Artificial Sequence
  derived and/or modified CDS sequence (opt5) from PUUV(CG144)__AF367064.1__N
augagcgaccugaccgauauccaggaggacauuacaagacacgaacaacagcucguggccgcucggcagaagcugaaagaugccgagcgcgcggucgaaauggaccccgaugacguuaacaagaauacgcuucaggcuagacaacagaccguguccgcccuggaggauaaacucgccgacuacaagcggcgcauggcugaugccgugucuagaaagaagauggacacaaagccugcugauccgaccggcaucgaacccgacgaucaucugaaagagcggagcucccuucgcuaugggaacguccuggacgugaaugccauugacaucgaggaaccuucuggacagacagcggauugguacaccauuggcaucuauguuaucggguucacacuccccauuauccugaaggcccuguacaugcucagcaccagaggacggcagacggugaaagagaacaagggcacccgcauuagauuuaaagacgauacauccuucgaagacaucaaugggauucggcgcccuaagcaccuguaugucucuaugcccaccgcucaaagcacaaugaaggccgaggagcuuaccccuggaagauuucggacgaucgugugcggccuguucccgacacagauucagguucgcaacaucaugucccccgugaugggcgucaucggguuuagcuucuuugugaaagauuggccugaacggauuagagaguucauggaaaaggagugucccuuuaucaaaccugaagugaagcccggaaccccggcucaggagauugagaugcucaaaaagaauaaaaucuacuucaugcauagacaagacguccuggauaagaaccacguugccgacauugauaaacuuaucgacuaugcggccucuggcgauccuacaucccccgacaauaucgacagcccuaacgcucccuggguguuugccugcgcucccgaucgcuguccuccgaccugcauuuacguggccgggauggccgaacugggagcuuucuuuucuauccuccaggacaugcggaauaccauuauggcguccaaaacagucggcacggccgaggaaaagcugaaaaagaaaagcucuuucuaccaguccuaucugagacgcacccaaagcauggggauccagcucgaucagcggauuauccugcuuuacaugcuggaguggggaaaggaaaugguggaccauuuccaccucggcgaugacauggaucccgagcugagaggccuugcucaggcccugaucgaccaaaagguuaaagagauuuccaaccaggaaccucucaagaucuga

SEQ ID NO: 7141 - RNA, 1302 nt, Artificial Sequence
  derived and/or modified CDS sequence (opt5) from PUUV(CG168)__AF367065.1__N
augagcgaccugaccgauauccaggaggacauuacaagacacgaacaacagcucguggccgcucggcagaagcugaaagaugccgagcgcgcggucgaaauggaccccgaugacguuaacaagaauacgcuucaggcuagacaacagaccguguccgcccuggaggauaaacucgccgacuacaagcggcgcauggcugaugccgugucuagaaagaagauggacacaaagccugcugauccgaccggcaucgaacccgacgaucaucugaaagagcggagcucccuucgcuaugggaacguccuggacgugaaugccauugacaucgaggaaccuucuggacagacagcggauugguacaccauuggcguuuaugugaucggguucacacuccccaucauucugaaggcccuguacaugcucagcaccagaggacggcagacggucaaagagaacaagggcacccgcaucagauuuaaagacgauacauccuucgaagacauuaaugggauccggcgcccuaagcaccuguaugugucuaugcccaccgcucaaagcacaaugaaggccgaggagcuuaccccuggaagauuucggacgauuguuugcggccuguucccgacacagauccaggugcgcaacauuaugucccccgucaugggcgugaucggguuuagcuucuuugugaaagauuggccugaaagaauccgggaguucauggaaaaggagugucccuuuauuaaaccugaagucaagcccggaaucccggcucaggagauugagaugcucaaaaagaauaaaaucuacuucaugcauagacaagacguucuggauaagaaccacguggccgacauugauaaacuuaucgacuaugcggccucuggcgauccuaccucccccgacaauaucgacagcccuaacgcucccuggguguuugccugcgcucccgaucgcuguccuccgacaugcauuuacgucgccgggauggccgaacugggagcuuucuuuucuauccuccaggacaugcggaauaccauuauggcguccaaaaccgugggcacagccgaggaaaagcugaaaaagaaaagcucuuucuaccaguccuaucugagacgcacgcaaagcauggggauccagcucgaucagcggauuauccugcuuuacaugcuggaguggggaaaggaaaugguugaccauuuccaccucggcgaugacauggaucccgagcugagaggccuugcucaggcccugaucgaccaaaaggugaaagagauuuccaaccaggaaccucucaagaucuga

SEQ ID NO: 7142 - RNA, 1302 nt, Artificial Sequence
  derived and/or modified CDS sequence (opt5) from PUUV(CG17/Baskiria-2001)__AF442613.1__N
augagcgaccuggccgauauccaggaggaaauuaccagacacgagcaacagcucguggcugcccggcagaagcugaaagacgcggaacgcgcugucgagguugaucccgacgaugugaacaagaauacacuucaggccagacaacagacgguguccgcccuggaagacaaacucgcugauuacaagcggcgcauggccgacgcugucucucggaaaaagauggauaccaagccuacagacccgaccggcaucgagcccgaugaccaucugaaagagagaagcucccuucgcuaugggaacgugcuggauguuaaugccauugacaucgaagaaccuucuggacagacagcggacugguacaccauuggcguguaugucaucggguucacaauccccauuauccucaaggcccuguacaugcugagcaccagaggacggcagacggugaaagaaaacaagggcacccgcauuagauuuaaagaugacacauccuucgaggauaucaaugggauucggcgcccuaagcaccucuauguuucuaugcccaccgcucaaagcacaaugaaggccgaggaacugaccccuggaagauuucggacgaucgugugcggccuuuucccgacacagauucagguccgcaacaucaugucccccgugaugggcgugaucggguuuagcuucuuugucaaagacuggccugagaagauuagagaauuuauggagaaagaaugucccuuuaucaagccugagguuaaacccggaaccccggcucaggagguggaguuccugaagcggaauagaguguacuuuaugacacgccaagauguccucgacaaaaaccauguggccgauauugacaagcugaucgauuaugcggccucuggcgacccuaccucccccgaugacauugagagcccuaaugcucccuggguuuucgccugcgcucccgaccgguguccuccgaccugcaucuacguggccgggauggccgaacuuggagcuuucuucucuauccugcaggauaugagaaacacaauuauggcguccaagacggucggcaccgccgaggaaaaacucaagaaaaagagcucuuucuaccaguccuaucugcgccggacacaaagcauggggauccagcuggaccagagaauuauccuccuguacaugcuugaguggggaaaagagaugguggaucacuuucaucugggcgacgauauggaccccgaacuccgcggccuggcucagucccuuauugaucaaaagguuaaggagaucucuaaucaggaaccucugaaaaucuga

SEQ ID NO: 7143 - RNA, 1302 nt, Artificial Sequence
  derived and/or modified CDS sequence (opt5) from PUUV(CG215)__AF367066.1__N
augagcgaccugaccgauauccaggaggacauuacaagacacgaacaacagcucguggccgcucggcagaagcugaaagaugccgagcgcgcggucgaaauggaccccgaugacguuaacaagaauacgcuucaggcuagacaacagaccguguccgcccuggaggauaaacucgccgacuacaagcggcgcauggcugaugccgugucuagaaagaagauggacacaaagccugcugauccgaccggcaucgaacccgacgaucaucugaaagagcggagcucccuucgcuaugggaacguccuggacgugaaugccauugacaucgaggaaccuucuggacagacagcggauugguacaccauuggcguuuaugugaucggguucacacuccccaucauucugaaggcccuguacaugcucagcaccagaggacggcagacggucaaagagaacaagggcacccgcaucagauuuaaagacgauacauccuucgaagacauuaaugggauccggcgcccuaagcaccuguaugugucuaugcccaccgcucaaagcacaaugaaggccgaggagcuuaccccuggaagauuucggacgauuguuugcggccuguucccgacacagauccaggugcgcaacauuaugucccccgucaugggcgugaucggguuuagcuucuuugugaaagauuggccugaaagaauccgggaguucauggaaaaggagugucccuuuauuaaaccugaagucaagcccggaaccccggcucaggagaucgagaugcucaaaaagaauaaaauuuacuucaugcauagacaagacguucuggauaagaaccacguggccgacaucgauaaacuuauugacuaugcggccucuggcgauccuacaucccccgacaauaucgacagcccuaacgcucccuggguguuugccugcgcucccgaucgcuguccuccgaccugcaucuacgucgccgggauggccgaacugggagcuuucuuuucuauucuccaggacaugcggaauaccaucauggcguccaaaacagugggcacggccgaggaaaagcugaaaaagaaaagcucuuucuaccaguccuaucugagacgcacccaaagcauggggauucagcucgaucagcggaucauucugcuuuacaugcuggaguggggaaaggaaaugguugaccauuuccaccucggcgaugacauggaucccgagcugagaggccuugcucagacacugaucgaccaaaaggugaaagagaucuccaaccaggaaccucucaagauuuga

SEQ ID NO: 7144 - RNA, 1302 nt, Artificial Sequence
  derived and/or modified CDS sequence (opt5) from PUUV(CG315)__AF367068.1__N
augagcgaccugaccgauauccaggaggacauuacaagacacgaacaacagcucguggccgcucggcagaagcugaaagaugccgagcgcgcggucgaaauggaccccgaugacguuaacaagaauacgcuucaggcuagacaacagaccguguccgcccuggaggauaaacucgccgacuacaagcggcgcauggcugaugccgugucuagaaagaagauggacacaaagccugcugauccgaccggcaucgaacccgacgaucaucugaaagagcggagcucccuucgcuaugggaacguccuggacgugaaugccauugacaucgaggaaccuucuggacagacagcggauugguacaccauuggcguuuaugugaucggguucacacuccccaucauucugaaggcccuguacaugcucagcaccagaggacggcagacggucaaagagaacaagggcacccgcaucagauuuaaagacgauacauccuucgaagacauuaaugggauccggcgcccuaagcaccuguaugugucuaugcccaccgcucaaagcacaaugaaggccgaggagcuuaccccuggaagauuucggacgauuguuugcggccuguucccgacacagauccaggugcgcaacauuaugucccccgucaugggcgugaucggguuuagcuucuuugugaaagauuggccugaaagaauccgggaguucauggaaaaggagugucccuuuaugaaaccugaagucaagcccggaaccccggcucaggagauugagaugcucaaaaagaauaaaaucuacuucaugcauagacaagacguucuggauaagaaccacguggccgacauugauaaacuuaucgacuaugcggccucuggcgauccuacaucccccgacaauauugacagcccuaacgcucccuggguguuugccugcgcucccgaucgcuguccuccgaccugcaucuacgucgccgggauggccgaacugggagcuuucuuuucuauccuccaggacaugcggaauaccauuauggcguccaaaacagugggcacggccgaggaaaagcugaaaaagaaaagcucuuucuaccaguccuaucugagacgcacccaaagcauggggauccagcucgaucagcggauuauccugcuuuacaugcuggaguggggaaaggaaaugguugaccauuuccaccucggcgaugacauggaucccgagcugagaggccuugcucaggcccugauugaccaaaaggugaaagagaucuccaaccaggaaccucucaagaucuga

SEQ ID NO: 7145 - RNA, 1302 nt, Artificial Sequence
  derived and/or modified CDS sequence (opt5) from PUUV(CRF161)__AF367069.1__N
augagcgaccugaccgauauccaggaggacauuacaagacacgaacaacagcucguggccgcucggcagaagcugaaagaugccgagcgcgcggucgaaauggaccccgaugacguuaacaagaauacgcuucaggcuagacaacagaccguguccgcccuggaggauaaacucgccgacuacaagcggcgcauggcugaugccgugucuagaaagaagauggacacaaagccugcugauccgaccggcaucgaacccgacgaucaucugaaagagcggagcucccuucgcuaugggaacguccuggacgugaaugccauugacaucgaggaaccuucuggacagacagcggauugguacaccauuggcguuuaugugaucggguucacacuccccaucauucugaaggcccuguacaugcucagcaccagaggacggcagacggucaaagagaacaagggcacccgcaucagauuuaaagacgauacauccuucgaagacauuaaugggauccggcgcccuaagcaccuguaugugucuaugcccaccgcucaaagcacaaugaaggccgaggagcuuaccccuggaagauuucggacgauuguuugcggccuguucccgacacagauccaggugcgcaacauuaugucccccgucaugggcgugaucggguuuagcuucuuugugaaagauuggccugaaagaauccgggaguucauggaaaaggagugucccuuuauuaaaccugaagucaagcccggaaccccggcucaggagaucgagaugcucaaaaagaauaaaauuuacuucaugcauagacaagacguucuggauaagaaccacguggccgacaucgauaaacuuauugacuaugcggccucuggcgauccuacaucccccgacaauaucgacagcccuaacgcucccuggguguuugccugcgcucccgaucgcuguccuccgaccugcaucuacgucgccgggauggccgaacugggagcuuucuuuucuauucuccaggacaugcggaauaccaucauggcguccaaaacagugggcacggccgaggaaaagcugaaaaagaaaagcucuuucuaccaguccuaucugagacgcacccaaagcauggggauucagcucgaucagcggaucauucugcuuuacaugcuggaguggggaaaggaaaugguugaccauuuccaccucggcgaugacauggaucccgagcugagaggccuugcucaggcccugaucgaccaaaaggugaaagagaucuccaaccaggaaccucucaagauuuga

SEQ ID NO: 7146 - RNA, 1302 nt, Artificial Sequence
  derived and/or modified CDS sequence (opt5) from PUUV(CRF308)__AF367070.1__N
augagcgaccugaccgauauccaggaggacauuacaagacacgaacaacagcucguggccgcucggcagaagcugaaagaugccgagcgcgcggucgaaauggaccccgaugacguuaacaagaauacgcuucaggcuagacaacagaccguguccgcccuggaggauaaacucgccgacuacaagcggcgcauggcugaugccgugucuagaaagaagauggacacaaagccugcugauccgaccggcaucgaacccgacgaucaucugaaagagcggagcucccuucgcuaugggaacguccuggacgugaaugccauugacaucgaggaaccuucuggacagacagcggauugguacaccauuggcguuuaugugaucggguucacacuccccaucauucugaaggcccuguacaugcucagcaccagaggacggcagacggucaaagagaacaagggcacccgcaucagauuuaaagacgauacauccuucgaagacauuaaugggauccggcgcccuaagcaccuguaugugucuaugcccaccgcucaaagcacaaugaaggccgaggagcuuaccccuggaagauuucggacgauuguuugcggccuguucccgacacagauccaggugcgcaacauuaugucccccgucaugggcgugaucggguuuagcuucuuugugaaagauuggccugaaagaauccgggaguucauggaaaaggagugucccuuuauuaaaccugaagucaagcccggaaccccggcucaggagaucgagaugcucaaaaagaauaaaauuuacuucaugcauagacaagacguucuggauaagaaccacguggccgacauggauaaacuuaucgacuaugcggccucuggcgauccuacaucccccgacaauauugacagcccuaacgcucccuggguguuugccugcgcucccgaucgcuguccuccgaccugcaucuacgucgccgggauggccgaacugggagcuuucuuuucuauccuccaggacaugcggaauaccauuauggcguccaaaacagugggcacggccgaggaaaagcugaaaaagaaaagcucuuucuaccaguccuaucugagacgcacccaaagcauggggauccagcucgaucagcggauuauccugcuuuacaugcuggaguggggaaaggaaaugguugaccauuuccaccucggcgaugacauggaucccgagcugagaggccuugcucaggcccugauugaccaaaaggugaaagagaucuccaaccaggaaccucucaagaucuga

SEQ ID NO: 7147 - RNA, 1302 nt, Artificial Sequence
  derived and/or modified CDS sequence (opt5) from PUUV(CRF366)__AF367071.1__N
augaccgaccugacagauauccaggaggacauuacgagacacgaacaacagcucguggccgcucggcagaagcugaaagaugccgagcgcgcggucgaaauggaccccgaugacguuaacaagaauacccuucaggcuagacaacagacagugagcgcccuggaggauaaacucgccgacuacaagcggcgcauggcugaugccguguccagaaagaagauggacaccaagccugcugauccgacaggcaucgaacccgacgaucaucugaaagagcggucuagccuucgcuaugggaacguccuggacgugaaugccauugacaucgaggaaccuuccggacagaccgcggauugguacacaauuggcaucuauguuaucggguucacccuccccauuauccugaaggcccuguacaugcucucuacgagaggacggcagaccgugaaagagaacaagggcacacgcauuagauuuaaagacgauaccagcuucgaagacaucaaugggauucggcgcccuaagcaccuguaugucuccaugcccacagcucaaucuaccaugaaggccgaggagcuuacgccuggaagauuucggacaaucgugugcggccuguucccgacccagauucagguucgcaacaucaugagccccgugaugggcgucaucggguuuuccuucuuugugaaagauuggccugaacggauuagagaguucauggaaaaggagugucccuuuaucaaaccugaagugaagcccggaacaccggcucaggagauugagaugcucaaaaagaauaaaaucuacuucaugcauagacaagacguccuggauaagaaccacguugccgacauugauaaacuuaucgacuaugcggccagcggcgauccuaccucucccgacaauaucgacuccccuaacacccccuggguguuugcuugcgcccccgaucgcuguccuccgacaugcauuuacguggcugggauggccgaacugggagccuucuuuagcauccuccaggacaugcggaauacgauuauggcuucuaaaaccgucggcacagcggaggaaaagcugaaaaagaaauccagcuucuaccagucuuaucugagacgcacccaauccauggggauccagcucgaucagcggauuauccugcuuuacaugcuggaguggggaaaggaaaugguggaccauuuccaccucggcgaugacauggaucccgagcugagaggccuugcccaggcucugaucgaccaaaagguuaaagagauuagcaaccaggaaccucucaagaucuga

SEQ ID NO: 7148 - RNA, 1302 nt, Artificial Sequence
  derived and/or modified CDS sequence (opt5) from PUUV(Djaknebole_98-1)__AM746310.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaccgauccgacaggcaucgaacccgacgaucaucugaaggagagaagcucccuucgguacgggaacgugcuggacguuaaugccauugacaucgaggaaccuucuggacagaccgcugauugguauacaauuggcguguacgucaucggguuuacccuccccaucauucugaaagcccuguauaugcucagcacgcgcggaagacagaccgugaaggagaacaaaggcacacggauccgcuucaaggacgauaccuccuuugaagacauuaaugggaucagacggccuaagcaccuguacguuucuaugcccacagcgcaaagcaccaugaaagccgaggagcuuacgccuggacgcuucagaacaauugugugcggccuguuuccgacccagauccagguccggaacauuaugucccccgugaugggcgugaucggguucagcuuuuucgucaaggauugggcugaccgcaucagagaauuuauggagaaagaauguccuuucauuaagcccgagguuaaaccuggaacacccacccaggaaaucgaguuucucaagaaaaauaagguguauuucauggaucggcaaaacgugcuggacaagaaucaugucgccgauauugacaaacuuaucgauuacgcugccucuggcgacccgaccuccccugacaacauugagagccccaaugcgccuuggguguuugccugcgcucccgauagaugucccccuacaugcaucuauguugccgggauggcugaacugggagccuucuucucuauccuccaggacaugcgcaacacgauuauggccuccaagaccgugggcacagcugaggaaaaacugaagaaaaagagcucuuuuuaccaguccuaccugcggagaacccaaagcauggggauccagcucgaucagcgcauuauccugcuuuauaugcuggaguggggaaaggaaauggucgaccacuuccaucucggcgaugacauggauccggagcugcggggccuugcgcaggcccugauugaccaaaaagugaaggagaucuccaaucaggauccccucaaaaucuga

SEQ ID NO: 7149 - RNA, 1302 nt, Artificial Sequence
  derived and/or modified CDS sequence (opt5) from PUUV(Fusong 114-05)__EF488804.1__N
augagcgaccugaaggauauccaggaggacauugccagacacgaacaacagcucguggucgcucggcagaaacugcgcgaugccgagaaggcgguugaaauggaccccgaugacgugaacaaaaauacccuucaggcuagacaacagacaguguccgcccuggaggauaagaucgccgacuucaaacggcgcauggcugauauugucucuagaaagaagauggacacgaaaccugccgauccgaccggcaucgaacccgacgaucaucucaaggagcggagcucccugcgcuacgggaacgugcuugacguuaaugcuauugacaucgaggaaccuucuggacagacagccgauugguauaccaucggcguguacauuaucgaguuuacacugcccauuauccucaaagcgcuguauaugcugagcaccagagggcggcagacagccaaggaaaacaaaggaacccgcauuagauucaaggacgauacguccuuugaggacgucaauggcauccggcgcccuaagcaccucuacgugucuaugcccaccgcucaaagcacaaugaaagccgaggaacugaccccugggagauuccggacaauuguuugcggacuuuuuccgacccagauccaggugcgcaacaucaugucccccgucaugggcgugauuggcuucagcuuuuucgcuaaggauuggccugacagaaucaaagaguuuauggaaaaggagugucccuucauuaaaccugaagugaagcccgggacgccggccaaagaggucgagauccugaagcggaauaagauuuauuuuaugcagagacaaggaguucucgauaaaaaccaugugccugacaucgauaagcugaucgacuacgcggccucuggcgaucccacauccccucgcaauauugacagccccaacgcucccuggguguucgccugcgcuccugaccgguguccgccuaccugcaucuaugucgccgggauggccgaacuuggagcguuuuucucuauucugcaggauaugagaaauacaaucauggcuuccaaaaccgugggcaccgccgaggaaaagcucaaaaagaaaagcucuuucuaccaguccuaccugcgccggacacaaagcauggggauucagcuggaccagagaaucauccuccuguauaugcuugaguggggaaaggaaaugguugaucacuuucaucugggcgacgauauggaccccgagcuccgcucccuggcucaggcccuuauugaucaaaaggugaaagagaucucuaaccaggaaccccugaagauuuga

SEQ ID NO: 7150 - RNA, 1302 nt, Artificial Sequence
  derived and/or modified CDS sequence (opt5) from PUUV(Fusong 199-05)__EF488803.1__N
augagcgaccugaaggauauccaggaggacauugccagacacgaacaacagcucguggcugcccggcagaaacugcgcgaugcggagaaggcugucgaaauggaccccgaugacguuaacaaaaauacccuucaggccagacaacagacaguguccgcccuggaggauaagaucgcugacuucaaacggcgcauggccgauauugugucuagaaagaagauggacacgaaaccugcugauccgaccggcaucgaacccgacgaucaucucaaggagcggagcucccugcgcuacgggaacguccuugacgugaaugccauugacaucgaggaaccuucuggacagacagcggauugguauaccaucggcguuuacauuaucggguuuacacugcccauuauccucaaagcccuguauaugcugagcaccagaggacggcagacagugaaggagaacaaaggcacccgcauuagauucaaggacgauacguccuuugaagacgucaaugggauccggcgcccuaagcaccucuacgugucuaugcccaccgcucaaagcacaaugaaagccgaggagcugaccccuggaagauuccggacaauuguuugcggccuuuuuccgacccagauccaggugcgcaacaucaugucccccgucaugggcgugauuggguucagcuuuuucgcuaaggauuggccugacagaaucaaagaauuuauggagaaggaaugucccuucauuaaaccugaggugaagcccggaacgccggccaaagaagucgagauccugaagcggaauaagauuuauuuuaugcagagacaagauguucucgacaaaaaccaugugccugauaucgacaagcugaucgauuacgcggccucuggcgaccccacauccccugagaauauugacagccccaacgcucccuggguguucgccugcgcuccugaucgcuguccgccuaccugcaucuaugucgccgggauggccgaacuuggagcguuuuucucuauucugcaggacaugcggaauacaaucauggcuuccaaaaccgugggcaccgccgaggaaaagcucaaaaagaaaagcucuuucuaccaguccuaccugagacgcacacaaagcauggggauucagcuggaucagcggaucauccuccuguauaugcuugaguggggaaaggaaaugguugaccacuuucaucugggcgaugacauggaucccgagcucagaucccuggcucaggcccuuauugaccaaaaggugaaagagaucucuaaccaggaaccccugaagauuuga

SEQ ID NO: 7151 - RNA, 1302 nt, Artificial Sequence
  derived and/or modified CDS sequence (opt5) from PUUV(Fusong 200-05)__EF211820.1__N
augagcgaccugaaggauauccaggaggacauugccagacacgaacaacagcucguggucgcucggcagaaacugcgcgaugccgagaaggcgguugaaauggaccccgaugacgugaacaaaaauacccuucaggcuagacaacagacaguguccgcccuggaggauaagaucgccgacuucaaacggcgcauggcugauauugucucuagaaagaagauggacacgaaaccugccgauccgaccggcaucgaacccgacgaucaucucaaggagcggagcucccugcgcuacgggaacgugcuugacguuaaugcuauugacaucgaggaaccuucuggacagacagccgauugguauaccaucggcguguacauuaucggguuuacacugcccauuauccucaaagcgcuguauaugcugagcaccagaggacggcagacagucaaggagaacaaaggcacccgcauuagauucaaggacgauacguccuuugaagacgugaaugggauccggcgcccuaagcaccucuacguuucuaugcccaccgcccaaagcacaaugaaagcugaggagcugaccccuggaagauuccggacaauugugugcggccuuuuuccgacccagauccagguccgcaacaucaugucccccgugaugggcgugauuggguucagcuuuuucgccaaggauuggccugacagaaucaaagaauuuauggagaaggaaugucccuucauuaaaccugaggucaagcccggaacgccggcuaaagaaguugagauccugaagcggaauaagauuuauuuuaugcagagacaagaugugcucgacaaaaaccaugugccugauaucgacaagcugaucgauuacgccgcgucuggcgaccccacauccccugagaauauugacagccccaacgcccccugggucuucgcuugcgccccugaucgcuguccgccuaccugcaucuauguggcugggauggccgaacuuggagccuuuuucucuauucugcaggacaugcggaauacaaucauggcuuccaaaaccguuggcaccgcggaggaaaagcucaaaaagaaaagcucuuucuaccaguccuaccugagacgcacacaaagcauggggauucagcuggaucagcggaucauccuccuguauaugcuugaguggggaaaggaaaugguggaccacuuucaucugggcgaugacauggaucccgagcucagaucccuggcccaggcucuuauugaccaaaaggucaaagagaucucuaaccaggaaccccugaagauuuga

SEQ ID NO: 7152 - RNA, 1302 nt, Artificial Sequence
  derived and/or modified CDS sequence (opt5) from PUUV(Fusong 900-06)__EF488806.1__N
augagcgaccugaaggauauccaggaggacauugccagacacgaacaacagcucguggucgcucggcagaaacugcgcgaugccgagaaggcgguugaaauggaccccgaugacgugaacaaaaauacccuucaggcuagacaacagacaguguccgcccuggaggauaagaucgccgacuucaaacggcgcauggcugauauugucucuagaaagaagauggacacgaaaccugccgauccgaccggcaucgaacccgacgaucaucucaaggagcggagcucccugcgcuacgggaacgugcuugacguuaaugcuauugacaucgaggaaccuucuggacagacagccgauugguauaccaucggcguguacauuaucggguuuacacugcccauuauccucaaagcgcuguauaugcugagcaccagaggacggcagacagucaaggagaacaaaggcacccgcauuagauucaaggacgauacguccuuugaagacgugaaugggauccggcgcccuaagcaccucuacguuucuaugcccaccgcccaaagcacaaugaaagcugaggagcugaccccuggaagauuccggacaauugugugcggccuuuuuccgacccagauccagguccgcaacaucaugucccccgugaugggcgugauuggguucagcuuuuucgccaaggauuggccugacagaaucaaagaauuuauggagaaggaaugucccuucauuaaaccugaggucaagcccggaacgccggcuaaagaaguugagauccugaagcggaauaagauuuauuuuaugcagagacgcgaugugcucgacaaaaaccaugugccugauaucgacaagcugaucgauuacgccgcgucuggcgaccccacauccccugagaauauugacagccccaacgcccccugggucuucgcuugcgccccugaucgguguccgccuaccugcaucuauguggcugggauggccgaacuuggagccuuuuucucuauucugcaagacaugagaaauacaaucauggcuuccaaaaccguuggcaccgcggaggaaaagcucaaaaagaaaagcucuuucuacaaguccuaccugcgccggacacagagcauggggauucagcuggaucaaagaaucauccuccuguauaugcuugaguggggaaaggaaaugguggaccacuuucaucugggcgaugacauggaucccgagcuccgcucccuggcccaggcucuuauugaccagaaagucaaggagaucucuaaccaggaaccccugaaaauuuga

SEQ ID NO: 7153 - RNA, 1302 nt, Artificial Sequence
  derived and/or modified CDS sequence (opt5) from PUUV(Gumboda_98-2)__AM746316.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaccgauccgacaggcaucgaacccgacgaucaucugaaggagagaagcucccuucgguacgggaacgugcuggacguuaaugccauugacaucgaggaaccuucuggacagaccgcugauugguauacaauuggcguguacgucaucggguuuacccuccccaucauucugaaagcccuguauaugcucagcacgcgcggaagacagaccgugaaggagaacaaaggcacacggauccgcuucaaggacgauaccuccuuugaagacauuaaugggaucagacggccuaagcaccuguacguuucuaugcccacagcgcaaagcaccaugaaagccgaggagcuuacgccuggacgcuucagaacaauugugugcggccuguuuccgacccagauccagguccggaacauuaugucccccgugaugggcgugaucggguucagcuuuuucgucaaggauugggcugaccgcaucagagaauuuauggagaaagaauguccuuucauuaagcccgagguuaaaccuggaacacccacccaggaaaucgaguuucucaagaaaaauaagguguauuucauggaucggcaaaacgugcuggagaagaaucaugucgccgacauugauaaacuuaucgacuacgcugccucuggcgauccgaccuccccugacaacauugaaagccccaaugcgccuuggguguuuucuugcgcccccgacagaugucccccuacaugcaucuauguugcugggauggccgagcugggagcuuucuucuccauccuccaggauaugcgcaacacgauuauggccagcaagaccgugggcacagccgaagagaaacugaagaaaaagucuuccuuuuaccagagcuaccugcggagaacccaauccauggggauccagcucgaccagcgcauuauccugcuuuauaugcuggaauggggaaaggagauggucgaucacuuccaucucggcgacgauauggacccggagcugcggggccuugcucaggcgcugauugaucaaaaagugaaggaaaucucuaaucaggacccccucaaaaucuga

SEQ ID NO: 7154 - RNA, 1302 nt, Artificial Sequence
  derived and/or modified CDS sequence (opt5) from PUUV(Gumboda_98-4)__AM746318.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaccgauccgacaggcaucgaacccgacgaucaucugaaggagagaagcucccuucgguacgggaacgugcuggacguuaaugccauugacaucgaggaaccuucuggacagaccgcugauugguauacaauuggcguguacgucaucggguuuacccuccccaucauucugaaagcccuguauaugcucagcacgcgcggaagacagaccgugaaggagaacaaaggcacacggauccgcuucaaggacgauaccuccuuugaagacauuaaugggaucagacggccuaagcaccuguacguuucuaugcccacagcgcaaagcaccaugaaagccgaggagcuuacgccuggacgcuucagaacaauugugugcggccuguuuccgacccagauccagguccggaacauuaugucccccgugaugggcgugaucggguucagcuuuuucgucaaggauugggcugaccgcaucagagaauuuauggagaaagaauguccuuucauuaagcccgagguuaaaccuggaacacccacccaggaaaucgaguuucucaagaaaaauaagguguauuucauggaucggcaaaacgugcuggacaagaaucaugucgccgauauugacaaacuuaucgauuacgcugccucuggcgacccgaccuccccugacaacauugagagccccaaugcgccuuggguguuuucuugcgcccccgauagaugucccccuacaugcaucuauguugcugggauggccgaacugggagcuuucuucuccauccuccaggacaugcgcaacacgauuauggccagcaagaccgugggcacagccgaggaaaaacugaagaaaaagucuuccuuuuaccagagcuaccugcggagaacccaauccauggggauccagcucgaucagcgcauuauccugcuuuauaugcuggaguggggaaaggaaauggucgaccacuuccaucucggcgaugacauggauccggagcugcggggccuugcucaggcgcugauugaccaaaaagugaaggagaucucuaaucaggauccccucaaaaucuga

SEQ ID NO: 7155 - RNA, 1302 nt, Artificial Sequence
  derived and/or modified CDS sequence (opt5) from PUUV(Kamiiso-8Cr-95)__AB010730.1__N
augagcgaccugaaggauauccaggaggacauuaccagacacgaacaacagcucguggucgcccggcagaaacugcgcgaugcugagaaggccguugaaauggaccccgaugacgugaacaaaaauacacuucaggcgagacaacagacgguguccgcucuggaggauaagcucgccgacuucaaacggcgcauggccgaugucgugucuagaaagaagauggacaccaaaccugcugauccgacaggcaucgaacccgacgaucaucugaaggagcggagcucccuucgcuacgggaacguucuggacgugaaugccauugacaucgaggaaccuucuggacagaccgcugauugguauacaauuggcgucuacaucaucggguuuacccuccccauuauccugaaagcccuguauaugcucagcacaagaggacggcagaccgugaaggagaacaaaggcacgcgcauuagauucaaggacgauaccuccuuugaagacaucaaugggauucggcgcccuaagcaccuguacguuucuaugcccacagcgcaaagcaccaugaaagccgaggagaucacaccuggaagauuccggaccauugugugcggccuuuuuccgacgcagauccagguccgcaacaucaugucccccgugaugggcgugauuggguucagcuuuuucgucaaggauuggccugaaagaaucaaagaguuuauggaaaaggagugucccuucauuaaaccugaaguuaagcccggaacaccggcuaaagagguggagauccugaagcggaauaagguguauuuuaugcagagacaagacguccucgauaaaaaccaugugccugacauugauaagcugaucgacuacgccgcuucuggcgaucccaccuccccugacaauaucgacagccccaacgcccccuggguuuucgcgugcgccccugaucgcuguccgcccacaugcauuuauguggcugggauggccgaacuuggagccuuuuucucuauccugcaggacaugcggaauaccauuauggcuuccaaaaccgucggcacagccgaggaaaagcucaaaaagaaaagcucuuucuaccaguccuaccugagacgcacgcaaagcauggggauccagcuggaucagcggauuauccuccuguauaugcuugaguggggaaaggaaaugguggaccacuuucaucugggcgaugacauggauccugagcucagaggccuggcucaggcgcuuaucgaccaaaagguuaaagagauuuccaaccaggaaccccugaagaucuga

SEQ ID NO: 7156 - RNA, 1302 nt, Artificial Sequence
  derived and/or modified CDS sequence (opt5) from PUUV(Mu/07/1219)__KJ994776.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuacaaaagacggauggccgaugcugucucucgcaagaagauggacacaaaaccuaccgauccgacaggcaucgaacccgacgaucaucugaaggagagaagcucccuucgguaugggaacgugcuggacguuaaugccauugacaucgaggaaccuucuggacagaccgcugauugguacacaauuggcguguaugucaucggguucacccuccccaucauucugaaagcccuguacaugcucagcacgcgcggaagacagaccgugaaggagaacaaaggcacacggauccgcuuuaaggacgauaccuccuucgaagacauuaaugggaucagacggccuaagcaccuguauguuucuaugcccacagcgcaaagcaccaugaaagccgaggagcuuacgccuggacgcuuuagaacaauugugugcggccuguucccgacccagauccagguccggaacauuaugucccccgugaugggcgugaucggguuuagcuucuuugucaaggauugggcugaacgcaucagagaguucauggaaaaagaguguccuuuuauuaagcccgaaguuaaaccuggaacacccgcccaggaggcugaguuccucaagcggaauaaaguguacuuuaugcaaagacaggacgugcuggauaagaaccaugucgccgacaucgauaaacuuauugacuaugcggccucuggcgauccgaccuccccugacaauaucgaaagccccaacgcuccuuggguguucgccugcgcucccgaccgcugucccccuaccugcauuuacguugccgggauggccgagcugggagcguuuuucucuauccuccaggauaugcggaauacaaucauggcuuccaagacggugggcaccgccgaagagaagcugaaaaagaaaagcucuuucuaccaauccuaucugagacgcacacagagcauggggauucagcucgaccagcggaucauucugcuuuacaugcuggaauggggaaaggagauggucgaucacuuucaucucggcgacgauauggacccggagcugagaggccuugcucaagcccugaucgaucagaaggugaaagaaauuuccaaccaggagccccucaagaucuga

SEQ ID NO: 7157 - RNA, 1302 nt, Artificial Sequence
  derived and/or modified CDS sequence (opt5) from PUUV(Opina916)__AF294652.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuguggauccgaccggcaucgaacccgacgaucaucugaaggagagaagcucccuucgguacgggaacguucuggacgugaaugccauugacaucgaggaaccuucuggacagacagcugauugguauaccauuggcgucuacgugaucggguuuacacuccccaucauucugaaagcccuguauaugcucagcacccgcggaagacagacgguuaaggagaacaaaggcacccggauccgcuucaaggacgauacauccuuugaagacauuaaugggaucagacggccuaagcaccuguacgugucuaugcccaccgcgcaaagcacaaugaaagccgaggagcuuaccccuggacgcuucagaacgauugucugcggccuguuuccgacacagauccaggugcggaacauuaugucccccgugaugggcgucaucggguucagcuuuuucguuaaggauugggcugaacgcaucagagaguuuauggaaaaagaguguccuuucauuaagcccgaagugaaaccuggaacccccgcccaggaggcugaguuucucaagaaaaaucggaucuauuucaugcaaagacaggaagugcuggacaagaaccaugucgccgauauugacaaacuuaucgauuacgcggccucuggcgacccgacauccccugauaauauugagagccccaacgcuccuuggguguuugccugcgcucccgaccgcugucccccuaccugcaucuauguugccgggauggccgaacugggagcuuucuucucuauccuccaggacaugcggaauaccauuauggcguccaagacagugggcacggccgaggaaaagcugaaaaagaaaagcucuuuuuaccaauccuaccugagacgcacccagagcauggggauccagcucgaucagcggauuauccugcuuuauaugcuggaguggggaaaggagauggucgaccacuuccaucucggcgaugacauggauccggaacugagaggccuugcucaagcccugauugaccagaaggugaaagagaucuccaaccaggaaccccucaagaucuga

SEQ ID NO: 7158 - RNA, 1302 nt, Artificial Sequence
  derived and/or modified CDS sequence (opt5) from PUUV(Palbole_98-1)__AM746327.1__N
augagcgaccugaccgauauccaggaggacauuacaugccacgaacaacagcucguggucgccagacagaagcugaaagaugcugagaaggccguugaaauggaccccgaugacgugaacaaaaauacgcuucaggcgcggcaacagaccguguccgcucuggaggauaagcucgccgacuucaaacgcagaauggccgaugcugucucucggaagaagauggacacaaaaccuaccgauccgacaggcaucgaacccgacgaucaucugaaggagcgcagcucccuuagauacgggaacgugcuggacguuaaugccauugacaucgaggaaccuucuggacagaccgcugauugguauacaauuggcguguacgucaucggguuuacccuccccaucauucugaaagcccuguauaugcucagcacgcggggacgccagaccgugaaggagaacaaaggcacaagaauccgguucaaggacgauaccuccuuugaagacauuaaugggauccgcagaccuaagcaccuguacguuucuaugcccacagcgcaaagcaccaugaaagccgaggagcuuacgccuggacgguuccgcacaauuguguguggccuguuuccgacccagauccaggucagaaacauuaugucccccgugaugggcgugaucggguucagcuuuuucgucaaggauugggcugaccggauccgcgaauuuauggagaaagaaugcccuuucauuaagcccgagguuaaaccuggaacacccacccaggaaaucgaguuucucaagaaaaauaagguguauuucauggauagacaaaacgugcuggacaagaaucaugucgccgauauugacaaacuuaucgauuacgcugccucuggcgacccgaccuccccugacaacauugagagccccaaugcgccuuggguguuugccugugcucccgaucggugucccccuacaugcaucuauguugccgggauggcugaacugggagccuucuucucuauccuccaggacaugagaaacacgauuauggccuccaagaccgugggcacagcugaggaaaaacugaagaaaaagagcucuuuuuaccaguccuaccugcgccggacccaaagcauggggauccagcucgaucagagaauuauccugcuuuauaugcuggaguggggaaaggaaauggucgaccacuuccaucucggcgaugacauggauccggagcugcgcggccuugcgcaggcccugauugaccaaaaagugaaggagaucuccaaucaggauccccucaaaaucuga

SEQ ID NO: 7159 - RNA, 1302 nt, Artificial Sequence
  derived and/or modified CDS sequence (opt5) from PUUV(Palbole_98-2)__AM746328.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaccgauccgacaggcaucgaacccgacgaucaucugaaggagagaagcucccuucgguacgggaacgugcuggacguuaaugccauugacaucgaggaaccuucuggacagaccgcugauugguauacaauuggcguguacgucaucggguuuacccuccccaucauucugaaagcccuguauaugcucagcacgcgcggaagacagaccgugaaggagaacaaaggcacacggauccgcuucaaggacgauaccuccuuugaagacauuaaugggaucagacggccuaagcaccuguacguuucuaugcccacagcgcaaagcaccaugaaagccgaggagcuuacgccuggacgcuucagaacaauugugugcggccuguuuccgacccagauccagguccggaacauuaugucccccgugaugggcgugaucggguucagcuuuuucgucaaggauugggcugaccgcaucagagaauuuauggagaaagaauguccuuucauuaagcccgagguuaaaccuggaacacccacccaggaaaucgaguuucucaagaaaaauaagguguauuucauggaucggcaaaacgugcuggacaagaaucaugucgccgauauugacaaacuuaucgauuacgcugccucuggcgacccgaccuccccugacaacauugagagccccaaugcgccuuggguguuugccugcgcucccgauagaugucccccuacaugcaucuauguugccgggauggcugaacugggagccuucuucucuauccuccaggacaugcgcaacacgauuauggccuccaagaccgugggcacagcugaggaaaaacugaagaaaaagagcucuuuuuaccaguccuaccugcggagaacccaaagcauggggauccagcucgaucagcgcauuauccugcuuuauaugcuggaguggggaaaggaaauggucgaccacuuccaucucggcgaugacauggauccggagcugcggggcuuugcgcaggcccuuauugaccaaaaagugaaggagaucuccaaucaggauccccugaaaaucuga

SEQ ID NO: 7160 - RNA, 1302 nt, Artificial Sequence
  derived and/or modified CDS sequence (opt5) from PUUV(Palbole_98-3)__AM746329.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaccgauccgacaggcaucgaacccgacgaucaucugaaggagagaagcucccuucgguacgggaacgugcuggacguuaaugccauugacaucgaggaaccuucuggacagaccgcugauugguauacaauuggcguguacgucaucggguuuacccuccccaucauucugaaagcccuguauaugcucagcacgcgcggaagacagaccgugaaggagaacaaaggcacacggauccgcuucaaggacgauaccuccuuugaagacauuaaugggaucagacggccuaagcaccuguacguuucuaugcccacagcgcaaagcaccaugaaagccgaggagcuuacgccuggacgcuucagaacaauugugugcggccuguuuccgacccagauccagguccggaacauuaugucccccgugaugggcgugaucggguucagcuuuuucgucaaggauugggcugaccgcaucagagaauuuauggagaaagaauguccuuucauuaagcccgagguuaaaccuggaacacccacccaggaaaucgaguuucucaagaaaaauaagguguauuucauggaucggcaaaacgugcuggacaagaaucaugucgccgauauugacaaacuuaucgauuacgcugccucuggcgacccgaccuccccugacagcauugagucucccaacgcgccuuggguguuugccugcgcucccgauagaugucccccuacaugcaucuauguugccgggauggcugaacugggagccuucuucuccauccuccaggacaugcgcaauacgauuauggccagcaagaccgugggcacagcugaggaaaaacugaagaaaaagucuuccuuuuaccagagcuaccugcggagaacccaauccauggggauccagcucgaucagcgcauuauccugcuuuauaugcuggaguggggaaaggaaauggucgaccacuuccaucucggcgaugacauggauccggagcugcggggccuugcgcaggcccugauugaccaaaaagugaaggagaucucuaaccaggauccccucaaaaucuga

SEQ ID NO: 7161 - RNA, 1302 nt, Artificial Sequence
  derived and/or modified CDS sequence (opt5) from PUUV(PUUV/Ardennes/Mg156/2011)__KT247592.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacagauggccgaugcugucucucggaagaagauggacacaaaaccuaccgauccgacaggcaucgaacccgacgaucaucugaaggagcgcagcucccuuagauacgggaacgugcuggacguuaaugccauugacaucgaggaaccuucuggacagaccgcugauugguauacaauuggcguguacgucaucggguuuacccuccccaucauucugaaagcccuguauaugcucagcacgcggggacgccaaaccgugaaggagaacaaaggcacaagaauccgguucaaggacgauaccuccuuugaagacauuaaugggauccgcagaccuaagcaccuguacguuucuaugcccacagcgcagagcaccaugaaagccgaggagcuuacgccuggacgguuccgcacaauugugugcggccuguuuccgacccagauccaggucagaaacauuaugucccccgugaugggcgugaucggguucagcuuuuucgucaaggauugggcugaccggauccgcgaauuuauggagaaagaauguccuuucauuaagcccgagguuaaaccuggaacacccgcccaagaaguggaguuucucaagagaaauaaaaucuauuucaugcagcggcaggaugugcuggacaagaaccaugucgcugauauugacaaacuuaucgauuacgccgcgucuggcgacccgaccuccccugacaauauugaggcccccaacgcuccuuggguguuugccugcgcucccgauagaugucccccuaccugcaucuauguugccgggauggccgaacugggagcuuucuucagcauccuccaagacaugcgcaauacaauuauggcgucuaagacggugggcaccgccgaggaaaagcugaaaaagaaauccagcuuuuaccagucuuaccugcggagaacacaguccauggggauccagcucgaucaacgcauuauccugcuuuauaugcuggaguggggaaaggaaauggucgaccacuuccaucucggcgaugacauggauccggagcugcggggccuugcucaggcccugauugaccagaaggugaaagagaucagcaaccaggaaccccucaagaucuga

SEQ ID NO: 7162 - RNA, 1302 nt, Artificial Sequence
  derived and/or modified CDS sequence (opt5) from PUUV(PUUV/Jelgava/Mg136/2008)__JN657230.1__N
augagcgaccuggccgauauccaggaggacauuaccagacacgaacaacagcucguggucgcucggcagaagcugaaagaugccgagcgcgcgguugaaguggaccccgaugacgugaacaagaauacacuucaggcuagacaacagacggucuccgcccuggaggauaaacucgccgacuacaagcggcgcauggcugaugccgugucuagaaagaagauggacaccaagccugcugauccgacaggcaucgaacccgacgaucaucugaaagagcggagcucccuucgcuaugggaacguucuggacgugaaugccauugacaucgaggaaccuucuggacagaccgcggauugguacacaauuggcgucuaugugaucggguucacccuccccaucauucugaaggcccuguacaugcucagcacaagaggacggcagaccguuaaagagaacaagggcacgcgcaucagauuuaaagacgauaccuccuucgaagacauuaaugggauccggcgcccuaagcaccuguaugugucuaugcccacagcucaaagcaccaugaaggccgaggagcuuacaccuggaagauuucggaccgucgugugcggccuguucccgacgcagauucaggugcgcaacaucaugucccccgucaugggcguuauuggguuuagcuucuuugugaaagauuggccugacagaaucaaggaauuuauggagaaagaaucucccuuuaucaagccugaugugaaacccggaacaccggcucaggaggucgaguuccucaagcggaauaaaguguacuuuaugaacagacaagacguucuggauaagaaucauguggccgacauugauaaacuuaucgacuaugcggccuccggcgacccuaccagccccgaugacauugaaucuccuaacgcucccugggucuucgccugugcucccgaucgcugcccuccgacauguaucuacguggccgggauggccgagcugggagcuuucuucuccauucuccaggacaugcggaauaccaucauggcgagcaaaaccguuggcacagccgaagagaagcugaaaaagaaaucuuccuucuaccagagcuaucugagacgcacgcaauccauggggauccagcucgaucagcggauuauccugcuuuacaugcuggaauggggaaaggagaugguggaccacuuucaucucggcgaugacauggaucccgaacugagaggccuugcucaggcccugauugaccaaaaggucaaagagaucucuaaccaggagccucucaagauuuga

SEQ ID NO: 7163 - RNA, 1302 nt, Artificial Sequence
  derived and/or modified CDS sequence (opt5) from PUUV(PUUV/Jelgava/Mg140/2008)__JN657231.1__N
augagcgaccuggccgauauccaggaggacauuaccagacacgaacaacagcucguggucgcucggcagaagcugaaagaugccgagcgcgcgguugaaguggaccccgaugacgugaacaagaauacacuucaggcuagacaacagacggucuccgcccuggaggauaaacucgccgacuacaagcggcgcauggcugaugccgugucuagaaagaagauggacaccaagccugcugauccgacaggcaucgaacccgacgaucaucugaaagagcggagcucccuucgcuaugggaacguucuggacgugaaugccauugacaucgaggaaccuucuggacagaccgcggauugguacacaauuggcgucuaugugaucggguucacccuccccaucauucugaaggcccuguacaugcucagcacaagaggacggcagaccguuaaagagaacaagggcacgcgcaucagauuuaaagacgauaccuccuucgaagacauuaaugggauccggcgcccuaagcaccuguaugugucuaugcccacagcucaaagcaccaugaaggccgaggagcuuacaccuggaagauuucggaccgucgugugcggccuguuccauacgcagauucaggugcgcaacaucauguccccggucaugggcguuauuggguuuagcuucuuugugaaagauuggcccgacagaaucaaggaauuuauggagaaagaauguccuuuuaucaagcccgaugugaaaccuggaacacccgcucaggaggucgaguuccucaagcggaauaaaguguacuuuaugaacagacaagacguucuggauaagaaucacguggccgacauugauaaacuuaucgacuaugcggccucuggcgacccgaccuccccugaugacauugaaagccccaacgcuccuugggucuucgccugcgcucccgaucgcugucccccuacaugcaucuacguggccgggauggccgagcugggagcuuucuucucuauucuccaggacaugcggaauaccaucauggcguccaaaaccguuggcacagccgaagagaagcugaaaaagaaaagcucuuucuaccaguccuaucugagacgcacgcaaagcauggggauccagcucgaucagcggauuauccugcuuuacaugcuggaauggggaaaggagaugguggaccauuuucaccucggcgaugacauggauccggaacugagaggccuugcucaggcccugauugaccaaaaggucaaagagaucuccaaccaggagccccucaagauuuga

SEQ ID NO: 7164 - RNA, 1302 nt, Artificial Sequence
  derived and/or modified CDS sequence (opt5) from PUUV(PUUV/Jura/Mg2/2010)__KT247596.2__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaccgauccgacaggcaucgaacccgacgaucaucugaaggagagaagcucccuucgguacgggaacgugcuggacguuaaugccauugacaucgaggaaccuucuggacagaccgcugauugguauacaauuggcguguacgucaucggguuuacccuccccaucauucugaaagcccuguauaugcucagcacgcgcggaagacagaccgugaaggagaacaaaggcacacggauccgcuucaaggacgauaccuccuuugaagacauuaaugggaucagacggccuaagcaccuguacguuucuaugcccacagcgcaaagcaccaugaaagccgaggagcuuacgccuggacgcuucagaacaauugugugcggccuguuuccgacccagauccagguccggaacauuaugucccccgugaugggcgugaucggguucagcuuuuucgucaaggauugggcugaccgcaucagagaauuuauggagaaagaauguccuuucauuaagcccgagaucaaaccuggaacacccgcccaggaagcugaguuucucaagcggaauaaaauuuauuucaugcaaagacaggauguucuggacaagaaccauguggccgauaucgacaaacuuauugauuacgcggccucuggcgacccgaccuccccugacaauaucgagagccccaacgcuccuuggguguuugccugcgcucccgaucgcugucccccuaccugcaucuaugucgccgggauggccgaacugggagcuuucuucucuauucuccaggacaugcggaauacaaucauggcguccaagacggugggcaccgccgaggaaaagcugaaaaagaaaagcucuuuuuaccaauccuaccugagacgcacacagagcauggggauucagcucgaucagcggaucauucugcuuuauaugcuggaguggggaaaggaaaugguugaccacuuccaucucggcgaugacauggauccggagcugagaggccuugcucaagcccugaucgaccagaaggugaaagagaucuccaaccaggaaccccucaagauuuga

SEQ ID NO: 7165 - RNA, 1302 nt, Artificial Sequence
  derived and/or modified CDS sequence (opt5) from PUUV(PUUV/Madona/Mg233/2008)__JN657232.1__N
augagcgaccuggccgauauccaggaggacauuaccagacacgaacaacagcucguggucgcucggcagaagcugaaagaugccgagcgcgcgguugaaguggaccccgaugacgugaacaagaauacacuucaggcuagacaacagacggucuccgcccuggaggauaaacucgccgacuacaagcggcgcauggcugaugccgugucuagaaagaagauggacaccaagccuacagauccgaccggcaucgaacccgacgaucaucugaaagagcggagcucccuucgcuaugggaacguucuggacgugaaugcuauugacaucgaggaaccuucuggacagacagccgauugguacaccauuggcgucuaugugaucagcuucacacuccccaucauucugaaggcgcuguacaugcucuccaccagagggcggcagacgguuaaagagaacaagggaacccgcaucagauuuaaagacgauacaucuuucgaagacauuaauggcauccggcgcccuaagcaccuguaugugagcaugcccaccgcccaauccacaaugaaggcugaggagcuuaccccugggagauuucggacgauugucugcggacuguucccgacacagauccaggugcgcaacauuaugagccccgugaugggcgucaucggcuuuucuuucuuuguuaaagauuggccugacagaaucaaggaguucauggaaaaagaaugucccuuuauuaagccugaugugaaacccgggaccccggcccaggagaucgaguuccucaagcggaauaaaguguacuuuaugaacagacaagacguccuggauaagaaucauguggcugacauugauaaacuuaucgacuaugccgcguccggagacccuacaagccccgaugacauugaaucuccuaacgcccccuggguuuucgcuugcgcccccgaucgcuguccuccgaccugcaucuacguggcuggcauggccgagcugggggccuuuuucuccauccuccaggacaugcggaauaccauuauggcuagcaaaacagucggaacggcggaagagaagcugaaaaagaaaucuuccuucuaccagagcuaucugagacgcacccaauccaugggcauccagcucgaucagcggauuauccugcuuuacaugcuggaaugggggaaggagaugguggaccacuuucaucucggagaugacauggaucccgaacugagaggccuugcccaggcucugauugaccaaaagguuaaagagaucucuaaccaggagccucucaagaucuga

SEQ ID NO: 7166 - RNA, 1302 nt, Artificial Sequence
  derived and/or modified CDS sequence (opt5) from PUUV(PUUV/Orleans/Mg23/2010)__KT247594.1__N
augagcgaccugaccgauauccaggaggugauuacaagacacgaacaacagcucgucguugcccggcagaagcugaaagacgcugagaaggccguggaaauggaucccgacgaugugaacaaaaauacgcuucaggcgcgccaacagaccgucuccgcucuggaggacaagcucgccgauuucaaaagacggauggccgacgcugugucucgcaagaagauggauacaaaaccugccgacccgaccggcaucgaacccgaugaccaucugaaggagagaagcucccuucgguacgggaacguucuggaugugaaugcuauugacaucgaggaaccuucuggacagacagccgacugguauaccauuggcgucuacgugaucggguuuacacuccccaucauucugaaagcgcuguauaugcucagcacccgcggaagacagacgguuaaggagaacaaaggcacccggauccgcuucaaggaugacacauccuuugaagauauuaaugggaucagacggccuaagcaccuguacgugucuaugcccaccgcccaaagcacaaugaaagcugaggagcuuaccccuggacgcuucagaacgauugucugcggccuguuuccgacacagauccaggugcggaacauuaugucccccgugaugggcgucaucggguucagcuuuuucguuaaggacugggccgaucgcaucaaagaauuuauggagaaggaauguccuuucauuaaacccgaggugaagccuggaacccccgugaaagaagcugaguuucucaagaagaauagagucuauuucaugcagcggcaagacgugcuggauaaaaaccauguugccgacaucgauaaacuuauugacuacgcggccgcuggcgauccgacaucuccugacaauaucgagucccccaacgccccuuggguguuugcuugcgcccccgacagaugucccccuaccugcauuuaugucgccgggauggcugaacugggagcguucuucagcauccuccaggauaugcgcaauaccaucauggccucuaagacagugggcacggcugaggaaaagcugaaaaagaaguccagcuuuuaccagucuuaccugcggagaacccaauccauggggauucagcucgaccagcgcaucauucugcuuuauaugcuggaguggggaaaagaaaugguugaucacuuccaucucggcgacgauauggacccggagcugcggggccuugcccaggcccugaucgaucaaaaggugaaagagauuagcaaccaggaaccccucaagaucuga

SEQ ID NO: 7167 - RNA, 1302 nt, Artificial Sequence
  derived and/or modified CDS sequence (opt5) from PUUV(Tobetsu-60Cr-93)__AB010731.1__N
augagcgaccugaaggauauccaggaggacauuaccagacacgaacaacagcucguggucgcccggcagaaacugcgcgaugcugagaaggccguugaaauggaccccgaugacgugaacaaaaauacacuucaggcgagacaacagacgguguccgcucuggaggauaagcucgccgacuucaaacggcgcauggccgaugucgugucuagaaagaagauggacaccaaaccugcugauccgacaggcaucgaacccgacgaucaucugaaggaccggagcucccuucgcuacgggaacguucuggacgugaaugccauugauaucgaggagccuucuggacagaccgcugacugguauacaauuggcgucuacaucaucggguuuacccuccccauuauccugaaagcccuguauaugcucagcacaagaggacggcagaccgugaaggaaaacaaaggcacgcgcauuagauucaaggaugacaccuccuuugaggauaucaaugggauucggcgcccuaagcaccuguacguuucuaugcccacagcgcaaagcaccaugaaagccgaagagaucacaccuggaagauuccggaccauugugugcggccuuuuuccgacgcagauccagguccgcaacaucaugucccccgugaugggcgugauuggguucagcuuuuucgucaaggacuggccugagagaaucaaagaauuuauggagaaggaaugucccuucauuaaaccugagguuaagcccggaacaccggcuaaagaaguggagauccugaagcggaauaagguguauuuuaugcagagacaagauguccucgacaaaaaccaugugccugauauugacaagcugaucgauuacgccgcuucuggcgaccccaccuccccugacaauaucgauagccccaacgcccccuggguuuucgcgugcgccccugaccgcuguccgcccacaugcauuuauguggcugggauggccgagcuuggagccuuuuucucuauccugcaggauaugcggaauaccauuauggcuuccaaaaccgucggcacagccgaagagaagcucaaaaagaaaagcucuuucuaccaguccuaccugagacgcacgcaaagcauggggauccagcuggaccagcggauuauccuccuguauaugcuugaauggggaaaggagaugguggaucacuuucaucugggcgacgauauggacccugaacucagaggccuggcucaggcgcuuaucgaucaaaagguuaaagagauuuccaaccaggagccccugaagaucuga

SEQ ID NO: 7168 - RNA, 1302 nt, Artificial Sequence
  derived and/or modified CDS sequence (opt5) from PUUV(Vranica)__U14137.1__N
augagcgaccugaccgauauccaggaggacauuacaagacacgaacaacagcucguggucgcccggcagaagcugaaagaugcugagaaggccguugaaauguaccccgacgaugugaacaaaaauacgcuucaggcgcgccaacagaccguguccgcucuggaggacaagcucgccgauuucaaaagacggauggccgacgcugucucucgcaagaagauggauacaaaaccuaccgacccgacaggcaucgaacccgaugaccaucugaaggagagaagcucccuucgguaugggaacgugcuggauguuaaugccauugacaucgaggaaccuucuggacagaccgcugacugguacacaauuggcguguaugucaucggguuuacccuccccaucauucugaaagcccuguacaugcucagcacgcgcggaagacagaccgugaaggagaacaaaggcacacgguaucgcuucaaggaugacaccuccuuugaagauaucaaugggauuagacggccuaagcaccuguacguuucuaugcccacagcgcaaagcaccaugaaagccgaggagcuuacgccuggacgcuucagaacaaucgugugcggccuguuuccgacccagauucagguccggaacaucaugucccccgugaugggcgugauuggguucagcuuuuucgucaaggacugggcugaucgcaucagagaauuuauggagaaagaauguccuuucaucaagcccgagguuaaaccuggaacacccacccaggaaauugaguuucucaagaaaaauaagguguauuucauggaccggcaaaacgugcuggauaagaaucaugucgccgacaucgauaaacuuauugacuacgcugccucuggcgauccgaccuccccugacaacaucgagagccccaaugcgccuuggguguuugccugcgcucccgacagaugucccccuacaugcauuuacguugccgggauggcugaacugggagccuucuucucuauccuccaggauaugcgcaacacgaucauggccuccaagaccgugggcacagcugaggaaaaacugaagaaaaagagcucuuuuuaucaguccuaccugcggagaacccaaagcauggggauucagcucgaccagcgcaucauucugcuuuauaugcuggaguggggaaaggaaauggucgaucacuuccaucucggcgacgauauggacccggagcugcggggccuugcgcaggcccugaucgaucaaaaagugaaggagauuuccaaucaggacccccucaaaaucuga

SEQ ID NO: 7169 - RNA, 1302 nt, Artificial Sequence
  derived and/or modified CDS sequence (opt5) from PUUV(P360)__L11347.1__N
augagcgaccugaccgauauccaggaggaaauuacaagacacgagcaacagcucguggucgcccggcagaagcugaaagacgcugaacgcgccguugagguguaccccgaugacgugaacaagaauacgcuucaggcgagacaacagaccgucuccgcucuggaagauaaacucgccgacuauaagcggcgcauggccgaugcugugucucggaaaaagauggacacaaagccuaccgauccgacaggcaucgagcccgacgaucaucugaaagagagaagcucccuucgcuacgggaacguucuggacgugaaugccauugauaucgaagaaccuucuggacagaccgcugacugguauacaauuggcgucuacgugaucggguucaccauccccauuauccucaaggcccuguauaugcugagcacgagaggacggcagaccguuaaagaaaacaagggcacacgcauuagauuuaaagacgauaccuccuucgaggacaucaaugggauucggcgcccuaagcaccucuacgugucuaugcccacagcgcaaagcaccaugaaggccgaggaacugacgccuggaagauuucggacaaucgucugcggccuuuucccgacccagauucaggugcgcaacaucaugucccccgugaugggcgucaucggguuuagcuucuuuguuaaagauuggccugagaagauuagagaguucauggagaaagaaugucccuuuaucaagccugaggugaaacccggaacaccggcucaggagguggaguuccugaagcggaauagagucuauuuuaugacccgccaagacgugcucgauaaaaaccauguugccgacauugauaagcugaucgacuacgcugccucuggcgauccuaccucccccgacgauauugaaagcccuaaugcgcccuggguguucgccugcgcucccgaccgguguccuccgacaugcaucuacgucgccgggauggcugaacuuggagccuuuuucucuauccugcaggacaugagaaacacgauuauggccuccaagaccgugggcacagcugaggaaaaacucaagaaaaagagcucuuucuaucaguccuaccugcgccggacccaaagcauggggauccagcuggaucagagaauuauccuccuguauaugcuugaguggggaaaagagaugguugaccacuuucaucugggcgaugacauggaucccgaacuccgcggccuggcgcagucccuuauugaccaaaaggugaaggagaucucuaaucaggaaccucugaaaaucuga

SEQ ID NO: 7170 - RNA, 1302 nt, Artificial Sequence
  derived and/or modified CDS sequence (opt5) from PUUV(Aijajarvi/Mg7/05)__GQ339476.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacagauggccgaugcugucucucggaagaagauggacacaaaaccuaccgauccgacaggcaucgaacccgacgaucaucugaaggagcgcagcucccuuagauacgggaacgugcuggacguuaaugccauugacaucgaggaaccuucuggacagaccgcugauugguauacaauuggcguguacgucaucggguuuacccuccccaucauucugaaagcccuguauaugcucagcacgcggggacgccaaaccgugaaggagaacaaaggcacaagaauccgguucaaggacgauaccuccuuugaagacauuaaugggauccgcagaccuaagcaccuguacguuucuaugcccacagcgcagagcaccaugaaagccgaggagcuuacgccuggacgguuccgcacaauugugugcggccuguuuccgacccagauccaggucagaaacauuaugucccccgugaugggcgugaucggguucagcuuuuucgucaagggaugggcugaucggauccgcgaauuuauggagaaagaauguccuuucauuaagcccgagguuaaaccuggcacacccacccaagaaguggaguuucucaagaaaaauaagguguauuuccuggacagacagaacguccuugauaagaaucauguggccgacaucgauaaacugauugacuacgcugccucuggggauccgaccuccccugacaacaucgagagccccaaugcgccuuggguuuuugccugcgcucccgaccggugucccccuacaugcauuuauguggccggaauggcugaacucggcgccuucuucucuauccugcaggauaugagaaacacgaucauggccuccaagaccgucgggacagcugaggaaaaacugaagaaaaagagcucuuuuuaccaauccuaccuccgccggacccagagcaugggcauucagcuggaccagagaaucauucuucuguucaugcucgaguggggaaaggaaaugguggaucacuuucaucugggcgacgauauggacccggagcuucgcgggcuggcgcaagcccucaucgaucagaaaguuaaggagauuuccaaucaggaaccccugaaaaucuga

SEQ ID NO: 7171 - RNA, 1302 nt, Artificial Sequence
  derived and/or modified CDS sequence (opt5) from PUUV(Bavaria 151/05)__EU439968.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuacaaaagacggauggccgaugcugucucucgcaagaagauggacacaaaaccuaccgauccgacaggcaucgaacccgacgaucaucugaaggagagaagcucccuucgguaugggaacgugcuggacguuaaugccauugacaucgaggaaccuucuggacagaccgcugauugguacacaauuggcguguaugucaucggguucacccuccccaucauucugaaagcccuguacaugcucagcacgcgcggaagacagaccgugaaggagaacaaaggcacacggauccgcuuuaaggacgauaccuccuucgaagacauuaaugggaucagacggccuaagcaccuguauguuucuaugcccacagcgcaaagcaccaugaaagccgaggagcuuacgccuggacgcuuuagaacaauugugugcggccuguucccgacccagauccagguccggaacauuaugucccccgugaugggcgugaucggguuuagcuucuuugucaaggauugggcugaacgcaucagagaguucauggaaaaagaguguccuuuucucaagcccgaaauuaaaccuggaacacccgcccaggaggcugaguuccugaagaaaaauaagguuuacuuuaugcaacggcaggacgugcuugauaagaaccauguggccgacaucgauaaacugauugacuaugcggccucuggcgauccgaccuccccugacaauaucgaaagccccaacgcuccuugggucuucgccugcgcucccgacagaugucccccuaccugcauuuacguggccgggauggccgagcucggagcguuuuucucuauccugcaggauaugcgcaauacaaucauggcuuccaagacgguuggcaccgccgaagagaaacugaagaaaaagagcucuuucuaccaauccuaucuccggagaacacagagcauggggauucagcuggaccagcgcaucauucuucuguacaugcucgaauggggaaaggagaugguggaucacuuucaucugggcgacgauauggacccggagcuucggggccuggcucaagcccucaucgaucagaaagucaaggaaauuuccaaccaggagccccugaaaaucuga

SEQ ID NO: 7172 - RNA, 1302 nt, Artificial Sequence
  derived and/or modified CDS sequence (opt5) from PUUV(Bavaria 159/05)__EU439972.1__N
augagcgaccugaccgauauccacgaggacauuacaagacaugaacagcaacucguggucgcccggcagaagcugaaagaugcugagaaggccguugaaauggaccccgaugacgugaacaaaaauacgcuucaggcgcgccagcaaaccguguccgcucuggaggauaagcucgccgacuacaaaagacggauggccgaugcugucucucgcaagaagauggacacaaaaccuaccgauccgacaggcaucgaacccgacgaucaccugaaggagagaagcucccuucgguaugggaacgugcuggacguuaaugccauugacaucgaggaaccuucuggacagaccgcugauugguacacaauuggcguguaugucaucggguucacccuccccaucauucugaaagcccuguacaugcucagcacgcgcggaagacagaccgugaaggagaacaaaggcacacggauccgcuuuaaggacgauaccuccuucgaagacauuaaugggaucagacggccuaagcaucuguauguuucuaugcccacagcgcagagcaccaugaaagccgaggagcuuacgccuggacgcuuuagaacaauugugugcggccuguucccgacccaaauccagguccggaacauuaugucccccgugaugggcgugaucggguuuagcuucuuugucaaggauugggcugaacgcaucagagaguucauggaaaaagaguguccuuuuauuaagcccgaaaucaaaccuggaacacccgcccaggaggcugaguuccucaagcggaauaaaguuuacuuuaugcagagacaagacgugcuggauaagaaccacguggccgacauugauaaacuuaucgacuaugcggccucuggcgauccgaccuccccugacaauauugaaagccccaacgcuccuugggucuucgccugcgcucccgaccgcugucccccuaccugcaucuacguggccgggauggccgagcugggagcguuuuucucuauccuccaggauaugcggaauacaauuauggcuuccaagacgguuggcaccgccgaagagaagcugaaaaagaaaagcucuuucuaccaguccuaucugagacgcacacaaagcauggggauccagcucgaccagcggauuauccugcuuuacaugcuggaauggggaaaggagaugguggaucauuuucaccucggcgacgauauggacccggagcugagaggccuugcucaggcccugauugaucaaaaggucaaagaaaucuccaaccaggagccccucaagaucuga

SEQ ID NO: 7173 - RNA, 1299 nt, Artificial Sequence
  derived and/or modified CDS sequence (opt5) from PUUV(Bavaria CG 33/04)__DQ016430.2__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuacaaaagacggauggccgaugcugucucucgcaagaagauggacacaaaaccuaccgauccgacaggcaucgaacccgacgaucaucugaaggagagaagcucccuucgguaugggaacgugcuggacguuaaugccauugacaucgaggaaccuucuggacagaccgcugauugguacacaauuggcguguaugucaucggguucacccuccccaucauucugaaagcccuguacaugcucagcacgcgcggaagacagaccgugaaggagaacaaaggcacacggauccgcuuuaaggacgauaccuccuucgaagacauuaaugggaucagacggccuaagcaccuguauguuucuaugcccacagcgcaaagcaccaugaaagccgaggagcuuacgccuggacgcuuuagaacaauugugugcggccuguucccgacccagauccagguccggaacauuaugucccccgugaugggcgugaucggguuuagcuucuuugucaaggauugggcugaacgcaucagagaguucauggaaaaagaguguccuuuuauuaagcccgaaaucaaaccuggaacacccgcccaggaggcugaguuccucaagcggaauaaaguuuacuuuaugcaaagacaggacgugcuggauaagaaccauguggccgacauugauaaacuuaucgacuaugcggccucuggcgauccgaccuccccugacaauauugaaagccccaacgcuccuugggucuucgccugcgcucccgaccgcugucccccuaccugcaucuacguggccgggauggccgagcugggagcuuuuucuauccuccaggauaugcggaauacaauuauggcguccaagacgguuggcaccgccgaagagaagcugaaaaagaaaagcucuuucuaccaauccuaucugagacgcacacagagcauggggauccagcucgaccagcggauuauccugcuuuacaugcuggaauggggaaaggagaugguggaucacuuccaucucggcgacgauauggacccggagcugagaggccuugcucaagcccugauugaucagaaggucaaagaaaucuccaaccaggagccccucaagaucuga

SEQ ID NO: 7174 - RNA, 1302 nt, Artificial Sequence
  derived and/or modified CDS sequence (opt5) from PUUV(Bavaria CG 34/04)__AY954723.2__N
augagcgaccugaccgauauccaggaggacauuacaagacacgaacaacagcucguggucgcccggcagaagcugaaagaugcuggcaaggccguugagauggaccccgaugacgugaacaaaaauacgcuucaggcgcgccaacagaccguguccgcucuggaagauaagcucgccgacuacaaaagacggauggccgaugcugucucucgcaagaagauggacacaaaaccuaccgauccgacagggaucgagcccgacgaucaucugaaggaaagaagcucccuucgguauggaaacgugcuggacguuaaugccauugacaucgaggagccuucuggccagaccgcugauugguacacaauugggguguaugucaucggauucacccuccccaucauucugaaagcccuguacaugcucagcacgcgcggcagacagaccgugaaggaaaacaaagggacacggauccgcuuuaaggacgauaccuccuucgaggacauuaauggaaucagacggccuaagcaccuguauguuucuaugcccacagcgcaaagcaccaugaaagccgaggaacuuacgccuggccgcuuuagaacaauugugugcggccuguucccgacccagauccagguccggaacauuaugucccccgugaugggggugaucggauuuagcuucuuugucaaggauugggcugagcgcaucagagaauuuauggagaaagaauguccuuuuauuaagcccgagaugaaaccuggcacacccgcccaggaagcugaguuccucaagcggaauaaaguuuacuuuaugcaaagacaggacgugcuggauaagaaccauguggccgacaucgauaaacuuauugacuaugcggccucuggggauccgaccuccccugacaauaucgagagccccaacgcuccuugggucuucgccugcgcucccgaccgcugucccccuaccugcauuuacguggccggaauggccgaacugggcgcuuucuucucuauccuccaggauaugcggaauacaaucauggcguccaagacgguugggaccgccgaggaaaagcugaaaaagaaaagcucuuucuaccaauccuaucugagacgcacacagagcaugggcauucagcucgaccagcggaucauucugcuuuacaugcuggaguggggaaaggaaaugguggaucacuuucaucucggcgacgauauggacccggagcugagagggcuugcucaagcccugaucgaucagaaggucaaagagauuuccaaccaggaaccccucaagaucuga

SEQ ID NO: 7175 - RNA, 1302 nt, Artificial Sequence
  derived and/or modified CDS sequence (opt5) from PUUV(Bavaria CG 41/04)__DQ016432.2__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaaccucgccgacuacaagagacggauggccgaugcugucucucgcaaaaagauggacacaaagccuaccgauccgacaggcaucgaacccgacgaucaucugaaagagagaagcucccuucgguaugggaaugugcuggacguuaacgccauugacaucgaggaaccuucuggacagaccgcugauugguacacaauuggcguguaugucaucggguucacccuccccaucauucugaaggcccuguacaugcucagcacgcgcggaagacagaccgugaaagagaauaagggcacacggauccgcuuuaaagacgauaccuccuucgaagacauuaacgggaucagacggccuaagcaccuguauguuucuaugcccacagcgcaaagcaccaugaaggccgaggagcuuacgccuggacgcuuuagaacaauugugugcggccuguucccgacccagauccagguccggaauauuaugucccccgugaugggcgugaucggguuuagcuucuuugucaaagauugggcugaacgcaucagagaguucauggaaaaggaguguccuuuuauuaaacccgaaaugaagccuggaacacccgcccaggaggcugaguuccucaaacggaacaagguuuacuuuaugcaaagacaggacgugcuggauaaaaaucauguggccgacaucgauaaacuuauugacuaugcggccucuggcgauccgaccuccccugacaacaucgaaagccccaaugcuccuugggucuucgccugcgcucccgaccgcugucccccuaccugcauuuacguggccgggauggccgagcugggagcguuuuucucuauccuccaggauaugcggaacacaaucauggcuuccaagacgguuggcaccgccgaagagaagcugaagaaaaagagcucuuucuaccaauccuaucugagacgcacacagagcauggggauucagcucgaccagcggaucauucugcuuuacaugcuggaauggggaaaagagaugguggaucacuuucaucucggcgacgauauggacccggagcugagaggccuugcucaagcccugaucgaucagaaggucaaggaaauuuccaaucaggagccccucaaaaucuga

SEQ ID NO: 7176 - RNA, 1302 nt, Artificial Sequence
  derived and/or modified CDS sequence (opt5) from PUUV(Bavaria CG 9/04)__AY954722.2__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuacaaaagacggauggccgaugcugucucucgcaagaagauggacacaaaaccuaccgauccgacaggcaucgaacccgacgaucaucugaaggagagaagcucccuucgguaugggaacgugcuggacguuaaugccauugacaucgaggaaccuucuggacagaccgcugauugguacacaauuggcguguaugucaucggguucacccuccccaucauucugaaagcccuguacaugcucagcacgcgcggaagacagaccgugaaggagaacaaaggcacacggauccgcuuuaaggacgauaccuccuucgaagacauuaaugggaucagacggccuaagcaccuguauguuucuaugcccacagcgcaaagcaccaugaaagccgaggagcuuacgccuggacgcuuuagaacaauugugugcggccuguucccgacccagauccagguccggaacauuaugucccccgugaugggcgugaucggguuuagcuucuuugucaaggauugggcugaacgcaucagagaguucauggaaaaagaguguccuuuuauuaagcccgaaaugaaaccuggaauccccgcccaggaggcugaguuccucaagcggaauaaaguuuacuuuaugcaaagacaggacgugcuggauaagaaccauguggccgacauugauaaacuuaucgacuaugcggccucuggcgauccgacauccccugacaauauugaaagccccaacgcuccuugggucuucgccugcgcucccgaccgcugucccccuaccugcaucuacguggccgggauggccgagcugggagcguuuuucucuauccuccaggauaugcggaauaccauuauggcuuccaagacaguuggcacggccgaagagaagcugaaaaagaaaagcucuuucuaccaauccuaucugagacgcacccagagcauggggauccagcucgaccagcggauuauccugcuuuacaugcuggaauggggaaaggagaugguggaucacuuucaucucggcgacgauauggacccggagcugagaggccuugcucaagcccugauugaucagaaggucaaagaaaucuccaaccaggagccccucaagaucuga

SEQ ID NO: 7177 - RNA, 1302 nt, Artificial Sequence
  derived and/or modified CDS sequence (opt5) from PUUV(Bergsjobo/Mg25/05)__GQ339483.1__N
augagcgaccuggccgauauccaggacgagauuaccagacacgaacaacagcucguggcugcccggcagaagcugaaagaugcggagcgcgcugucgaaguugaccccgaugacgugaacaagaauacacuucaggccagacaacagacgguguccgcccuggaggauaaacucgcugacuucaagcggcgcauggccgaugcugucucuagaaagaagauggacaccaagccuacagauccgaccggcaucgaacccgacgaucaucugaaagagcggagcucccuucgcuacgggaacgugcuggacguuaaugccauugacaucgaggaaccuucuggacagacagcggauugguauaccauuggcguguacgucaucggguuuacacuccccaucauucugaaggcccuguauaugcucagcaccagaggacggcagacggugaaagagaacaagggcacccgcaucagauucaaagacgauacauccuuugaagacauuaaugggauccggcgcccuaagcaccuguacguuucuaugcccaccgcucaaagcacaaugaaggccgaggagcuuaccccuggaagauuccggacgauugugugcggccuguuuccgacacagauccagguccgcaacauuaugucccccgugaugggcgugaucggguucagcuuuuucgucaaagauugggcugaaagaauccgggaguuuauggaaaaggaguguccuuucauuaaacccgaaguuaagccuggaacccccgcccaggagguggaguuucucaaaaagaauaaaaucuauuucaugcaaagacaggacgugcuggauaagaaccaugucgcggacauugauaaacuuaucgacuacgccgcuucuggcgauccgacauccccugacaauauugaaagccccaacgccccuuggguguuugcuugcgcccccgaccgcugucccccuaccugcaucuauguugccgggauggcugagcugggagcguucuucucuauccuccaggauaugcggaauaccauuauggccuccaaaacagugggcacggcugaagagaagcugaaaaagaaaagcucuuuuuaccaauccuaccugagacgcacccagagcauggggauccagcucgaccagcggauuauccugcuuuauaugcuggaauggggaaaggagauggucgaucacuuccaucucggcgacgauauggacccggagcugagaggccuugcccaagcccugauugaucagaaggugaaagaaaucuccaaccaggagccccucaagaucuga

SEQ ID NO: 7178 - RNA, 1302 nt, Artificial Sequence
  derived and/or modified CDS sequence (opt5) from PUUV(CG14444)__AJ277075.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacagauggccgaugcugucucucggaagaagauggacacaaaaccuaccgauccgacaggcaucgaacccgacgaucaucugaaggagcgcagcucccuuagauacgggaacgugcuggacguuaaugccauugacaucgaggaaccuucuggacagaccgcugauugguauacaauuggcguguacgucaucggguuuacccuccccaucauucugaaagcccuguauaugcucagcacgcggggacgccaaaccgugaaggagaacaaaggcacaagaauccgguucaaggacgauaccuccuuugaagacauuaaugggauccgcagaccuaagcaccuguacguuucuaugcccacagcgcagagcaccaugaaagccgaggagcuuacgccuggacgguuccgcacaauugugugcggccuguuuccgacccagauccaggucagaaacauuaugucccccgugaugggcgugaucggguucagcuuuuucgucaaggauugggcugaccggauccgcgaauuuauggagaaagaauguccuuucauuaagcccgagguuaaaccuggaacacccgcccaagaagcugaguuucucaagagaaauaaaaucuauuucaugcagcggcaggaggugcuggauaagaaccauguggccgacauugauaaacuuaucgacuacgcggccucuggcgauccgaccuccccugacaauauugaagcucccaacgccccuugggucuuugcuugcgcccccgacagaugucccccuaccugcaucuauguggccgggauggcugagcugggagcguucuucagcauccuccaagauaugcgcaauacaauuauggccucuaagacgguuggcaccgcugaagagaagcugaaaaagaaauccagcuuuuaccagucuuaccugcggagaacacaguccauggggauccagcucgaccaacgcauuauccugcuuuauaugcuggaauggggaaaggagaugguggaucacuuccaucucggcgacgauauggacccggagcugcggggccuugcccaggcccugauugaucagaaggucaaagaaaucagcaaccaggagccccucaagaucuga

SEQ ID NO: 7179 - RNA, 1302 nt, Artificial Sequence
  derived and/or modified CDS sequence (opt5) from PUUV(CG14445)__AJ277076.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacagauggccgaugcugucucucggaagaagauggacacaaaaccuaccgauccgacaggcaucgaacccgacgaucaucugaaggagcgcagcucccuuagauacgggaacgugcuggacguuaaugccauugacaucgaggaaccuucuggacagaccgcugauugguauacaauuggcguguacgucaucggguuuacccuccccaucauucugaaagcccuguauaugcucagcacgcggggacgccaaaccgugaaggagaacaaaggcacaagaauccgguucaaggacgauaccuccuuugaagacauuaaugggauccgcagaccuaagcaccuguacguuucuaugcccacagcgcagagcaccaugaaagccgaggagcuuacgccuggacgguuccgcacaauugugugcggccuguuuccgacccagauccaggucagaaacauuaugucccccgugaugggcgugaucggguucagcuuuuucgucaaggauugggcugaccggauccgcgaauuuauggagaaagaauguccuuucauuaagcccgagguuaaaccuggaacacccgcccaagaagcugaguuucucaagagaaauaucauuuauuucaugcagcggcaggaggugcuggauaaaaaccauguggccgacaucgauaaacuuauugacuacgcggccucuggcgauccgaccuccccugacaauaucgaagcucccaacgccccuugggucuuugcuugcgcccccgacagaugucccccuaccugcaucuauguggccgggauggcugagcugggagcguucuucagcauucuccaagauaugcgcaauacaaucauggccucuaagacgguuggcaccgcugaagagaagcugaagaaaaaguccagcuuuuaccagucuuaccugcggagaacacaguccauggggauucagcucgaccaacgcaucauucugcuuuauaugcuggaauggggaaaagagaugguggaucacuuccaucucggcgacgauauggacccggagcugcggggccuugcccaggcccugaucgaucagaaggucaaggaaaucagcaaccaggagccccucaaaauuuga

SEQ ID NO: 7180 - RNA, 1302 nt, Artificial Sequence
  derived and/or modified CDS sequence (opt5) from PUUV(CG1820/POR)__KT885052.1__N
augagcgaccugaccgauauccaggaggaaauuacaagacacgagcaacagcucguggucgcccggcagaagcugaaagacgcugaacgcgccguugagguggaucccgacgaugugaacaaguccacgcuucaggcgagacaacagaccgucucugcucuggaagacaaacucgccgauuacaagcggcgcauggccgacgcugugagccggaaaaagauggauacaaagccuaccgacccgacaggcaucgagcccgaugaccaucugaaagagagauccucucuucgcuaugggaauguucuggaugugaacgccauugacaucgaagaaccuagcggacagaccgcugacugguacacaauuggcgucuaugugaucggguucaccauccccauuauccucaaggcccuguacaugcuguccacgagaggacggcagaccguuaaagaaaauaagggcacacgcauuagauuuaaagaugacaccucuuucgaggauaucaacgggauucggcgcccuaagcaccucuaugugagcaugcccacagcgcaauccaccaugaaggccgaggaacugacgccuggaagauuucggacaaucgucugcggccuuuucccgacccagauucaggugcgcaauaucaugagccccgugaugggcgucaucggguuuucuuucuuuguuaaagacuggccugagaagauuagagaguucauggagaaagaaugucccuuuaucaagccugaggugaaacccggaacaccggcucaggagguggaguuccugaagcggaacagagucuacuuuaugacccgccaagaugugcucgacaaaaaucauguugccgauauugacaagcugaucgauuaugcugccuccggcgacccuaccagccccgaugacauugaaucuccuaacgcgcccuggguguucgccugcgcucccgaccgguguccuccgacaugcaucuacgucgccgggauggcugaacuuggagccuuuuucuccauccugcaggauaugagaaauacgauuauggccagcaagaccgugggcacagcugaggaaaaacucaagaaaaagucuuccuucuaccagagcuaucugcgccggacccaauccauggggauccagcuggaccagagaauuauccuccuguacaugcuugaguggggaaaagagaugguugaucacuuucaucugggcgacgauauggaccccgaacuccgcggccuggcgcagucucuuauugaucaaaaggugaaggagaucagcaaccaggaaccucugaaaaucuga

SEQ ID NO: 7181 - RNA, 1302 nt, Artificial Sequence
  derived and/or modified CDS sequence (opt5) from PUUV(Couvin/59Cg/97)__AJ277034.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacagauggccgaugcugucucucggaagaagauggacacaaaaccuaccgauccgacaggcaucgaacccgacgaucaucugaaggagcgcagcucccuuagauacgggaacgugcuggacguuaaugccauugacaucgaggaaccuucuggacagaccgcugauugguauacaauuggcguguacgucaucggguuuacccuccccaucauucugaaagcccuguauaugcucagcacgcggggacgccaaaccgugaaggagaacaaaggcacaagaauccgguucaaggacgauaccuccuuugaagacauuaaugggauccgcagaccuaagcaccuguacguuucuaugcccacagcgcagagcaccaugaaagccgaggagcuuacgccuggacgguuccgcacaauugugugcggccuguuuccgacccagauccaggucagaaacauuaugucccccgugaugggcgugaucggguucagcuuuuucgucaaggauugggcugaccggauccgcgaauuuauggagaaagaauguccuuucauuaagcccgagguuaaaccuggaacacccgcccaagaagcugaguuucucaagagaaauaaaaucuauuucaugcagcggcaggaugugcuggacaagaaccauguggccgauauugacaaacuuaucgauuacgcggccucuggcgacccgaccuccccugacaauauugaggcucccaacgccccuugggucuuugcuugcgcccccgauagaugucccccuaccugcaucuauguggccgggauggcugaacugggagcguucuucagcauccuccaagacaugcgcaauacaauuauggccucuaagacgguuggcaccgcugaggaaaagcugaaaaagaaauccagcuuuuaccagucuuaccugcggagaacacaguccauggggauccagcucgaucaacgcauuauccugcuuuauaugcuggaguggggaaaggaaaugguggaccacuuccaucucggcgaugacauggauccggagcugcggggccuugcccaggcccugauugaccagaaggucaaagagaucagcaaccaggaaccccucaagaucuga

SEQ ID NO: 7182 - RNA, 1302 nt, Artificial Sequence
  derived and/or modified CDS sequence (opt5) from PUUV(Evo/12Cg/93)__Z30702.1__N
augagcgaccugaccgauauccaggaggacauuacaagacacgaacaacagcucguggucgcccggcagaagcugaaagaugcugagcgcgccguugaaguggaccccgaugacgugaacaagaauacgcuucaggcgagacaacagaccgucuccgcucuggaggauaaacucgccgacuacaagcggcgcauggccgaugcugugucucggaaaaagauggacacaaagccuaccgauccgacaggcaucgaacccgacgaucaucugaaagagcggagcucccuucgcuaugggaacguucuggacgugaaugccauugacaucgaggaaccuucuggacagaccgcugauugguacacaauuggcgucuaugugaucggguucaccauccccauuauccucaaggcccuguacaugcugagcacgagaggacggcagaccguuaaagagaacaagggcacacgcauuagauuuaaagacgauaccuccuucgaagacaucaaugggauucggcgcccuaagcaccucuaugugucuaugcccacagcgcaaagcaccaugaaggccgaggagcugacgccuggaagauuucggacaaucgucugcggccuuuucccgacccagauucaggugcgcaacaucaugucccccgugaugggcgucaucggguuuagcuucuuuguuaaagauuggccugaaagaauuagagaguucauggaaaaggagugucccuuuaucaaaccugaaauuaagcccggaacaccggcucaggagauggagaugcugaaaagaaauaagaucuacuucaugcaacgccaggacgugcucgauaaaaaccauguggccgacauugauaagcugaucgacuaugcugccucuggcgauccuaccucccccgacaauaucgacagcccuaacgcgcccugggucuuugccugcgcucccgaucgguguccuccgaccugcauuuacguggccgggauggcugaacuuggagccuucuuuucuauccugcaggacaugagaaauacaauuauggccuccaagacgguuggcaccgcugaggaaaaacuccgcaagaaaagcucuuucuaccaauccuaucugcggagaacacagagcauggggauccagcuggaucagcgcauuauccuccuguucaugcuugaguggggaaaggaaaugguggaccacuuucaucugggcgaugacauggaucccgagcuccggggccuggcgcaagcccuuaucgaccagaaagucaaggagauuuccaaccaggaaccucugaagaucuga

SEQ ID NO: 7183 - RNA, 1302 nt, Artificial Sequence
  derived and/or modified CDS sequence (opt5) from PUUV(Evo/14Cg/93)__Z30704.1__N
augagcgaccugaccgauauccaggaggacauuacaagacacgaacaacagcucguggucgcccggcagaagcugaaagaugcugagcgcgccguugaaguggaccccgaugacgugaacaagaauacgcuucaggcgagacaacagaccgucuccgcucuggaggauaaacucgccaacuacaagcggcgcauggccgacgcugugucucggaaaaagauggauacaaagccuaccgacccgacaggcaucgaacccgaugaccaucugaaagagcggagcucccuucgcuaugggaauguucuggaugugaacgccauugacaucgaggaaccuucuggacagaccgcugacugguacacaauuggcgucuaugugaucggguucaccauccccauuauccucaaggcccuguacaugcugagcacgagaggacggcagaccguuaaagagaauaagggcacacgcauuagauuuaaagaugacaccuccuucgaagauaucaacgggauucggcgcccuaagcaccucuaugugucuaugcccacagcgcaaagcaccaugaaggccgaggagcugacgccuggaagauuucggacaaucgucugcggccuuuucccgacccagauucaggugcgcaauaucaugucccccgugaugggcgucaucggguuuagcuucuuuguuaaagacuggccugaaagaauuagagaguucauggaaaaggagugucccuuuaucaaaccugaaauuaagcccggaacaccggcucaggagauggagaugcugaaaagaaacaagaucuacuucaugcaacgccaggaugugcucgacaaaaaucauguggccgauauugacaagcugaucgauuaugcugccucuggcgggccuaccucccccgacaacaucgauagcccuaaugcgcccugggucuuugccugcgcucccgaccgguguccuccgaccugcauuuacguggccggaauggcugaacuuggcgccuucuuuucuauccugcaggacaugagaaacacaauuauggccuccaagacgguugggaccgcugaggaaaaacucaagaaaaagagcucuuucuaccaauccuaucugcgccggacacagagcaugggaauccagcuggaucagagaauuauccuccuguucaugcuugaguggggcaaagaaaugguggaccacuuucaucugggcgaugacauggaucccgagcuccgcgggcuggcgcaagcccuuaucgaccagaaggucaaggagauuuccaaucaggaaccucugaaaaucuga

SEQ ID NO: 7184 - RNA, 1302 nt, Artificial Sequence
  derived and/or modified CDS sequence (opt5) from PUUV(Evo/15Cg/93)__Z30705.1__N
augagcgaccugaccgauauccaggaggacauuacaagacacgaacaacagcucguggucgcccggcagggccugaaggaugcugagcgcgccguugaaguggaccccgaugacgugaacaaaaaugcgcuucaggcuagacaacagacggucuccgcccuggaggauaagcucgccgacuacaaacggcgcauggcugaugccgugucuagaaagaaaauggacaccaagccuacagauccgaccgggaucgaacccgacgaucaucugaaggagcggagcucccuucgcuauggaaacguuuucgacgugaaugcuauugacaucgaggaaccuucuggccagacagccgauugguacaccauuggggucuaugugaucggauuuacaauccccauuauccugaaagcgcucuacaugcugagcaccagaggccggcagacgguuaaggagaacaaagggacccgcauuagauucaaggacgauacauccuuugaagacaucaauggaauuagacgcccuaaacaccuguaugugucuaugcccaccgcccaaagcacaaugaaggcugaggagcucaccccuggcagauuccggacgaucgucugcggccuguuuccgacacagauucaggugcgcaacaucaugucccccgugaugggggucaucggauucagcuuuuucguuaaggauuggccugaacggauucgggaguuuauggaaaaagagugucccuucaucaagccugaaauuaaacccggcaccccggcccaggagauggagaugcuuaagagaaauaaaaucuacuuuaugcaacgccaggacgugcuggauaagaaccauguggcugacauugauaaacucaucgacuaugccgcgucuggggauccuacaucccccgacaauaucgacagcccuaacgcccccugggucuucgcuugcgcccccgaucgguguccuccgaccugcauuuacguggcuggaauggccgaacugggcgccuuuuucucuauccuucaggacaugagaaauaccauuauggcuuccaagacaguugggacggcggaggaaaagcugaaaaagaaaagcucuuucuaccaauccuaucuccgccggacccagagcaugggaauccagcuggaucagagaauuauccugcucuuuaugcuggaguggggcaaggaaaugguggaccacuuccaucuuggcgaugacauggaucccgagcugcgcgggcucgcccaagcucugaucgaccagaaagucaaggagauuuccaaccaggaaccucuuaagaucuga

SEQ ID NO: 7185 - RNA, 1302 nt, Artificial Sequence
  derived and/or modified CDS sequence (opt5) from PUUV(Faboviken/Mg26/05)__GQ339484.1__N
augagcgaccuggccgauauccaggacgagauuaccagacacgaacaacagcucguggcugcccggcagaagcugaaagaugcggagcgcgcugucgaaauggaccccgaugacguuaacaagaauacacuucaggccagacaacagacgguguccgcccuggaggauaaacucgcugacuucaagcggcgcauggccgaugcugugucuagaaagaagauggacaccaagccuacagauccgaccggcaucgaacccgacgaucaucugaaagagauuagcucccuucgguacgggaacguccuggacgugaaugccaucgacauugaggaaccuucuggacagacagcggauugguauaccaucggcguuuacgugaucggguuuacacuccccauuauccugaaggcccuguauaugcucagcacccgcggaagacagacggucaaagagaacaagggcacccggauucgcuucaaagacgauacauccuuugaagacaucaaugggauuagacggccuaagcaccuguacgugucuaugcccaccgcucaaagcacaaugaaggccgaggagcuuaccccuggacgcuucagaacgaucguuugcggccuguuuccgacacagauucaggugcggaacaucaugucccccgucaugggcgugaucggguucagcuuuuucgugaaagauugggcugaacgcauuagagaguuuauggaaaaggaguguccuuucaucaaacccgaagucaagccuggaacccccgcccaggagguugaguuucucaaaaagaauaaaauuuauuucaugcaacggcaggacgugcuggauaagaaccauguggcggacaucgauaaacuuauugacuacgccgcuucuggcgauccgacauccccugacaauaucgaaagccccaacgccccuugggucuuugcuugcgcccccgacagaugucccccuaccugcaucuauguggccgggauggcugagcugggagcguucuucucuauucuccaggauaugcgcaauaccaucauggccuccaaaacaguuggcacggcugaagagaagcugaaaaagaaaagcucuuuuuaccaauccuaccugcggagaacccagagcauggggauucagcucgaccagcgcaucauucugcuuuauaugcuggaauggggaaaggagaugguggaucacuuccaucucggcgacgauauggacccggagcugcggggccuugcccaagcccugaucgaucagaaggucaaagaaaucuccaaccaggagccccucaagauuuga

SEQ ID NO: 7186 - RNA, 1302 nt, Artificial Sequence
  derived and/or modified CDS sequence (opt5) from PUUV(Fyn)__AJ238791.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaccgauccgacaggcaucgaacccgacgaucaucugaaggagagaagcucccuucgguacgggaacgugcuggacguuaaugccauugacaucgaggaaccuucuggacagaccgcugauugguauacaauuggcguguacgucaucggguuuacccuccccaucauucugaaagcccuguauaugcucagcacgcgcggaagacagaccgugaaggagaacaaaggcacacggauccgcuucaaggacgauaccuccuuugaagacauuaaugggaucagacggccuaagcaccuguacguuucuaugcccacagcgcaaagcaccaugaaagccgaggagcuuacgccuggacgcuucagaacaauugugugcggccuguuuccgacccagauccagguccggaacauuaugucccccgugaugggcgugaucggguucagcuuuuucgucaaggauugggcugaacgcaucagagaguuuauggaaaaagaguguccuuucauuaagcccgaacucaaaccuggaacaaaugcccaggaggcugaguuucugaagaaaaaccggguuuauuuccuuaauagacaagacgugcuggauaagaaccauguggccgacaucgauaagcucauugacuacgcggccucuggcgaucccaccuccccggacaauaucgaagcuccuaacgcccccugggucuuuagcugcgcuccugaccgcugucccccuaccugcauuuauguggccgggauggccgagcugggagcuuucuucucuauccugcaggauaugcggaauacaaucauggcguccaaaacgguuggcaccgccgaagagaagcucaaaaagaaaagcucuuuuuaccaguccuaccugagacgcacacaaagcauggggauucagcuugaccagcggaucauucugcucuauaugcuggaauggggaaaggagaugguggaucacuuccaucuuggcgacgauauggaccccgagcugagaggccucgcucaggcccugaucgaucaaaaggucaaagaaauuuccaaccaggagccgcugaagaucuga

SEQ ID NO: 7187 - RNA, 1302 nt, Artificial Sequence
  derived and/or modified CDS sequence (opt5) from PUUV(Fyn131)__AJ278093.1__N
augagcgaccugaccgauauccaggaggacauuacaagacacgaacaacagcucguggucgcccggcagaagcugaaagaugcugagaaggccguugaaauggaccccgaugacgugaacaaaaauacgcuugaggcgcgccagcaaaccguguccgcucuggaagauaagcucgccgacuucaaaagacggaugacagaugccgucucucgcaagaagauggacaccaaaccuacagauccgaccggcaucgagcccgacgaucaucugaaggagagaagcucccuucgguacgggaacgugcuggacguuaaugcuauugacaucgaggaaccuucuggacagacagccgauugguauaccauuggcguguacgucaucggguuuacgcuccccaucauucugaaagcucuguauaugcucagcacccgcggaagacagacagugaaggaaaacaaaggcacccggauccgcuucaaggacgauacauccuuugaggacauuaaugggaucagacggccuaagcaccuguacguuucuaugcccaccgccccuagcacgaugaaagcggaggaacuuacaccgggacgcuucagaaccauugugugcggccuguuucccacacagauccaaguccggaacauuauguccccugugaugggcgugaucgggagcucuuucuuugucaaggauugggccgaccgcaucagagaguucauggaaaaagagugucccuuuguuaagccugaacucaaacccggaaccaaugcucaggaggccgaguuccugaagaaaaaccggguguauuuuaugaauagacaggaugugcuugacaagaaccaugucgcugauauugacaagcugaucgauuacgccgcguccggcgacccgaccugcccugacaauauugaagcccccaacgcuccuuggggguucgccugugcuccccaccgcugucccccuacaugcaucuauguggccggaauggccgagcucggcgcguuuuucagcauucugcaggauaugcggaauacgaucauggcuucuaaaaccguugggacagccgaagagaagcugaaaaagaaauccagcuucuaccaaucuuaccucagacgcacccaguccaugggaauccagcuggaccaacggauuauccuucuguauaugcucgaauggggcagagagaugguggaucauuuucaccugggcgacgauauggacccggagcuucgcgggcuggcucaggcccucauuaaccagaaggucaaggaaaucagcaaucaggagccccugaaaauuuga

SEQ ID NO: 7188 - RNA, 1302 nt, Artificial Sequence
  derived and/or modified CDS sequence (opt5) from PUUV(Fyn47)__AJ278092.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaccgauccgacaggcaucgaacccgacgaucaucugaaggagagaagcucccuucgguacgggaacgugcuggacguuaaugccauugacaucgaggaaccuucuggacagaccgcugauugguauacaauuggcguguacgucaucggguuuacccuccccaucauucugaaagcccuguauaugcucagcacgcgcggaagacagaccgugaaggagaacaaaggcacacggauccgcuucaaggacgauaccuccuuugaagacauuaaugggaucagacggccuaagcaccuguacguuucuaugcccacagcgccuagcaccaugaaagccgaggagcuuacgccgggacgcuucagaacaauugugugcggccuguuucccacccaaauccagguccggaagauuauguccccugugaugggcgugaucggguucagcuuuuucgucaaagauuggguugaacgcaucagagaguuuauggaaaaggagugucccuucgugaaaccugaacucaagcccggaacaaacgcucaggaggccgaguuucugaaaaagaaucggguguauuucaugaacagacaggacguccuugauaagaaucauguggcugacauugauaaacugaucgacuacgccgcgucuggcgauccgaccuccccugacaacauugaagcccccaaugcuccuuggguuuuugccugcgcuccccaccgcugucccccuaccugcaucuauguggccgggauggccgagcucggagcuuucuucagcauucugcaagacaugcggaacgcgaucauggccucuaagacagucggcacggcugaagagaaacugaagaaaaaguccagcuuuuaccagucuuaccucagacgcacccaguccguggggauccaacuggaucagcggauuauccuucuguauaugcucgaauggggaagagagaugguugaccauuuccaccugggcgaugacauggauccggagcuucgcggccuggcccaggcccucauugaccagaaggugaaagaaaucagcaaucaagagccccugaagauuuga

SEQ ID NO: 7189 - RNA, 1302 nt, Artificial Sequence
  derived and/or modified CDS sequence (opt5) from PUUV(Gomselga)__AJ238790.1__N
augagcgaccugaccgauauccaggaggacauuacaagacacgaacaacagcucguggucgcccggcagaagcugaaagaugcugagcgcgccguugaaguggaccccgaugacgugaacaagaauacgcuucaggcgagacaacagaccgucuccgcucuggaggauaaacucgccgacuacaagcggaaaauggccgaugcugugucucgcaagaagauggacacaaaaccuaccgauccgacaggcaucgaacccgacgaucaucugaaggagagaagcucccuucgguaugggaacguucuggacgugaaugccauugacaucgaggauccuucuggacagaccgcugacugguacacaauuggcgucuaugugaucggguucacccuccccaucauucugaaagcccuguacaugcucagcacgcgcggaagacagaccguuaaggaaaacaaaggcacacggauccgcuuuaaggaugacaccuccuucgaggaaauuaaugggaucagacggccuaagcaccuguaugugucuaugcccacagcgcaaagcaccaugaaagccgaggagcuuacgccuggacgcuuuagaacaauugucugcggccuguucccgacccagauccaggugcggaacauugugucccccgucaugggcguuaucggguuuagcuucuuugugaaggauuggucucagcgcaucacagaguucauggaaaaagaauguccuuuuauuaagcccgaggugaaaccuggaacccccgcucaagaaaucgagauguucaagagaaauaaaauuuacuuuaugcagcggcaggacguccucgauaagaaccauguggccgacaucgauaaguccauugacuaugcugccagcgaggauccgaccucuccugacaauaucgacucccccaacgcgccuuggguuuucgccugcgcucccgauagaugucccccuacaugcaucuacguggccggcauggcugaacugggggccuuuuucagcauucuucaagacaugcgcaauacgaucauggccucuaaaaccgucggaacagcugaggaaaagcugaaaaagaaauccagcuucuaccaguccuaucuccggagaacccagucuaugggcauucagcuggaucaacgcaucauucugcucuuuaugcuggagugggggaaggaaaugguggaccacuuccaucuuggagaugacauggauccggagcugcggggccucgcgcaggcccugaucgaccagaagguuaaagagaucagcaaccaggaaccccuuaagauuuga

SEQ ID NO: 7190 - RNA, 1302 nt, Artificial Sequence
  derived and/or modified CDS sequence (opt5) from PUUV(Gyttjea/Mg19/05)__GQ339480.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacagauggccgaugcugucucucggaagaagauggacacaaaaccuaccgauccgacaggcaucgaacccgacgaucaucugaaggagcgcagcucccuuagauacgggaacgugcuggacguuaaugccauugacaucgaggaaccuucuggacagaccgcugauugguauacaauuggcguguacgucaucggguuuacccuccccaucauucugaaagcccuguauaugcucagcacgcggggacgccaaaccgugaaggagaacaaaggcacaagaauccgguucaaggacgauaccuccuuugaagacauuaaugggauccgcagaccuaagcaccuguacguuucuaugcccacagcgcagagcaccaugaaagccgaggagcuuacgccuggacgguuccgcacaauugugugcggccuguuuccgacccagauccaggucagaaacauuaugucccccgugaugggcgugaucggguucgccuuuuucgucaagggaugggcugaucggauccgcgaauuuauggagaaagaauguccuuucauuaagcccgagguuaaaccuggcacacccacccaagaaaucgaguuucucaagaaaaauaagguguauuuccuggacagacagaccgugcuugauaagaaccaugucgcugacauugauaaacugaucgacuacgccgcgagcggggauccgacaucuccugacaauauugagucccccaacgccccuuggguguuugcuugcgcccccgaccggugucccccuacgugcaucuauguugcuggaauggccgaacucggcgccuucuucagcauccugcaggauaugagaaauaccauuauggcuucuaagacaguggggaccgcggaggaaaaacugaagaaaaaguccagcuuuuaccaaucuuaccuccgccggacacaguccaugggaauccagcuggaccagagaauuauccuucuguucaugcucgaguggggcaaggaaauggucgaucacuuucaucugggcgacgauauggacccggagcuucgcgggcuggcccaagcucucauugaucagaaagugaaggagaucagcaaccaggaaccccugaaaaucuga

SEQ ID NO: 7191 - RNA, 1302 nt, Artificial Sequence
  derived and/or modified CDS sequence (opt5) from PUUV(Karhumaki)__AJ238788.1__N
augagcgaccugaccgauauccaggaggacauuacaagacacgaacaacagcucguggucgcccggcagaagcugaaagaugcugagcgcgccguugaaguggaccccgaugacgugaacaagaauacgcuucaggcgagacaacagaccgucuccgcucuggaggauaaacucgccgacuacaagcggaaaauggccgaugcugugucucgcaagaagauggacacaaaaccuaccgauccgacaggcaugaagcccgacguucaucugaaagaaagaagcucccuugaguaugggaacgugcuggaugucaaugccaucgacauugaggaaccuucuggacagaccgcugacugguacacaaucggcguguauguuauuggguucacccuccccaucauccugaaggcccuguacaugcucagcacgcggggacgccagaccgugaaagagaacaagggcacacggauuagauuuaaggaugacaccuccuucgaagauaucaaugggauucgcagaccuaaacaccuguaugucucuaugcccacagcgcaaagcaccaugaaggccgaggagcuuacgccuggacgguuucgcacaaucgugugcggccuguucccgacccagauucaggugagaaacaucaugucccccgucaugggcguuauuggguuuagcuucuuugugaaagacuggucugaacggauccgcgaguucauggaaaaggaguguccuuuuaucaaacccgaagugaagccuggaacacccgcucaggagauugagaugcucagacggaauaaaaucuacuucaugcaaagacaggauguccuggacaagaaccauguggccgauauugacaaacuuaucgaucuggcugccuccggcgacccgaccagcccugauaauauugacucucccaacgcgccuuggguuuuugccugcgcucccgugcgcugucccccuaccugcaucuaugucgccgggauggcugaacucggagccuucuuuuccauccugcaggacaugcggaauacaauuauggccagcaagacggugggcaccgcugaggaaaagcugaaaaagaaaucuuccuucuaccaaagcuaccucagacgcacacaguccauggggauccagcuggaucagcggauuauccuucuguucaugcucgaguggggaaaggaaaugguugaccacuuucaucugggcgaugacauggauccggagcuuagaggccuggcgcaagcccucauugaccagaaggugaaagagaucucuaaccaggaaccccugaagaucuga

SEQ ID NO: 7192 - RNA, 1302 nt, Artificial Sequence
  derived and/or modified CDS sequence (opt5) from PUUV(Kolodozero)__AJ238789.1__N
augagcgaccugaccgauauccaggaggacauuacaagacacgaacaacagcucguggucgcccggcagaagcugaaagaugcugagcgcgccguugaaguggaccccgaugacgugaacaagaauacgcuucaggcgagacaacagaccgucuccgcucuggaggauaaacucgccgacuacaagcggcgcauggccgaugcugugucuagaaagaagauggacacaaagccuaccgauccgacaggcaucgaacccgacgaucaucugaaagagcggagcucccuucgcuaugggaacguucuggacgugaaugccauugacaucgaggaaccuucuggacagaccgcugauugguacacaauuggcgucuaugugaucggguucacccuccccaucauucugaaggcccuguacaugcucagcacgagaggacggcagaccguuaaagagaacaagggcacacgcaucagauuuaaagacgauaccuccuucgaagacauuaaugggauccggcgcccuaagcaccuguaugugucuaugcccacagcgcaaagcaccaugaaggccgaggagcuuacgccuggaagauuucggacaauugucugcggccugaucccgacccagauucaggugcgcaacaucaugucccccgugaugggcgucaucggguucagcuuuuucguuaaagauuggucugaacggauuagagaguuuauggaaaaggaguguccuuucaucaaacccgaagugaagccuggaacauccgcucaggagauugagaugcucaaaagaaauaagaucuacuuuaugcaacgccaggacgugcuggauaaaaaccaugucgccgacauugauaaacuuaucgacuaugcugccagcggcgaucccaccucuccggacaauaucgacuccccuaacgcgcccuggguguucgccugcgcuccugaucggugucccccuaccugcauuuacguugccgggauggcugaacugggagccuuuuucagcauccuccaggacaugagaaauacaauuauggccucuaagacggugggcaccgcugaggaaaaacugaagaaaaaguccagcuuuuaccaauccuaucugcgccggacacagucuauggggaucccccucgaucagagaauuauccugcuuuucaugcuggaguggggacaggaaauggucgaccacuuccaucucggcgaugacauggauccggagcugcgcggccuugcgcaagcccugaucgaccagaaagugaaggagauuagcaaccaggaaccccucaagaucuga

SEQ ID NO: 7193 - RNA, 1302 nt, Artificial Sequence
  derived and/or modified CDS sequence (opt5) from PUUV(Kuhmo/X11)__GU808825.1__N
augagcgaccugaccgauauccaggaggacauuacaagacacgaacaacagcucguggucgcccggcagaagcugaaagaugcugagcgcgccguuggcguggaccccgaugacgugaacaagaauacgcuucaggcgagacaacagaccgucuccgcucuggaagauaaacucgccgacuacaagcggcgcauggccgaugcugugucucggaaaaagauggacacaaagccuaccgauccgacagggaucgagcccgacgaucaucugaaagaaagaagcucccuucgcuauggaaacguucuggacgugaaugccauugacaucgaggagccuucuggccagaccgcugauugguacacaauuggggucuaugugaucggauucacccuccccaucauucugaaggcccuguacaugcucagcacgagaggccggcagaccguuaaagaaaacaaggggacacgcaucagauuuaaagacgauaccuccuucgaggacauuaauggaauccggcgcccuaagcaccuguaugugucuaugcccacagcgcaaagcaccaugaaggccgaagaacuuacgccuggcagauuucggacaauugucugcggccuguucccgacccagauccaggugcgcaacauuaugucccccgugaugggggucaucggauuuagcuucuuuguuaaagauuggucugagagaauccgggaguucauggagaaggaauguccuuuuauuaaacccgaggugaagccuggcacacccgcucaggaaaucgagaugcucaaaagaaaucgcauuuacuucaugcaacggcaggacgugcuggauaagaaccaugucgccgacaucgauaaacuuauugacuaugcugccuccggggauccgaccagcccugacaauaucgacucucccaacgcgccuuggguguuugccugcgcucccgauagaugucccccuaccugcaucuacguugccggaauggcugagcugggcgccuucuuuuccauucuccaggacaugcgcaauacaaucauggccagcaagacgguggggaccucugaagagaagcugaaaaagaaauccagcuucuaccaauccuaucugcggagaacacagucuaugggcauucagcucgaucagcgcaucauucugcuuuucaugcuggaauggggaaaggagauggucgaccacuuucaucucggcgaugacauggauccggaacugcgggggcuugcucaagcgcugaucgaccagaaagugaaggagaucagcaaccaggagccccucaagauuuga

SEQ ID NO: 7194 - RNA, 1302 nt, Artificial Sequence
  derived and/or modified CDS sequence (opt5) from PUUV(Kuhmo/X5)__GU808824.1__N
augagcgaccugaccgauauccaggaggacauuacaagacacgaacaacagcucguggucgcccggcagaagcugaaagaugcugagcgcgccguugaaguggaccccgaugacgugaacaagaauacgcuucaggcgagacaacagaccgucuccgcucuggaggauaaacucgccgacuacaagcggcgcauggccgaugcugugucucggaaaaagauggacacaaagccuaccgauccgacaggcaucgaacccgacgaucaucugaaagagagaagcucccuucgcuaugggaacguucuggacgugaaugccauugacaucgaggaaccuucuggacagaccgcugauugguacacaauuggcgucuaugugaucggguucacccuccccaucauucugaaggcccuguacaugcucagcacgagaggacggcagaccguuaaagagaacaagggcacacgcaucagauuuaaagacgauaccuccuucgaagacauuaaugggauccggcgcccuaagcaccuguaugugucuaugcccacagcgcaaagcaccaugaaggccgaggagcuuacgccuggaagauuucggacaauugucugcggccuguucccgacccagauccaggugcgcaacauuaugucccccgugaugggcgucaucggguuuagcuucuuuguuaaagauuggucugaaagaauccgggaguucauggaaaaggaguguccuuuuauuaaacccgaagugaagccuggaacacccgcucaggagaucgagaugcucaaaagaaaucgcauuuacuucaugcaacggcaggacgugcuggauaagaaccaugucgccgacaucgauaaacuuauugacuaugcugccuccggcgauccgaccagcccugacaauaucgacucucccaacgcgccuuggguguuugccugcgcucccgauagaugucccccuaccugcaucuacguugccgggauggcugaacugggagccuucuuuuccauucuccaggacaugcgcaauacaaucauggccagcaagacggugggcaccgcugaggaaaagcugaaaaagaaaucuuccuucuaccaaagcuaucugcggagaacacaguccauggggauucagcucgaucagcgcaucauucugcuuuucaugcuggaguggggaaaggaaauggucgaccacuuucaucucggcgaugacauggauccggagcugcggggccuugcgcaagcccugaucgaccagaaagugaaggagaucucuaaccaggaaccccucaagauuuga

SEQ ID NO: 7195 - RNA, 1302 nt, Artificial Sequence
  derived and/or modified CDS sequence (opt5) from PUUV(Ljustrask/Mg20/05)__GQ339481.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacagauggccgaugcugucucucggaagaagauggacacaaaaccuaccgauccgacaggcaucgaacccgacgaucaucugaaggagcgcagcucccuuagauacgggaacgugcuggacguuaaugccauugacaucgaggaaccuucuggacagaccgcugauugguauacaauuggcguguacgucaucggguuuacccuccccaucauucugaaagcccuguauaugcucagcacgcggggacgccaaaccgugaaggagaacaaaggcacaagaauccgguucaaggacgauaccuccuuugaagacauuaaugggauccgcagaccuaagcaccuguacguuucuaugcccacagcgcagagcaccaugaaagccgaggagcuuacgccuggacgguuccgcacaauugugugcggccuguuuccgacccagauccaggucagaaacauuaugucccccgugaugggcgugaucggguucgccuuuuucgucaagggaugggcugaucggauccgcgaauuuauggagaaagaauguccuuucauuaagcccgagguuaaaccuggcacacccacccaagaaaucgaguuucucaagaaaaauaagguguauuuccuggacagacagaacgugcuugauaagaaucaugucgcugacauugauaaacugaucgacuacgccgcgagcggggauccgaccucuccugacaacauugagucccccaaugccccuuggguguuugcuugcgcccccgaccggugucccccuacaugcaucuauguugcuggaauggccgaacucggcgccuucuucagcauccugcaggauaugagaaacacgauuauggcuucuaagaccguggggacagcggaggaaaaacugaagaaaaaguccagcuuuuaccaaucuuaccuccgccggacccaguccaugggaauccagcuggaccagagaauuauccuucuguucaugcucgaguggggcaaggaaauggucgaucacuuucaucugggcgacgauauggacccggagcuucgcgggcuggcccaagcucucauugaucagaaagugaaggagaucagcaaucaggaaccccugaaaaucuga

SEQ ID NO: 7196 - RNA, 1302 nt, Artificial Sequence
  derived and/or modified CDS sequence (opt5) from PUUV(Mangelbo/Mg1/05)__GQ339485.1__N
augagcgaccugaccgauauccaggacgagauuacaagacacgaacaacagcucguggccgcucggcagaagcugaaagaugccgagcgcgcggucgaaauggaccccgaugacguuaacaagaauacgcuucaggcuagacaacagaccguguccgcccuggaggauaaacucgccgacuucaagcggcgcauggcugaugccgugucuagaaagaagauggacacaaagccuaccgauccgacaggcaucgaacccgacgaucaucugaaagagcggagcucccuucgcuacggggacguccuggacgugaacgcuauugauaucgaggaaccuucuggacagaccgccgacugguauacaauuggcguuuacgugaucggguuuacccuccccaucauucugaaggcgcuguauaugcucagcacgagaggacggcagaccgucaaagagaauaagggcacacgcaucagauucaaagaugacaccuccuuugaagauauuaacgggauccggcgcccuaagcaccuguacgugucuaugcccacagcccaaagcaccaugaaggcugaggagcuuacgccuggaagauuccggacaauuguuugcggccuguuuccgacccagauccaggugcgcaauauuaugucccccgucaugggcgugaucggguucagcuuuuucgugaaagacugggccgaaagaauccgggaguuuauggauaaggaauguccuuucauuaaacccgaggucaagccuggaacacccgcucaggaaaucgaguuucucaaaaagaacaaaauuuauuucaugcaaagacaggacguucuggauaagaaucauguggccgacaucgauaaacuuauugacuacgcggccucuggcgacccgaccuccccugauaacaucgagagccccaaugcuccuuggguguuugccugcgcucccgaccgcugucccccuaccugcaucuaugucgccgggauggccgaacugggagcuuucuucucuauucuccaggauaugcggaacacaaucauggcguccaaaacggugggcaccgccgaggaaaagcugaaaaagaaaagcucuuuuuaccaauccuaccugagacgcacacagagcauggggauucagcucgaccagcggaucauucugcuuuauaugcuggaguggggaaaggaaaugguugaucacuuccaucucggcgacgauauggacccggagcugagaggccuuacccaagcucugaucgaucagaaggugaaagagaucuccaaucccgaaccucucaagauuuga

SEQ ID NO: 7197 - RNA, 1302 nt, Artificial Sequence
  derived and/or modified CDS sequence (opt5) from PUUV(Momignies/55Cg/96)__AJ277033.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacagauggccgaugcugucucucggaagaagauggacacaaaaccuaccgauccgacaggcaucgaacccgacgaucaucugaaggagcgcagcucccuuagauacgggaacgugcuggacguuaaugccauugacaucgaggaaccuucuggacagaccgcugauugguauacaauuggcguguacgucaucggguuuacccuccccaucauucugaaagcccuguauaugcucagcacgcggggacgccaaaccgugaaggagaacaaaggcacaagaauccgguucaaggacgauaccuccuuugaagacauuaaugggauccgcagaucuaagcaccuguacguuagcaugccuacagcgcaguccaccaugaaagccgaggagcuuacgcccggacgguuccgcacaauugugugcggccuguuuccuacccagauccaggucagaaacauuaugagcccggugaugggcgugaucggguucuccuuuuucgucaaggauugggcugaccggauccgcgaauuuauggagaaagaaugucccuucauuaagccugagguuaaacccggaacacccgcccaagaagcugaguuucucaagagaaauaaaaucuauuucaugcagcggcaggaugugcuggacaagaaccauguggccgauauugacaaacuuaucgauuacgcggccucuggcgaccccaccagcccggacaauauugaggcuccuaacgcccccugggucuuugcuugcgccccugauagaugucccccuaccugcaucuauguggccgggauggcugaacugggagcguucuucucuauccuccaagacaugcgcaauacaauuauggccuccaagacgguuggcaccgcugaggaaaagcugaaaaagaaaagcucuuuuuaccaguccuaccugcggagaacacagagcauggggauccagcucgaucaacgcauuauccugcuuuauaugcuggaguggggaaaggaaaugguggaccacuuccaucucuccgaugacauggauccugagcugcggggccuugcccaggcccugauugaccagaaggucaaagagaucucuaaccaggaaccgcucaagaucuga

SEQ ID NO: 7198 - RNA, 1302 nt, Artificial Sequence
  derived and/or modified CDS sequence (opt5) from PUUV(Montbliart/23Cg/96)__AJ277031.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacagauggccgaugcugucucucggaagaagauggacacaaaaccuaccgauccgacaggcaucgaacccgacgaucaucugaaggagcgcagcucccuuagauacgggaacgugcuggacguuaaugccauugacaucgaggaaccuucuggacagaccgcugauugguauacaauuggcguguacgucaucggguuuacccuccccaucauucugaaagcccuguauaugcucagcacgcggggacgccaaaccgugaaggagaacaaaggcacaagaauccgguucaaggacgauaccuccuuugaagacauuaaugggauccgcagaccuaagcaccuguacguuucuaugcccacagcgcagagcaccaugaaagccgaggagcuuacgccuggacgguuccgcacaauugugugcggccuguuuccgacccagauccaggucagaaacauuaugucccccgugaugggcgugaucggguucagcuuuuucgucaaggauugggcugaccggauccgcgaauuuauggagaaagaauguccuuucauuaagcccgagguuaaaccuggaacacccgcccaagaagcugaguuucucagacggaauaagaucuauuucaugcagagacaggaggugcuggauaaaaaccauguggccgacauugauaaacuuaucgacuacgcggccucuggcgauccgaccuccccugacaauauugaagcucccaacgccccuugggucuuugcuugcgcccccgaccgcugucccccuaccugcaucuauaucgccgggauggcugagcugggagcguucuucagcauucuccaagauaugcggaauacaaucauggccucuaagacggugggcaccgcugaagagaagcugaagaaaaaguccagcuuuuaccagucuuaccugagacgcacacaguccauggggauucagcucgaccaacggaucauucugcuuuauaugcuggaauggggaaaagagaugguugaucacuuccaucucggcgacgauauggacccggagcugagaggccuugcccaggcccugaucgaucagaaggugaaggaaaucagcaaccaggagccccucaaaauuuga

SEQ ID NO: 7199 - RNA, 1302 nt, Artificial Sequence
  derived and/or modified CDS sequence (opt5) from PUUV(MuEb10Karlstadt/10)__JN696373.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuacaaaagacggauggccgaugcugucucucgcaagaagauggacacaaaaccuaccgauccgacaggcaucgaacccgacgaucaucugaaggagagaagcucccuucgguaugggaacgugcuggacguuaaugccauugacaucgaggaaccuucuggacagaccgcugauugguacacaauuggcguguaugucaucggguucacccuccccaucauucugaaagcccuguacaugcucagcacgcgcggaagacagaccgugaaggagaacaaaggcacacggauccgcuuuaaggacgauaccuccuucgaagacauuaaugggaucagacggccuaagcaccuguauguuucuaugcccacagcgcaaagcaccaugaaagccgaggagcuuacgccuggacgcuuuagaacaauugugugcggccuguucccgacccagauccagguccggaacauuaugucccccgugaugggcgugaucggguuuagcuucuuugucaaggauugggcugaacgcaucagagaguucauggaaaaagaguguccuuuuauuaagcccgaaaucaaaccuggaacacccguucaggaggccgaguuccucaagcggaauaaaguguacuuuaugcaaagacaggaagugcuggacaagaaccaugucgcugauauugacaaacuuaucgauuaugccgcgucuggcgacccgaccuccccugauaauauugagagccccaacgccccuuggguguucgcuugcgcccccgaccgcugucccccuaccugcaucuacguugcugggauggccgaacugggagccuuuuucucuauccuccaggacaugcggaauacaauuauggcuuccaagacggugggcaccgcggaggaaaagcugaaaaagaaaagcucuuucuaccaauccuaucugagacgcacacagagcauggggauccagcucgaucagcggauuauccugcuuuacaugcuggaguggggaaaggagauggucgaccacuuucaucucggcgaugacauggauccggaacugagaggccuugcccaagcucugauugaccagaaggugaaagagaucuccaaccaggaaccccucaagaucuga

SEQ ID NO: 7200 - RNA, 1302 nt, Artificial Sequence
  derived and/or modified CDS sequence (opt5) from PUUV(MuEb12Lackenberg/10)__JN696374.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuacaaaagacggauggccgaugcugucucucgcaagaagauggacacaaaaccuaccgauccgacaggcaucgaacccgacgaucaucugaaggagagaagcucccuucgguaugggaacgugcuggacguuaaugccauugacaucgaggaaccuucuggacagaccgcugauugguacacaauuggcguguaugucaucggguucacccuccccaucauucugaaagcccuguacaugcucagcacgcgcggaagacagaccgugaaggagaacaaaggcacacggauccgcuuuaaggacgauaccuccuucgaagacauuaaugggaucagacggccuaagcaccuguauguuucuaugcccacagcgcaaagcaccaugaaagccgaggagcuuacgccuggacgcuuuagaacaauugugugcggccuguucccgacccagauccagguccggaacauuaugucccccgugaugggcgugaucggguuuagcuucuuugucaaggauugggcugaacgcaucagagaguucauggaaaaagaguguccuuuuauuaagcccgaaaugaaaccuggaacacccgcccaggaggcugaguuccucaagcggaauaaaguuuacuuuaugcaaagacaggacgugcuggauaagaaccauguggccgacaucgauaaacuuauugacuaugcggccucuggcgauccgaccuccccugacaauaucgaaagccccaacgcuccuugggucuucgccugcgcucccgaccgcugucccccuaccugcauuuacguggccgggauggccgagcugggagcguuuuucucuauccuccaggauaugcggaauacaaucauggcuuccaagacgguuggcaccgccgaagagaagcugaaaaagaaaagcucuuucuaccaauccuaucugagacgcacacagagcauggggauucagcucgaccagcggaucauucugcuuuacaugcuggaauggggaaaggagaugguggaucacuuucaucucggcgacgauauggacccggagcugagaggccuugcucaagcccugaucgaucagaaggucaaagaaauuuccaaccaggagccccucaagaucuga

SEQ ID NO: 7201 - RNA, 1302 nt, Artificial Sequence
  derived and/or modified CDS sequence (opt5) from PUUV(Munga/Mg16/05)__GQ339487.1__N
augagcgaccugaccgauauccaggacgagauuacaagacacgaacaacagcucguggccgcucggcagaagcugaaagaugccgagcgcgcggucgaaauggaccccgaugacguuaacaagaauacgcuucaggcuagacaacagaccguguccgcccuggaggauaaacucgccgacuucaagcggcgcauggcugaugccgugucuagaaagaagauggacacaaagccuaccgauccgacaggcaucgaacccgacgaucaucugaaagagcggagcucccuucgcuacgggaacguccuggacgugaaugcuauugacaucgaggaaccuucuggacagaccgccgauugguauacaauuggcguuuacgugaucggguuuacccuccccaucauucugaaggcgcuguauaugcucagcacgagaggacggcagaccgucaaagagaacaagggcacacgcaucagauucaaagacgauaccuccuuugaagacauuaaugggauccggcgcccuaagcaccuguacgugucuaugcccacagcccaaagcaccaugaaggcugaggagcuuacgccuggaagauuccggacaauuguuugcggccuguuuccgacccagauccaggugcgcaacauuaugucccccgucaugggcgugaucggguucagcuuuuucgugaaagauugggccgaaagaauccgggaguuuauggaaaaggaguguccuuucauuaaacccgaagucaagccuggaacacccgcucaggagaucgaguuucucaaaaagaauaaaauuuauuucaugcaaagacaggacguucuggauaagaaccauguggccgacaucgauaaacuuauugacuacgcggccucuggcgauccgaccuccccugacaauaucgaaagccccaacgcuccuuggguguuugccugcgcucccgaccgcugucccccuaccugcaucuaugucgccgggauggccgagcugggagcuuucuucucuauucuccaggauaugcggaauacaaucauggcguccaaaacggugggcaccgccgaagagaagcugaaaaagaaaagcucuuuuuaccaauccuaccugagacgcacacagagcauggggauucagcucgaccagcggaucauucugcuuuauaugcuggaauggggaaaggagaugguugaucacuuccaucucggcgacgauauggacccggagcugagaggccuugcucaagcccugaucgaucagaaggugaaagaaaucuccaaccaggagccccucaagauuuga

SEQ ID NO: 7202 - RNA, 1302 nt, Artificial Sequence
  derived and/or modified CDS sequence (opt5) from PUUV(Munga/Mg2/05)__GQ339486.1__N
augagcgaccugaccgauauccaggacgagauuacaagacacgaacaacagcucguggccgcucggcagaagcugaaagaugccgagcgcgcggucgaaauggaccccgaugacguuaacaagaauacgcuucaggcuagacaacagaccguguccgcccuggaggauaaacucgccgacuucaagcggcgcauggcugaugccgugucuagaaagaagauggacacaaagccuaccgauccgacaggcaucgaacccgacgaucaucugaaagagcggagcucccuucgcuacgggaacguccuggacaugaaugcuauugacaucgaggaaccuucuggacagaccgccgauugguauacaauuggcguguacguuaucggguuuacccuccccaucauucugaaggcgcuguauaugcucagcacgagaggacggcagaccgugaaagagaacaagggcacacgcaucagauucaaagacgauaccuccuuugaagacauuaaugggauccggcgcccuaagcaccuguacgucucuaugcccacagcccaaagcaccaugaaggcugaggagcuuacgccuggaagauuccggacaauugugugcggccuguuuccgacccagauccagguucgcaacauuaugucccccgugaugggcgucaucggguucagcuuuuucgugaaagauugggccgaaagaauccgggaguuuauggaaaaggaguguccuuucauuaaacccgaagugaagccuggaacacccgcucaggagaucgaguuucucaaaaagaauaaaauuuauuucaugcaaagacaggacguccuggauaagaaccauguugccgacaucgauaaacuuauugacuacgcggccucuggcgauccgaccuccccugacaauaucgaaagccccaacgcuccuuggguguuugccugcgcucccgaccgcugucccccuaccugcaucuauguggccgggauggccgagcugggagcuuucuucucuauucuccaggauaugcggaauacaaucauggcguccaaaacggucggcaccgccgaagagaagcugaaaaagaaaagcucuuuuuaccaauccuaccugagacgcacacagagcauggggauucagcucgaccagcggaucauucugcuuuauaugcuggaauggggaaaggagaugguggaucacuuccaucucggcgacgauauggacccggagcugagaggccuugcucaagcccugaucgaucagaagguuaaagaaaucuccaaccaggagccccucaagauuuga

SEQ ID NO: 7203 - RNA, 1302 nt, Artificial Sequence
  derived and/or modified CDS sequence (opt5) from PUUV(PUU/Cg-Erft)__AJ238779.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacagauggccgaugcugucucucggaagaagauggacacaaaaccuaccgauccgacaggcaucgaacccgacgaucaucugaaggagcgcagcucccuuagauacgggaacgugcuggacguuaaugccauugacaucgaggaaccuucuggacagaccgcugauugguauacaauuggcguguacgucaucggguuuacccuccccaucauucugaaagcccuguauaugcucagcacgcggggacgccaaaccgugaaggagaacaaaggcacaagaauccgguucaaggacgauaccuccuuugaagacauuaaugggauccgcagaccuaagcaccuguacguuucuaugcccacagcgcagagcaccaugaaagccgaggagcuuacgccuggacgguuccgcacaauugugugcggccuguuuccgacccagauccaggucagaaacauuaugucccccgugaugggcgugaucggguucagcuuuuucgucaaggauugggcugaccggaucaaaaaguuuauggaaaaagaguguccuuucauuaagcccgaaguuaaaccuggaacacccucucaagaggccgaauuucucaagaugaaucgcaucuauuucaugcagagacaggaggugcuggauaagaaccauguggcugacauugauaaacuuaucgacuacgccgcguccggcgauccgaccagcccugacaauauugaggcccccaacgcuccuugggucuuugccugcgcucccgaccggugucccccuaccugcaucuauguggccgggauggccgaacugggagcuuucuucucuauccuccaagauaugagaaauacaauuauggcguccaagacgguuggcaccgccgaggaaaaacugaagaaaaagagcucuuuuuaccaguccuaccugcgccggacacagagcauggggauccagcucgaccaaagaauuauccugcuuuauaugcuggaguggggaaaggaaaugguggaucacuuccaucucggcgacgauauggacccggagcugcgcggccuugcucaggcccugauugaucagaaagucaaggagaucuccaaccaggaaccccucaaaaucuga

SEQ ID NO: 7204 - RNA, 1302 nt, Artificial Sequence
  derived and/or modified CDS sequence (opt5) from PUUV(Puu/Kazan)__Z84204.1__N
augagcgaccugaccgauauccaggaggaaauuacaagacacgagcaacagcucguggucgcccggcagaagcugaaagacgcugaacgcgccguugagguggaucccgacgaugugaacaagaauacgcuucaggcgagacaacagaccgucuccgcucuggaagacaaacucgccgauuacaagcggcgcauggccgacgcugugucucggaaaaagauggauacaaagccuaccgacccgacaggcaucgagcccgaugaccaucugaaagagcggagcucccuucgcuaugggaacguucuggaugugaaugccauugacaucgaggaaccuucuggacagaccgcugacugguacacaauuggcgucuaugugaucggguucaccauccccauuauccucaaggcccuguacaugcugagcacgagaggacggcagaccguuaaagaaaacaagggcacacgcauuagauuuaaagaugacaccuccuucgaggauaucaaugggauucggcgcccuaagcaccucuaugugucuaugcccacagcgcaaagcaccaugaaggccgaggaacugacgccuggaagauuucggacaaucgucugcggccuuuucccgacccagauucaggugcgcaacaucaugucccccgugaugggcgucaucggguuuagcuucuuuguuaaagacuggccugagagaauuagagauuucauggaaaaggagucucccuuuaucaaaccugaagugaagcccggaacaccggcucaggagauugaguuccugaaaagaaaucgcguguacuuuaugacccggcaagacguccucgauaagaaccauguggccgacaucgauaaacugauugacuaugcugccuccggcgauccuaccagccccgacgacaucgaaucuccuaaugcgcccuggguuuucgccugugcucccgauagaugcccuccgacauguaucuacguggccgggauggcugagcuuggagccuuuuucuccauucugcaggacaugcgcaacacgaucauggccagcaagaccgucggcacagcugaagagaagcucaaaaagaaaucuuccuucuaccagagcuaucugcggagaacccaauccauggggauucagcuggaucagcgcaucauucuccuguacaugcuugaauggggaaaggagaugguggaccacuuucaucugggcgaugacauggaucccgagcuccggggccuggcgcagucucuuaucgaccaaaaaguuaaggaaaucagcaaucaggagccucugaagauuuga

SEQ ID NO: 7205 - RNA, 1302 nt, Artificial Sequence
  derived and/or modified CDS sequence (opt5) from PUUV(PUU/Mignovillard/CgY02/2005)__AM695638.1__N
augggcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccgugagcgcucuggaggauaagcucgccgacuucaaaagacggauggccgaugcugucucccgcaagaagauggacacaaaaccuaccgauccgacagggaucgaacccgacgaucaucugaaggagagaucuagccuucgguacggaaacgugcuggacguuaaugccauugacaucgaggaaccuuccggccagaccgcugauugguauacaauugggguguacgucaucggauuuacccuccccaucauucugaaagcccuguauaugcucucuacgcgcggcagacagaccgugaaggagaacaaagggacacggauccgcuucaaggacgauaccagcuuugaagacauuaauggaaucagacggccuaagcaccuguacguuuccaugcccacagcgcaaucuaccaugaaagccgaggagcuuacgccuggccgcuucagaacaauugugugcggccuguuuccgacccagauccagguccggaacauuaugagccccgugaugggggugaucggauucuccuuuuucgucaaggauuggacagaccgcaucagagaauuuauggagaaagaauguccuuucauuaagcccgagaugaaaccuggcacccccgcucaggaagccgaguuucucaagcggaauaaaaucuauuucaugcaaagacaggauguucuggacaagaaccauguggcugauauugacaaacuuaucgauuacgccgcgagcggggacccgaccucuccugacaauauugagucccccaacgccccuuggguguuugcuugcgcccccgaucgcugucccccuacaugcaucuaugucgcuggaauggccgaacugggcgccuucuucagcauccuccaggacaugcggaauacgauuauggcuucuaagaccguggggacagcggaggaaaagcugaaaaagaaauccagcuuuuaccaaucuuaccugagacgcacccaguccaugggaauccagcucgaucagcggauuauccugcuuuauaugcuggaguggggcaaggaaaugguugaccacuuccaucucggcgaugacauggauccggagcugagagggcuugcccaagcucugauugaccagaaggugaaagagaucagcaaccaggaaccccucaagaucuga

SEQ ID NO: 7206 - RNA, 1302 nt, Artificial Sequence
  derived and/or modified CDS sequence (opt5) from PUUV(PUUV/Croatia_Gerovo/Mg938/2008)__KC676609.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaccgauccgacaggcaucgaacccgacgaucaucugaaggagagaagcucccuucgguacgggaacgugcuggacguuaaugccauugacaucgaggaaccuucuggacagaccgcugauugguauacaauuggcguguacgucaugggguuuacccuccccaucauccugaaagcccuguauaugcucagcacgcgcggaagacagaccgugaaggagaacaaaggcacacggauucgcuucaaggacgauaccuccuuugaagacaucaaugggauuagacggccuaagcaccuguacguuucuaugcccacagcgcaaagcaccaugaaagccgaggagcuuacgccuggacgcuucagaacaaucgugugcggccuguuuccgacccagauucagguccggaacaucaugucccccgugaugggcgugauuggguucagcuuuuucgucaaggauuggucugaacgcguuagagacuuuauggagaaagaauguccuuucaucaagcccgagaucaaaccuggaacaccccagcaagaagcugaguuucucaagcggaauaaaguguauuucaugcagagacaggaugugcuggacaagaaccaugucgccgauauugacaaacuuaucgauuacgcugccuccggcgacccgaccagcccugacaauauugagucucccaacgcgccuuggguguuugccugcgcucccgaucgcugucccccuaccugcaucuauguugccgggauggcugaacugggagccuucuucuccauucuccaagacaugcggaauacaaucauggccagcaagacggugggcaccgcugaggaaaagcugaaaaagaaaucuuccuuuuaccagagcuaccugagacgcacacaguccauggggauccagcucgaucaacggauuauccugcuuuauaugcuggaguggggaaaggaaauggucgaccacuuccaucucggcgaugacauggauccggagcugagaggccuugcgcaggcccugauugaccagaaggugaaagagaucucuaaccaggaaccccucaagauuuga

SEQ ID NO: 7207 - RNA, 1302 nt, Artificial Sequence
  derived and/or modified CDS sequence (opt5) from PUUV(PUUV/Croatia_Gerovo/Mg979/2008)__KC676613.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaccgauccgacaggcaucgaacccgacgaucaucugaaggagagaagcucccuucgguacgggaacgugcuggacguuaaugccauugacaucgaggaaccuucuggacagaccgcugauugguauacaauuggcguguacgucaucggguuuacccuccccaucauucugaaagcccuguauaugcucagcacgcgcggaagacagaccgugaaggagaacaaaggcacacggauccgcuucaaggacgauaccuccuuugaagacauuaaugggaucagacggccuaagcaccuguacguuucuaugcccacagcgcaaagcaccaugaaagccgaggagcuuacgccuggacgcuucagaacaauugugugcggccuguuuccgacccagauccagguccggaacauuaugucccccgugaugggcgugaucggguucagcuuuuucgucaaggauuggucugaacgcguuagagacuuuauggagaaagaauguccuuucaucaagcccgagauuaaaccuggaacacccccgcaggaagcugaguuucucaagcggaauaaaguguauuucaugcaaagacaggaugugcuggacaagaaccaugucgccgauaucgacaaacuuauugauuacgcugccuccggcgacccuaccagccccgacaauaucgagucuccuaacgcgcccuggguguuugccugcgcucccgaucgcuguccuccgaccugcauuuauguugccgggauggcugaacugggagccuucuucuccauccuccaggacaugcggaauacaaucauggccagcaagacggugggcaccgcugaggaaaagcugaaaaagaaaucuuccuuuuaccaaagcuaccugagacgcacacaguccauggggauucagcucgaucagcggaucauucugcuuuauaugcuggaguggggaaaggaaauggucgaccacuuccaucucggcgaugacauggaucccgagcugagaggccuugcgcaagcccugaucgaccagaaggugaaagagauuucuaaccaggaaccucucaagaucuga

SEQ ID NO: 7208 - RNA, 1302 nt, Artificial Sequence
  derived and/or modified CDS sequence (opt5) from PUUV(PUUV/Konnevesi/Mg_M114B/2005)__JQ319171.1__N
augagcgaccugaccgauauccaggaggacauuacaagacacgaacaacagcucguggucgcccggcagaagcugaaagaugcugagcgcgccguugaaguggaccccgaugacgugaacaagaauacgcuucaggcgagacaacagaccgucuccgcucuggaggauaaacucgccgacuacaagcggcgcauggccgaugcugugucuagaaagaagauggacacaaagccuaccgauccgacaggcaucgaacccgacgaucaucugaaagagcggagcucccuucgcuaugggaacguucuggacgugaaugccauugacaucgaggaaccuucuggacagaccgcugauugguacacaauuggcgucuaugugaucggguucacccuccccaucauucugaaggcccuguacaugcucagcacgagaggacggcagaccguuaaagagaacaagggcacacgcaucagauuuaaagacgauaccuccuucgaagacauuaaugggauccggcgcccuaagcaccuguaugugucuaugcccacagcgcaaagcaccaugaaggccgaggagcuuacgccuggaagauuucggacaauugucugcggccuguucccgacccagauccaggugcgcaacauuaugucccccgugaugggcgucaucggguuuagcuucuuuguuaaagauuggccugaaagaauccgggaguucauggaaaaggagugucccuuuauuaaaccugaagugaagcccggaacaccggcucaggagaucgagaugcucaaaagaaauaagauuuacuucaugcaacgccaggacgugcuggauaaaaaccaugucgccgacaucgauaaacuuauugacuaugcugccucuggcgauccuaccucccccgacaauaucgacagcccuaacgcgcccuggguguuugccugcgcucccgaucgguguccuccgaccugcaucuacguugccgggauggcugaacugggagccuucuuuucuauucuccaggacaugagaaauacaaucauggccuccaagacggugggcaccgcugaggaaaaacugaagaaaaagagcucuuucuaccaauccuaucugcgccggacacagagcauggggauucagcucgaucagagaaucauucugcuuuucaugcuggaguggggaaaagaaauggucgaccacuuucauuucggcgaugacauggaucccgagcuccgcggccuggcgcaagcccuuaucgaccagaaggugaaggagaucuccaaccaggaaccucugaaaauuuga

SEQ ID NO: 7209 - RNA, 1302 nt, Artificial Sequence
  derived and/or modified CDS sequence (opt5) from PUUV(PUUV/Konnevesi/Mg_M94A/2005)__JQ319163.2__N
augagcgaccugaccgauauccaggaggacauuacaagacacgaacaacagcucguggucgcccggcagaagcugaaagaugcugagcgcgccguugaaguggaccccgaugacgugaacaagaauacgcuucaggcgagacaacagaccgucuccgcucuggaggauaaacucgccgacuacaagcggcgcauggccgaugcugugucuagaaagaagauggacacaaagccuaccgauccgacaggcaucgaacccgacgaucaucugaaagagcggagcucccuucgcuaugggaacguucuggacgugaaugccauugacaucgaggaaccuucuggacagaccgcugauugguacacaauuggcgucuaugugaucggguucacccuccccaucauucugaaggcccuguacaugcucagcacgagaggacggcagaccguuaaagagaacaagggcacacgcaucagauuuaaagacgauaccuccuucgaagacauuaaugggauccggcgcccuaagcaccuguaugugucuaugcccacagcgcaaagcaccaugaaggccgaggagcuuacgccuggaagauuucggacaauugucugcggccuguucccgacccagauccaggugcgcaacauuaugucccccgugaugggcgucaucggguuuagcuucuuuguuaaagauuggccugaaagaaucaaggaguucauggaaaaagagugucccuuuauuaagccugaagugaaacccggaacaccggcucaggagaucgagaugcucaagcggaauaaaauuuacuucaugcaaagacaggacgugcuggauaagaaccaugucgccgacaucgauaaacuuauugacuaugcugccucuggcgauccuaccucccccgacaauaucgacagcccuaacgcgcccuggguguuugccugcgcucccgaucgcuguccuccgaccugcaucuacguugccgggauggcugaacugggagccuucuuuucuauucuccaggacaugcggaauacaaucauggccuccaaaacggugggcaccgcugaggaagaggucaagaaaaagagcucuuucuaccaauccuaucugagacgcacacagagcauggggauucagcuggaucagcggaucauucuccuguucaugcuugaauggggaaaagagaugguggaccacuuucaucugggcgaugacauggaucccgagcucagaggccuggcgcaagccaugaucgaccagaagguuaaggaaaucuccaaccaggagccucuuaaaauuuga

SEQ ID NO: 7210 - RNA, 1302 nt, Artificial Sequence
  derived and/or modified CDS sequence (opt5) from PUUV(PUUV/Konnevesi/Mg_O14B/2005)__JQ319166.1__N
augagcgaccugaccgauauccaggaggacauuacaagacacgaacaacagcucguggucgcccggcagaagcugaaagaugcugagcgcgccguugaaguggaccccgaugacgugaacaagaauacgcuucaggcgagacaacagaccgucuccgcucuggaggauaaacucgccgacuacaagcggcgcauggccgaugcugugucuagaaagaagauggacacaaagccuaccgauccgacaggcaucgaacccgacgaucaucugaaagagcggagcucccuucgcuaugggaacguucuggacgugaaugccauugacaucgaggaaccuucuggacagaccgcugauugguacacaauuggcgucuaugugaucggguucacccuccccaucauucugaaggcccuguacaugcucagcacgagaggacggcagaccguuaaagagaacaagggcacacgcaucagauuuaaagacgauaccuccuucgaagacauuaaugggauccggcgcccuaagcaccuguaugugucuaugcccacagcgcaaagcaccaugaaggccgaggagcuuacgccuggaagauuucggacaauugucugcggccuguucccgacccagauccaggugcgcaacauuaugucccccgugaugggcgucaucggguuuagcuucuuuguuaaagauuggccugaaagaauccgggaguucauggaaaaggagugucccuuuauuaaaccugaagugaagcccggaacaccggcucaggagaucgagaugcucaaaagaaauaagauuuacuucaugcaacgccaggacgugcuggauaaaaaccaugucgccgacaucgauaaacuuauugacuaugcugccucuggcgauccuaccucccccgacaauaucgacagcccuaacgcgcccuggguguuugccugcgcucccgaucgguguccuccgaccugcaucuacguugccgggauggcugaacugggagccuucuuuucuauucuccaggacaugagaaauacaaucauggccuccaagacggugggcaccgcugaggaaaaacugaagaaaaagagcucuuucuaccaauccuaucugcgccggacacagagcauggggauucagcucgaucagagaaucauucugcuuuucaugcuggaguggggaaaagaaauggucgaccacuuucaucucggcgaugacauggaucccgagcugcgcggccuugcgcaagcccugaucgaccagaaggugaaggagaucuccaaccaggaaccucucaaaauuuga

SEQ ID NO: 7211 - RNA, 1302 nt, Artificial Sequence
  derived and/or modified CDS sequence (opt5) from PUUV(PUUV/Konnevesi/Mg_O22B/2005)__JQ319168.2__N
augagcgaccugaccgauauccaggaggacauuacaagacacgaacaacagcucguggucgcccggcagaagcugaaagaugcugagcgcgccguugaaguggaccccgaugacgugaacaagaauacgcuucaggcgagacaacagaccgucuccgcucuggaggauaaacucgccgacuacaagcggcgcauggccgaugcugugucuagaaagaagauggacacaaagccuaccgauccgacaggcaucgaacccgacgaucaucugaaagagcggagcucccuucgcuaugggaacguucuggacgugaaugccauugacaucgaggaaccuucuggacagaccgcugauugguacacaauuggcgucuaugugaucggguucacccuccccaucauucugaaggcccuguacaugcucagcacgagaggacggcagaccguuaaagagaacaagggcacacgcaucagauuuaaagacgauaccuccuucgaagacauuaaugggauccggcgcccuaagcaccuguaugugucuaugcccacagcgcaaagcaccaugaaggccgaggagcuuacgccuggaagauuucggacaauugucugcggccuguucccgacccagauccaggugcgcaacauuaugucccccgugaugggcgucaucggguuuagcuucuuuguuaaagauuggccugaaagaauccgggaguucauggaaaaggagugucccuuuauuaaaccugaagugaagcccggaacaccggcucaggagaucgagaugcucaaaagaaauaagauuuacuucaugcaacgccaggacgugcuggauaaaaaccaugucgccgacaucgauaaacuuauugacuaugcugccucuggcgauccuaccucccccgaaaauaucgacagcccuaacgcgcccuggguguuugccugcgcucccgaccgguguccuccgaccugcaucuacguugccgggauggcugagcugggagccuucuuuucuauucuccaggauaugagaaauacaaucauggccuccaagacggugggcaccgcugaagagaaacugaagaaaaagagcucuuucuaccaauccuaucugcgccggacacagagcauggggauucagcucgaccagagaaucauucugcuuuucaugcuggaauggggaaaagagauggucgaucacuuucaucucggcgacgauauggaccccgagcugcgcggccacgcgcaagcccuuaucgaucagaaggugaaggaaaucuccaaccaggagccucugaaaauuuga

SEQ ID NO: 7212 - RNA, 1302 nt, Artificial Sequence
  derived and/or modified CDS sequence (opt5) from PUUV(PUUV/Konnevesi/Mg_O57A/2005)__JQ319161.2__N
augagcgaccugaccgauauccaggaggacauuacaagacacgaacaacagcucguggucgcccggcagaagcugaaagaugcugagcgcgccguugaaguggaccccgaugacgugaacaagaauacgcuucaggcgagacaacagaccgucuccgcucuggaggauaaacucgccgacuacaagcggcgcauggccgaugcugugucuagaaagaagauggacacaaagccuaccgauccgacaggcaucgaacccgacgaucaucugaaagagcggagcucccuucgcuaugggaacguucuggacgugaaugccauugacaucgaggaaccuucuggacagaccgcugauugguacacaauuggcgucuaugugaucggguucacccuccccaucauucugaaggcccuguacaugcucagcacgagaggacggcagaccguuaaagagaacaagggcacacgcaucagauuuaaagacgauaccuccuucgaagacauuaaugggauccggcgcccuaagcaccuguaugugucuaugcccacagcgcaaagcaccaugaaggccgaggagcuuacgccuggaagauuucggacaauugucugcggccuguucccgacccgcauccaggugagaaacauuaugucccccgugaugggcgucaucggguuuagcuucuuuguuaaagauuggccugaacggaucaaggaguucauggaaaaagaguguucuuuuauuaagcccgaagugaaaccuggaacacccgcucaggagaucgagaugcucaagagaaauaaaauuuacuucaugcagcgccaagacgugcuggauaagaaccaugucgccgacaucgauaaacuuauugacuaugcugccuccggcgauccgaccagcccugacaauaucgacucucccaacgcgccuuggguguuugccugcgcucccgaucggugucccccuaccugcaucuacguugccgggauggcugaacugggagccuucuuuuccauucuccaggacaugagaaauacaaucauggccagcaaaacggugggcaccgcugaggaagaggucaagaaaaagucuuccuucuaccagagcuaucugcgccggacacaauccauggggauucagcuggaucagagaaucauucuccuguucaugcuugaauggggaaaagagaugguggaccacuuucaucugggcgaugacauggauccggagcuccgcggccuggcgcaggcccuuaucgaccaaaacguuaaggaaaucucuaaucaggagccccugaagauuuga

SEQ ID NO: 7213 - RNA, 1302 nt, Artificial Sequence
  derived and/or modified CDS sequence (opt5) from PUUV(PUUV/Konnevesi/Mg_O6B/2005)__JQ319164.1__N
augagcgaccugaccgauauccaggaggacauuacaagacacgaacaacagcucguggucgcccggcagaagcugaaagaugcugagcgcgccguugaaguggaccccgaugacgugaacaagaauacgcuucaggcgagacaacagaccgucuccgcucuggaggauaaacucgccgacuacaagcggcgcauggccgaugcugugucuagaaagaagauggacacaaagccuaccgauccgacaggcaucgaacccgacgaucaucugaaagagcggagcucccuucgcuaugggaacguucuggacgugaaugccauugacaucgaggaaccuucuggacagaccgcugauugguacacaauuggcgucuaugugaucggguucacccuccccaucauucugaaggcccuguacaugcucagcacgagaggacggcagaccguuaaagagaacaagggcacacgcaucagauuuaaagacgauaccuccuucgaagacauuaaugggauccggcgcccuaagcaccuguaugugucuaugcccacagcgcaaagcaccaugaaggccgaggagcuuacgccuggaagauuucgggcuauugucugcggccuguucccgacacagauccaggugcgcaacauuaugucccccgugaugggcgucaucggguuuagcuucuuuguuaaagauuggccugaaagaauccgggaguucaugggaaaggaaugucccuuuauuaaaccugaggugaagcccggcaccccggcccaggaaaucgagaugcucaaaagaaauaagauuuacuucaugcaacgccaggacgugcuggauaaaaaccaugucgcugacaucgauaaacuuauugacuaugccgcgucuggggauccuacaucccccgacaauaucgacagcccuaacgcccccuggguguuugcuugcgcccccgaucgguguccuccgaccugcaucuacguugcuggaauggccgagcugggcgccuucuuuucuauucuccaggacaugagaaauaccaucauggcuuccaagacaguggggacggcggaagagaaacugaagaaaaagagcucuuucuaccaauccuaucugcgccggacccagagcaugggcauucagcucgaucagagaaucauucugcuuuucaugcuggaauggggaaaagagauggucgaccacuuucaucucggcgaugacauggaucccgaacugcgcgggcuugcccaagcucugaucgaccagaaggugaaggagaucuccaaccaggagccucucaaaauuuga

SEQ ID NO: 7214 - RNA, 1302 nt, Artificial Sequence
  derived and/or modified CDS sequence (opt5) from PUUV(PUUV/Konnevesi/Mg_O74B/2005)__JQ319170.1__N
augagcgaccugaccgauauccaggaggacauuacaagacacgaacaacagcucguggucgcccggcagaagcugaaagaugcugagcgcgccguugaaguggaccccgaugacgugaacaagaauacgcuucaggcgagacaacagaccgucuccgcucuggaggauaaacucgccgacuacaagcggcgcauggccgaugcugugucuagaaagaagauggacacaaagccuaccgauccgacaggcaucgaacccgacgaucaucugaaagagcggagcucccuucgcuaugggaacguucuggacgugaaugccauugacaucgaggaaccuucuggacagaccgcugauugguacacaauuggcgucuaugugaucggguucacccuccccaucauucugaaggcccuguacaugcucagcacgagaggacggcagaccguuaaagagaacaagggcacacgcaucagauuuaaagacgauaccuccuucgaagacauuaaugggauccggcgcccuaagcaccuguaugugucuaugcccacagcgcaaagcaccaugaaggccgaggagcuuacgccuggaagauuucggacaauugucugcggccuguucccgacccagauccaggugcgcaacauuaugucccccgugaugggcgucaucggguuuagcuucuuuguuaaagauuggccugaaagaauccgggaguucauggaaaaggagugucccuuuauuaaaccugaagugaagcccggaacaccggcucaggagaucgagaugcucaaaagaaauaagauuuacuucaugcaacgccaggacgugcuggauaaaaaccaugucgccgacaucgauaaacuuauugacuaugcugccucuggcgauccuaccucccccgacaauaucgacagcccuaacgcgcccuggguguuugccugcgcucccgaucgguguccuccgaccugcaucuacguugccgggauggcugaacugggagccuucuuuucuauucuccaggacaugagaaauacaaucauggccuccaagacggugggcaccgucgaggaaaaacugaagaaaaagagcucuuucuaccaauccuaucugcgccggacacagagcauggggauucagcucgaucagagaaucauucugcuuuucaugcuggaguggggaaaagaaaugguggaccacuuucaucucggcgaugacauggaucccgagcugcgcggccuugcucaagcgcugaucgaccagaagguuaaggagaucuccaaccaggaaccucucaaaauuuga

SEQ ID NO: 7215 - RNA, 1302 nt, Artificial Sequence
  derived and/or modified CDS sequence (opt5) from PUUV(PUUV/Konnevesi/Mg_O78A/2005)__JQ319162.2__N
augagcgaccugaccgauauccaggaggacauuacaagacacgaacaacagcucguggucgcccggcagaagcugaaagaugcugagaaggccguugaaguggaccccgaugacgugaacaaaaauacgcuucaggcgcgccaacagaccgucuccgcucuggaggauaagcucgccgacuacaaaagacggauggccgaugcugugucucgcaagaagauggacacaaaaccuaccgauccgacaggcaucgaacccgacgaucaucugaaggagagaagcucccuucgguaugggaacguucuggacgugaaugccauugacaucgaggaaccuucuggacagaccgcugauugguacacaauuggcgucuaugugaucggguucacccuccccaucauucugaaagcccuguacaugcucagcacgcgcggaagacagaccguuaaggagaacaaaggcacacggauccgcuuuaaggacgauaccuccuucgaagacauuaaugggaucagacggccuaagcaccuguaugugucuaugcccacagcgcaaagcaccaugaaagccgaggagcuuacgccuggacgcuuuagaacaauugucugcggccuguucccgacccagauccaggugcggaacauuaugucccccgugaugggcgucaucggguuuagcuucuuuguuaaggauuggccugaacgcaucagagaguucauggaaaaagagugucccuuuauuaagccugaagugaaacccggaacaccggcucaggagaucgagaugcucaagcggaauaaaauuuacuucaugcaaagacaggacgugcuggauaagaaccaugucgccgacaucgauaaacuuauugacuaugcugccucuggcgauccuaccucccccgacaauaucgacagcccuaacgcgcccugggugcuggccugcgggcccgaacgcuguccuccgaccugcaucuacguugcuggaauggccgagcucggcgccuuuuucucuauucugcaggauaugcggaauacaaucauggcuuccaagacgguggggagcgacgaagucaagcugaaaaagaaauccuuuuucuaccaauauuaccucagacgcacccacucuaugggcauucagcuggaucagcggaucauucuucuguguaugcucgaguggggaaucgaaaugguggaccauuuccaccugggcgaugacauggaucccgagcuuagagggcuggcccaggcuaugaucgaccaaaagguuaaggagauuagcaaccaggaaccucucaucauuuga

SEQ ID NO: 7216 - RNA, 1302 nt, Artificial Sequence
  derived and/or modified CDS sequence (opt5) from PUUV(PUUV/Mg23/HungaryTR17/00)__FN377822.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacggauggccgaugcugucucucgcaagaagauggacacaaaaccuaccgauccgacaggcaucgaacccgacgaucaucugaaggagagaagcucccuucgguacgggaacgugcuggacguuaaugccauugacaucgaggaaccuucuggacagaccgcugauugguauacaauuggcguguacgucaucggguuuacccuccccaucauucugaaagcccuguauaugcucagcacgcgcggaagacagaccgugaaggagaacaaaggcacacggauccgcuucaaggacgauaccuccuuugaagacauuaaugggaucagacggccuaagcaccuguacguuucuaugcccacagcgcaaagcaccaugaaagccgaggagcuuacgccuggacgcuucagaacaauugugugcggccuguuuccgacccagauccagguccggaacauuaugucccccgugaugggcgugaucggguucagcuuuuucgucaaggauuggucugaacgcguuagagaguuuauggaaaaagaguguccuuucaucaagcccgaaauuaaaccuggaacacccccgcaggaggcugaguuucucaagcggaauaaaguguauuucaugcaaagacaggacgugcuggauaagaaccaugucgccgacaucgauaaacuuauugacuacgcugccuccggcgauccuaccagccccgacaauaucgaaucuccuaacgcgcccuggguguuugccugcgcucccgaccgcuguccuccgaccugcauuuauguugccgggauggcugagcugggagccuucuucuccauccuccaggauaugcggaauacaaucauggccagcaagacggugggcaccgcugaagagaagcugaaaaagaaaucuuccuuuuaccaaagcuaccugagacgcacacaguccauggggauucagcucgaccagcggaucauucugcuuuauaugcuggaauggggaaaggagauggucgaucacuuccaucucggcgacgauauggaccccgagcugagaggccuugcgcaagcccugaucgaucagaaggugaaagaaauuucuaaccaggagccucucaagaucuga

SEQ ID NO: 7217 - RNA, 1302 nt, Artificial Sequence
  derived and/or modified CDS sequence (opt5) from PUUV(PUUV/Mg9/HungaryTR17/00)__FN377821.1__N
augagcgaccuggccgauauccaggaggacauuaccagacacgaacaacagcucguggucgcucggcagaagcugaaagaugccgagaaggcgguugaaauggaccccgaugacgugaacaaaaauacacuucaggcucgccaacagacgguguccgcccuggaggauaagcucgccgacuucaaaagacggauggcugaugccgucucucgcaagaagauggacaccaaaccuacagauccgaccggcaucgaacccgacgaucaucugaaggagagaagcucccuucgguacgggaacgugcuggacguuaaugcuauugacaucgaggaaccuucuggacagacagccgauugguauaccauuggcguguacgucaucggguuuacacuccccaucauucugaaagcgcuguauaugcucagcacccgcggaagacagacggugaaggagaacaaaggcacccggauccgcuucaaggacgauacauccuuugaagacauuaaugggaucagacggccuaagcaccuguacguuucuaugcccaccgcccaaagcacaaugaaagcugaggagcuuaccccuggacgcuucagaacgauugugugcggccuguuuccgacacagauccagguccggaacauuaugucccccgugaugggcgugaucggguucagcuuuuucgucaaggauuggucugaacgcguuagagaguuuauggaaaaagaguguccuuucaucaagcccgaaauuaaaccuggaacacccccgcaggaggccgaguuucucaagcggaauaaaguguauuucaugcaaagacaggacgugcuggauaagaaccaugucgcugacaucgauaaacuuauugacuacgccgcguccggcgauccuaccagccccgacaauaucgaaucuccuaacgcccccuggguguuugcuugcgcccccgaccgcuguccuccgaccugcauuuauguugcugggauggccgagcugggagccuucuucuccauccuccaggauaugcggaauaccaucauggcuagcaagacagugggcacggcggaagagaagcugaaaaagaaaucuuccuuuuaccaaagcuaccugagacgcacccaguccauggggauucagcucgaccagcggaucauucugcuuuauaugcuggaauggggaaaggagauggucgaucacuuccaucucggcgacgauauggaccccgagcugagaggccuugcccaagcucugaucgaucagaaggugaaagaaauuucuaaccaggagccucucaagaucuga

SEQ ID NO: 7218 - RNA, 1302 nt, Artificial Sequence
  derived and/or modified CDS sequence (opt5) from PUUV(PUUV/NL/Mg1012/2010)__KU314900.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuacaaaagacggauggccgaugcugucucucgcaagaagauggacacaaaaccuaccgauccgacaggcaucgaacccgacgaucaucugaaggagagaagcucccuucgguaugggaacgugcuggacguuaaugccauugacaucgaggaaccuucuggacagaccgcugauugguacacaauuggcguguaugucaucggguucacccuccccaucauucugaaagcccuguacaugcucagcacgcgcggaagacagaccgugaaggagaacaaaggcacacggauccgcuuuaaggacgauaccuccuucgaagacauuaaugggaucagacggccuaagcaccuguauguuucuaugcccacagcgcaaagcaccaugaaagccgaggagcuuacgccuggacgcuuuagaacaauugugugcggccuguucccgacccagauccagguccggaacauuaugucccccgugaugggcgugaucggguuuagcuucuuugucaaggauuggccugaccgcaucagagaguucauggaaaaagaaugucccuuuauuaagccugagguuaaacccggaacaccggcucaggaagccgaguuccucaagcggaauaaaguguacuuuaugcaaagacaggaugugcuggacaagaaccaugucgcugauaucgacaaacuuauugauuaugccgcgucuggcgacccuaccucccccgacaauaucgagagcccuaacgcccccuggguguucgcuugcgcccccgaucgcuguccuccgaccugcauuuacguugcugggauggccgaacugggagccuuuuucucuauccuccaggacaugcggaauacaaucauggcuuccaagacggugggcgcggccgaggaaaagcugaaaaagaaaagcucuuucuaccaauccuaucugagacgcacccagagcauggggauucagcucgaucagcggaucauucugcuuuacaugcuggaguggggaaaggaaauggucgaccacuuucaucucggcgaugacauggaucccgagcugagaggccuugcucaagcccugaucgaccagaaggugaaagagauuuccaaccaggaaccucucaagaucuga

SEQ ID NO: 7219 - RNA, 1302 nt, Artificial Sequence
  derived and/or modified CDS sequence (opt5) from PUUV(PUUV/NL/Mg1439/2011)__KU314901.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuacaaaagacggauggccgaugcugucucucgcaagaagauggacacaaaaccuaccgauccgacaggcaucgaacccgacgaucaucugaaggagagaagcucccuucgguaugggaacgugcuggacguuaaugccauugacaucgaggaaccuucuggacagaccgcugauugguacacaauuggcguguaugucaucggguucacccuccccaucauucugaaagcccuguacaugcucagcacgcgcggaagacagaccgugaaggagaacaaaggcgcgcggauccgcuuuaaggacgauacauccuucgaagacauuaaugggaucagacggccuaagcaccuguauguuucuaugcccaccgcccaaagcacaaugaaagcugaggagcuuaccccuggacgcuuuagaacgauugugugcggccuguucccgacacagauccagguccggaacauuaugucccccgugaugggcgugaucggguuuagcuucuuugucaaggauuggccugaccgcaucagagaauuuauggagcgggaaugucccuuuauuaaaccugagguuaagcccggaaccccggcccaggaagcugaguuccucaaaagaaauaagguguacuuuaugcaacgccaggaugugcuggacaaaaaccaugucgccgauaucgacgagcuuauugauuaugcggccucuggcgacccuacaucccccgacaauaucgaaagcccuaacgcucccuggguguucgccugcgcucccgaucgguguccuccgaccugcauuuacguugccgggauggccgagcugggagcuuucuucucuauccuccaggacaugagaaauaccaucauggcguccaagacagugggcacggccgaagagaagcugaaaaagaaaagcucuuucuaccaauccuaucugcgccggacccagagcauggggauucagcucgaucagagaaucauucugcuuuacaugcuggaauggggaaaggagauggucgaccacuuucaucucggcgaugacauggaucccgagcugcgcggccuugcucaagcccugaucgaccagaaagugaaggaaauuuccaaccaggagccucucaagaucuga

SEQ ID NO: 7220 - RNA, 1302 nt, Artificial Sequence
  derived and/or modified CDS sequence (opt5) from PUUV(PUUV/NL/Mg2/2008)__KU314902.1__N
augagcgaccugaccgauauccaggaggacauuacaagacacgaacaacagcucguggucgcccggcagaagcugaaagaugcugagaaggccguugaaauggaccccgaugacgugaacaaaacgacccuucaggcgcgccaacagacaguguccgcucuggaggauaagcucgccgacuucaaaagacagauggccgaugcugucucucggaagaagauggacaccaaaccugccgauccgacaggcaucgaacccgacgaucaucugaaggagcgcagcucccuuagauacgggaaugugcuggacguuaacgcuauugacaucgaggaaccuucuggacagaccgccgauugguauacaauuggcguguacgucaucggguuuacccuccccaucauucugaaagcgcuguauaugcucagcacgcggggacgccaaaccgugaaggagaauaaaggcacaagaauccgguucaaggacgauaccuccuuugaagacauuaacgggauccgcagaccuaagcaccuguacguuucuaugcccacagcccagagcaccaugaaagcugaggagcuuacgccuggacgguuccgcacaauugugugcggccuguuuccgacccagauccaggucagaaauauuaugucccccgugaugggcgugaucggguucagcuuuuucgucaaggauugggccgaccggauccgcgaauuuauggagaaagaauguccuuucauuaagcccgauguuaaaccuggaacacccgcucaagaggccgaauuucucaagagaaacaaaaucuauuucaugcagcggcaggaggugcuggacaagaaucauguggcggauauugacaaacuuaucgauuacgccgcuucuggcgacccgaccuccccugacaacauugagagccccaauucuccuugggucuuugccugcgcucccgauagaugucccccuaccugcaucuauguggccgggauggccgaacugggagcuuucuucuccauccuccaagacaugcgcaacacaauuauggcgagcaagacgguuggcaccgccgaggaaaagcugaaaaagaaaucuuccuuuuaccagagcuaccugcggagaacacaguccauggggauccagcucgaucaacgcauuauccugcuuuauaugcuggaguggggaaaggaaaugguggaccacuuccaucucggcgaugacauggauccggagcugcggggccuugcucaggcccugauugaccagaaggucgaggaaaucucuaaucaggagccccucaaaaucuga

SEQ ID NO: 7221 - RNA, 1302 nt, Artificial Sequence
  derived and/or modified CDS sequence (opt5) from PUUV(PUUV/NL/Mg25/2007)__KU314897.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuacaaaagacggauggccgaugcugucucucgcaagaagauggacacaaaaccuaccgauccgacaggcaucgaacccgacgaucaucugaaggagagaagcucccuucgguaugggaacgugcuggacguuaaugccauugacaucgaggaaccuucuggacagaccgcugauugguacacaauuggcguguaugucaucggguucacccuccccaucauucugaaagcccuguacaugcucagcacgcgcggaagacagaccgugaaggagaacaaaggcacacggauccgcuuuaaggacgauaccuccuucgaagacauuaaugggaucagacggccuaagcaccuguauguuucuaugcccacagcgcaaagcaccaugaaagccgaggagcuuacgccuggacgcuuuagaacaauugugugcggccuguucccgacccagauccagguccggaacauuaugucccccgugaugggcgugaucggguuuagcuucuuugucaaggauuggccugaccgcaucagagaguucauggaaaaagaaugucccuuuauuaagccugagguuaaacccggaacaccggcucaggaagccgaguuccucaagcggaauaaaguguacuuuaugcaaagacaggaugugcuggacaagaaccaugucgcugauaucgacaaacuuauugauuaugccgcgucuggcgacccuaccucccccgacaauaucgagagcccuaacgcccccuggguguucgcuugcgcccccgaucgcuguccuccgaccugcauuuacguugcugggauggccgaacugggagccuuuuucucuauccuccaggacaugcggaauacaaucauggcuuccaagacggugggcaccgcggaggaaaagcugaaaaagaaaagcucuuucuaccaauccuaucugagacgcacacagagcauggggauucagcucgaucagcggaucauucugcuuuacaugcuggaguggggaaaggaaauggucgaccacuuucaucucggcgaugacauggaucccgagcugagaggccuugcccaagcucugaucgaccagaaggugaaagagauuuccaaccaggaaccucucaagaucuga

SEQ ID NO: 7222 - RNA, 1302 nt, Artificial Sequence
  derived and/or modified CDS sequence (opt5) from PUUV(PUUV/NL/Mg31/2007)__KU314896.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuacaaaagacggauggccgaugcugucucucgcaagaagauggacacaaaaccuaccgauccgacaggcaucgaacccgacgaucaucugaaggagagaagcucccuucgguaugggaacgugcuggacguuaaugccauugacaucgaggaaccuucuggacagaccgcugauugguacacaauuggcguguaugucaucggguucacccuccccaucauucugaaagcccuguacaugcucagcacgcgcggaagacagaccgugaaggagaacaaaggcacacggauccgcuuuaaggacgauaccuccuucgaagacauuaaugggaucagacggccuaagcaccuguauguuucuaugcccacagcgcaaagcaccaugaaagccgaggagcuuacgccuggacgcuuuagaacaauugugugcggccuguucccgacccagauccagguccggaacauuaugucccccgugaugggcgugaucggguuuagcuucuuugucaaggauuggccugaccgcaucagagaguucauggaaaaagaaugucccuuuauuaagccugagguuaaacccggaacaccggcucaggaagccgaguuccucaagcggaauaaaguguacuuuaugcaaagacaggaugugccugacaagaaccaugucgcugauaucgacaagcugauugauuaugccgcgucuggcgaccccaccuccccugacaauaucgagagccccaacgcccccuggguguucgcuugcgccccugaucgcuguccgccuaccugcauuuacguugcugggauggccgaacuuggagccuuuuucucuauccugcaggacaugcggaauacaaucauggcuuccaaaacggugggcaccgcggaggaaaagcucaaaaagaaaagcucuuucuaccaauccuaucugagacgcacacagagcauggggauucagcuggaucagcggaucauucuccuguacaugcuugaguggggaaaggaaauggucgaccacuuucaucugggcgaugacauggaucccgagcucagaggccuggcccaagcucuuaucgaccagaaggugaaagagauuuccaaccaggaaccccugaagaucuga

SEQ ID NO: 7223 - RNA, 1302 nt, Artificial Sequence
  derived and/or modified CDS sequence (opt5) from PUUV(PUUV/NL/Mg502/2008)__KU314904.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacagauggccgaugcugucucucggaagaagauggacacaaaaccugccgauccgaccggcaucgaacccgacgaucaucugaaggagcgcagcucccuuagauacgggaacgugcuggacguuaaugcuauugacaucgaggaaccuucuggacagacagccgauugguauaccauuggcguguacgucaucggguuuacacuccccaucauucugaaagcgcuguauaugcucagcacccggggacgccaaacggugaaggagaacaaaggcaccagaauccgguucaaggacgauacauccuuugaagacauuaaugggauccgcagaccuaagcaccuguacguuucuaugcccaccgcccagagcacaaugaaagcugaggagcuuaccccuggacgguuccgcacgauugugugcggccuguuuccgacacagauccaggucagaaacauuaugucccccgugaugggcgugaucggguucagcuuuuucgucaaggauugggccgaccggauccgcgaauuuauggagaaagaauguccuuucauuaagcccgauguuaaaccuggaacccccgcucaagaggccgaauuucucaagagaaauaaaaucuauuucaugcagcggcaggaggugcuggacaagaaccauguggcggauauugacaaacuuaucgauuacgccgcuucuggcgacccgacauccccugacaauauugagagccccgauucuccuugggucuuugccugcgcucccgacagaugucccccuaccugcaucuauguggccgggauggccgaacugggagcuuucuucuccauccuccaagauaugcgcaacaccauuauggcgagcaagacaguuggcacggccgaggaaaagcugaaaaagaaaucuuccuuuuaccagagcuaccugcggagaacccaguccauggggauccagcucgaccaacgcauuauccugcuuuauaugcuggaguggggaaaggaaaugguggaucacuuccaucucggcgacgauauggacccggagcugcggggccuugcucaggcccugauugaucagaaggucaaagagaucucuaaucaggaaccccucaagaucuga

SEQ ID NO: 7224 - RNA, 1302 nt, Artificial Sequence
  derived and/or modified CDS sequence (opt5) from PUUV(PUUV/NL/Mg591/2008)__KU314905.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacagauggccgaugcugucucucggaagaagauggacacaaaaccuaccgauccgacaggcaucgaacccgacgaucaucugaaggagcgcagcucccuuagauacgggaacgugcuggacguuaaugccauugacaucgaggaaccuucuggacagaccgcugauugguauacaauuggcguguacgucaucggguuuacccuccccaucauucugaaagcccuguauaugcucagcacgcggggacgccaaaccgugaaggagaacaaaggcacaagaauccgguucaaggacgauaccuccuuugaagacauuaaugggauccgcagaccuaagcaccuguacguuucuaugcccacagcgcagagcaccaugaaagccgaggagcuuacgccuggacgguuccgcacaauugugugcggccuguuuccgacccagauccaggucagaaacauuaugucccccgugaugggcgugaucggguucagcuuuuucgucaaggauugggcugaccggauccgcgaauuuauggagaaagaauguccuuucauuaagcccgauguuaaaccuggaacacccgcccaagaggcugaauuucucaagagaaauaaaaucuauuucaugcagcggcaggaggugcuggacaagaaccauguggccgauauugacaaacuuaucgauuacgcggccucuggcgacccgaccuccccugacaauauugagagccccaacucuccuugggucuuugcuugcgcccccgauagaugucccccuaccugcaucuauguggcugggauggccgaacugggagccuucuucuccauccuccaagacaugcgcaauacaauuauggcuagcaagacgguuggcaccgcggaggaaaagcugaaaaagaaaucuuccuuuuaccagagcuaccugcggagaacacaguccauggggauccagcucgaucaacgcauuauccugcuuuauaugcuggaguggggaaaggaaaugguggaccacuuccaucucggcgaugacauggauccggagcugcggucucuugcccaggcucugauugaccagaaggucaaagagaucagcaaccaggaaccccucaagaucuga

SEQ ID NO: 7225 - RNA, 1302 nt, Artificial Sequence
  derived and/or modified CDS sequence (opt5) from PUUV(Samara_49/CG/2005)__AB433843.2__N
augagcgaccugaccgauauccaggaggaaauuacaagacacgagcaacagcucguggucgcccggcagaagcugaaagacgcugaacgcgccguugagguggaucccgacgaugugaacaagaauacgcuucaggcgagacaacagaccgucuccgcucuggaagacaaacucgccgauuacaagcggcgcauggccgacgcugugucucggaaaaagauggauacaaagccuaccgacccgacaggcaucgagcccgaugaccaucugaaagagcggagcucccuucgcuaugggaacguucuggaugugaaugccauugacaucgaagaaccuucuggacagaccgcugacugguacacaauuggcgucuaugugaucggguucaccauccccauuauccucaaggcccuguacaugcugagcacgagaggacggcagaccguuaaagaaaacaagggcacacgcauuagauuuaaagaugacaccuccuucgaggauaucaaugggauucggcgcccuaagcaccucuaugugucuaugcccacagcgcaaagcaccaugaaggccgaggaacugacgccuggaagauuucggacaaucgucugcggccuuuucccgacccagauucaggugcgcaacaucaugucccccgugaugggcgucaucggguuuagcuucuuuguuaaagacuggccugagagaauuagagaguucauggagagagaaugucccuuuaucaagccugaggugaaacccggaacaccggcucaggagguggaguuccugaagcgcaaucgggucuacuuuaugaccagacaagaugugcucgacaaaaaccauguugccgauauugacaagcugaucgauuaugcugccucuggcgacccuaccucccccgaugacauugaaagcccuaaugcgcccuggguguucgccugcgcucccgaccgcuguccuccgacaugcaucuacgucgccgggauggcugaacuuggagccuuuuucucuauccugcaggauaugcggaacacgauuauggccuccaaaaccgugggcacagcugaggaaaagcucaagaaaaagagcucuuucuaccaguccuaucugagacgcacccaaagcauggggauccagcuggaccagcggauuauccuccuguacaugcuugaguggggaaaagagaugguugaucacuuucaucugggcgacgauauggaccccgaacucagaggccuggcgcagucccuuauugaucaaaaggugaaagagaucucuaaucaggaaccucugaagaucuga

SEQ ID NO: 7226 - RNA, 1302 nt, Artificial Sequence
  derived and/or modified CDS sequence (opt5) from PUUV(Thuin/33Cg/96)__AJ277030.1__N
augagcgaccugaccgauauccaggaggacauuacaagacacgaacaacagcucguggucgcccggcagaagcugaaagaugcugagaaggccguugaaauggaccccgaugacgugaacaaaaauacgcuucaggcgcgccaacagaccguguccgcucuggaggauaagcucgccgacuucaaaagacagauggccgaugcugucucucggaagaagauggacacaaaaccuaccgauccgacaggcaucgaacccgacgaucaucugaaggagcgcagcucccuuagauacgggaacgugcuggacguuaaugccauugacaucgaggaaccuucuggacagaccgcugauugguauacaauuggcguguacgucaucggguuuacccuccccaucauucugaaagcccuguauaugcucagcacgcggggacgccaaaccgugaaggagaacaaaggcacaagaauccgguucaaggacgauaccuccuuugaagacauuaaugggauccgcagaccuaagcaccuguacguuucuaugcccacagcgcagagcaccaugaaagccgaggagcuuacgccuggacgguuccgcacaauugugugcggccuguuuccgacccagauccaggucagaaacauuaugucccccgugaugggcgugaucggguucagcuuuuucgucaaggauugggcugaccggauccgcgaauuuauggagaaagaauguccuuucauuaagcccgagguuaaaccuggaacacccgugcaagaagccgaguuucucaagagaaauaaaaucuauuucaugcagcggcaggaggugcuggauaagaaccaugucgcugacauugauaaacuuaucgacuacgccgcgucuggcgauccgaccuccccugacaauauugaagcccccaacgcuccuuggguguuugccugcgcucccgacagaugucccccuaccugcaucuauguugccgggauggccgagcugggagcuuucuucagcauccuccaagauaugcgcaauacaauuauggcgucuaagacggugggcaccgccgaagagaagcugaaaaagaaauccagcuuuuaccagucuuaccugcggagaacacaguccauggggauccagcucgaccaacgcauuauccugcuuuauaugcuggaauggggaaaggagauggucgaucacuuccaucucggcgacgauauggacccggagcugcggggccuugcucaggcccugauugaucagaaggugaaagaaaucagcaaccaggagccccucaagaucuga

SEQ ID NO: 7227 - RNA, 1302 nt, Artificial Sequence
  derived and/or modified CDS sequence (opt5) from PUUV(Udmurtia/338Cg/92)__Z30708.1__N
augagcgaccugaccgauauccaggaggaaauuacaagacacgagcaacagcucguggucgcccggcagaagcugaaagacgcugaacgcgccguugagguggaucccgacgaugugaacaagaauacgcuucaggcgagacaacagaccgucuccgcucuggaagacaaacucgccgauuacaagcggcgcauggccgacucugugagccggaaaaagauggauacaaagccuaccgacccgacaggcaucgagcccgaugaccaucugaaagagagauccucuccucgcuaugggaacguucuugaugugaaugcuauugacaucgaggaacccagcggacagaccgccgacugguacacaauuggcgucuaugugaucggguucaccaucccuauuauccugaaggcucucuacaugcuguccacgagaggacggcagaccauuaaagaaaacaagggcacacgcaucagauuuaaagaugacaccucuuucgaggauauuaaugggauccggcgccccaagcaccuguauguuagcaugccuacagcccaauccaccaugaaggcggaggaacucacgccgggaagauuucggacaauugugugcggccuguuccccacccagauccagguccgcaacaucaugagcccugugaugggcgugauuggguuuucuuucuuugucaaagacuggcccgagagaauccgggauuucauggaaaaggaguguccuuuuauuaaacccgaaguuaagccgggaaccccugcccaggagaucgaguuccuuaaaagaaaucgcguguacuuuaugacacggcaagacgugcuggauaagaaccaugucgcugacauugauaaacucaucgacuaugccgcuuccggcgaucccaccagcccugacgacaucgaaucucccaaugcccccuggguguucgcgugcgccccugauagauguccgcccacaugcauuuacguugcugggauggccgagcugggagccuuuuucuccauccuucaggacaugcgcaacacgauuauggcuagcaagaccgugggcacagccgaagagaagcugaaaaagaaaucuuccuucuaccagagcuaucuccggagaacccaauccauggggauccagcuggaucagcgcauuauccugcucuacaugcuggaauggggaaaggagauggucgaccacuuucaucuuggcgaugacauggauccugagcugcggggccucgcucagucucugaucgaccaaaaagugaaggaaauuagcaaucaggagccccuuaagaucuga

SEQ ID NO: 7228 - RNA, 1302 nt, Artificial Sequence
  derived and/or modified CDS sequence (opt5) from PUUV(Udmurtia/444Cg/88)__Z30706.1__N
augagcgaccugaccgauauccaggaggaaauuacaagacacgagcaacagcucguggucgcccggcagaagcugaaagacgcugaacgcgccguugagguggaucccgacgaugugaacaagaauacgcuucaggcgagacaacagaccgucuccgcucuggaagacaaacucgccgauuacaagcggcgcauggccgacgcugugucucggaaaaagauggauacaaagccuaccgacccgacaggcaucgagcccgaugaccaucugaaagagcggagcucccuucgcuaugggaacguucuggaugugaaugccauugacaucgaggaaccuucuggacagaccgcugacugguacacaauuggcgucuaugugaucggguucaccauccccauuauccucaaggcccuguacaugcugagcacgagaggacggcagaccguuaaagaaaacaagggcacacgcauuagauuuaaagaugacaccuccuucgaggauaucaaugggauucggcgcccuaagcaccucuaugugucuaugcccacagcgcaaagcaccaugaaggccgaggaacugacgccuggaagauuucggacaaucgucugcggccuuuucccgacccagauucaggugcgcaacaucaugucccccgugaugggcgucaucggguuuagcuucuuuguuaaagacuggccugagagaauuagagauuucauggaaaaggagugucccuuuaucaaaccugaagugaagcccggaacaccggcucaggagauugaguuccugaaaagaaaucgcguguacuuuaugacccggcaagacguccucgauaagaaccauguggccgacaucgauaaacugauugacuaugcugccucuggcgauccuaccucccccgacgacaucgaaagcccuaaugcgcccuggguuuucgccugcgcucccgauagauguccuccgacaugcaucuacguggccgggauggcugagcuuggagccuuuuucucuauucugcaggacaugcgcaacacgaucauggccuccaagaccgucggcacagcugaagagaagcucaaaaagaaaagcucuuucuaccaguccuaucugcggagaacccaaagcauggggauucagcuggaucagcgcaucauucuccuguacaugcuugaauggggaaaggagaugguggaccacuuucaucugggcgaugacauggaucccgagcuccggggccuggcgcagucccuuaucgaccaaaaaguuaaggaaaucucuaaucaggagccucugaagauuuga

SEQ ID NO: 7229 - RNA, 1302 nt, Artificial Sequence
  derived and/or modified CDS sequence (opt5) from PUUV(Udmurtia/894Cg/91)__Z21497.1__N
augagcgaccugaccgauauccaggaggaaauuacaagacacgagcaacagcucguggucgcccggcagaagcugaaagacgcugaacgcgccguugagguggaucccgacgaugugaacaagaauacgcuucaggcgagacaacagaccgucuccgcucuggaagacaaacucgccgauuacaagcggcgcauggccgacgcugugucucggaaaaagauggauacaaagccuaccgacccgacaggcaucgagcccgaugaccaucugaaagagcggagcucccuucgcuaugggaacguucuggaugugaaugccauugacaucgaggaaccuucuggacagaccgcugacugguacacaauuggcgucuaugugaucggguucaccauccccauuauccucaaggcccuguacaugcugagcacgagaggacggcagaccguuaaagaaaacaagggcacacgcauuagauuuaaagaugacaccuccuucgaggauaucaaugggauucggcgcccuaagcaccucuaugugucuaugcccacagcgcaaagcaccaugaaggccgaggaacugacgccuggaagauuucggacaaucgucugcggccuuuucccgacccagauucaggugcgcaacaucaugucccccgugaugggcgucaucggguuuagcuucuuuguuaaagacuggccugagagaauuagagauuucauggaaaaggagugucccuuuaucaaaccugaagugaagcccggaacaccggcucaggagauugaguuccugaaaagaaaucgcguguacuuuaugacccggcaagacguccucgauaagaaccauguggccgacaucgauaaacugauugacuaugcugccucuggcgauccuaccucccccgacgacaucgaaagcccuaaugcgcccuggguuuucgccugcgcucccgauagauguccuccgacaugcaucuacguggucgggauggccgagcuuggagccuuuuucucuauucugcaggacaugcgcaacacgaucauggcuuccaagaccgugggcacagccgaagagaagcucaaaaagaaaagcucuuucuaccaguccuaucugcggagaacccaaagcauggggauucagcuggaucagcgcaucauucuccuguacaugcuugaauggggaaaggagaugguugaccacuuucaucugggcgaugacauggaucccgagcuccggggccuggcucagucccuuaucgaccaaaaagugaaggaaaucucuaaucaggagccucugaagauuuga

SEQ ID NO: 7230 - RNA, 1302 nt, Artificial Sequence
  derived and/or modified CDS sequence (opt5) from PUUV(Fusong-Cr-247)__EF442087.1__N
augagcgaccugaaggauauccaggaggacauugccagacacgaacaacagcucguggucgcucggcagaaacugcgcgaugccgagaaggcgguugaaauggaccccgaugacgugaacaauaacacccuucaggcuagacaacagacaguguccgcccuggaggauaaaaucgccgacuucaagcggcgcauggcugauauugucucucggaaaaagauggacacgaagccugccgauccgaccggcaucgaacccgacgaucaucucaaagagagaagcucccugcgcuacgggaaugugcuugacguuaacgcuauugacaucgaggaaccuucuggacagacagccgauugguauaccaucggcguguacauuaucggguuuacacugcccauuauccucaaggcgcuguauaugcugagcaccagaggacggcagacagucaaagagaauaagggcacccgcauuagauucaaagacgauacguccuuugaagacgugaacgggauccggcgcccuaagcaccucuacguuucuaugcccaccgcccaaagcacaaugaaggcugaggagcugaccccuggaagauuccggacaauugugugcggccuuuuuccgacccagauccagguccgcaauacgaugucccccgugaugggcgugaucggguucagcuuuuucgccaaagauuggccugacagaauuaaggaauuuauggagaaagaaugucccuucaucaagccugaggucaaacccggaacaccggcuaaggaaguugagauucugaaacggaacaagaucuauuuuaugcagagacaagaugugcucgacaagaaucaugugccugauauugacaaacugaucgauuacgccgcgucuggcgaccccaccuccccugagaacaucgacagccccaaugcccccugggucuucgcuugcgccccugaucgcuguccgcccacaugcauuuauguggcugggauggccgaacuuggagccuuuuucucuauccugcaggacaugcggaacaccauuauggcuuccaagaccguuggcacagcggaggaaaaacucaagaaaaagagcucuuucuaccaguccuaccugagacgcacgcaaagcauggggauccagcuggaucagcggauuauccuccuguauaugcuugaguggggaaaggaaaugguggaccacuuucaucugggcgaugacauggauccugagcucagaucccuggcccaggcucuuaucgaccaaaaagucaaggagauuucuaaucaggaaccccugaaaaucuga

SEQ ID NO: 7231 - RNA, 1302 nt, Artificial Sequence
  derived and/or modified CDS sequence (opt5) from MUV(11-4)__JX046484.1__N
augagcgaccugaaggagauccaggaagauauugccagacacgagcaacagcucguggucgcucggcagaaacugcgcgacgccgaaaaggcgguugagguggaucccgacgaugugaacaaaaauacccuucaggcuagacaacagacagucuccgcccuggaagacaagcucgccgauuucaaacggcagauggcugacuuugugucucgcaagaagauggauacgaaaccuaccgacccgacaggcaucgagcccgaugaccaucugaaggagagaagcucccuucgguacgggaacguucuggaugugaaugccauugacaucgaggaaccuucuggacagaccgcugacugguauacaauuggcgucuacaucaucggguucacccuccccauugugcugaaagcccuguauaugcucagcacacgcggaagacaaaccguuaaggaaaacaaaggcacgcggauccgcuuuaaggaugacaccuccuucgaggauauuaaugggaucagacggccuaagcaccuguacgugucuaugcccacagcgcagagcaccaugaaagccgaggaacuuacaccuggacgcuuuagaaccauugucugcggccuguucccgacgcagauccaggugcggaacauuaugucccccgugaugggcgucaucggguuuagcuucuuuguuaaggacugggcugaucgcaucaaagaguucauggaaaaggaguguccuuuuauuaaacccgaaccuaagcccggaacaccggccucugagguggaguuccucaaaagaaauaagaucuauuuuaugucccggcaagacgugcuggauaagaaccaugucccugacauugauaaacuuaucgacuacgcugccagcggcgaucccaccucuccugacaauauugaagaccccaacgcgcccuggguguucuccugcgccccugauagauguccgcccacaugccuguauguugcugggauggccgagcucggagcuuucuuuagcauccugcaggacaugcgcaauaccaucauggccucuaagaccgugggcacagccgaagagaaacugaagaaaaaguccagcuucuaccaguccuaccuccggagaacgcaaucuauggggauucagcuggaucagcgcaucauucuucuguauaugcucgaauggggaaaggagauggucgaccacuuucaucugggcgaugacauggauccugagcuucggacccuggcucaggcgcucaucgaccaaaaagugaaggaaauuagcaaccaggagccccugaaaaucuga

SEQ ID NO: 7232 - RNA, 1302 nt, Artificial Sequence
  derived and/or modified CDS sequence (opt5) from MUV(00-18)__DQ138128.1__N
augagcgaccugaaggagauccaggaagauauugccagacacgagcaacagcucguggucgcucggcagaaacugcgcgacgccgaaaaggcgguugagguggaucccgacgaugugaacaaaaauacccuucaggcuagacaacagacagucuccgcccuggaagacaagcucgccgauuucaaacggcagauggcugacuuugugucucgcaagaagauggauacgaaaccuaccgacccgacaggcaucgagcccgaugaccaucugaaggagagaagcucccuucgguacgggaacguucuggaugugaaugccauugacaucgaagaaccuucuggacagaccgcugacugguauacaauuggcgucuacgugaucggguucacccuccccaucguucugaaagcccuguauaugcucagcacacgcggaagacaaaccgugaaggaaaacaaaggcacgcggauucgcuuuaaggaugacaccuccuucgaggauaucaaugggauuagacggccuaagcaccuguacgucucuaugcccacagcgcagagcaccaugaaagccgaggaacuuacaccuggacgcuuuagaaccaucgugugcggccuguucccgacgcagauucaggugcggaacaucaugucccccgucaugggcguuauuggguuuagcuucuuugugaaggacuggguggagcgcaucaaagaguucauggagaaggaauguccuuuuaucaaacccgagccuaagcccggaacaccggcuucugaggucgaguuccucaaaagaaauaagauuuauuuuaugaaccggcaagaugugcuggacaagaaucauguuccugauaucgacaaacuuauugauuacgccgcuuccggcgaccccaccagcccugauaacaucgaagaccccaaugcccccuggguguucucuugcgcgccugacagauguccgcccacaugccuguaugucgccgggauggcugaacucggagccuucuuuuccauucugcaggauaugcgcaacaccaucauggcuagcaagaccgugggcacagccgaggaaaaacugaagaaaaagucuuccuucuaccagagcuaccuccggagaacgcaauccauggggauccagcuggaccagcgcauuauccuucuguauaugcucgaguggggaaaggagaugguugaucacuuucaucugggcgacgauauggacccugaacuucggacccuggcccaggcucucauugaucaaaaagugaaggagaucucuaaucaggaaccccugaaaauuuga

SEQ ID NO: 7233 - RNA, 1302 nt, Artificial Sequence
  derived and/or modified CDS sequence (opt5) from MUV(11-1)__JX028273.1__N
augagcgaccugaaggagauccaggaagauauugccagacacgagcaacagcucguggucgcucggcagaaacugcgcgacgccgaaaaggcgguugagguggaucccgacgaugugaacaaaaauacccuucaggcuagacaacagacagucuccgcccuggaagacaagcucgccgauuucaaacggcagauggcugacuuugugucucgcaagaagauggauacgaaaccuaccgacccgacaggcaucgagcccgaugaccaucugaaggagagaagcucccuucgguacgggaacguucuggaugugaaugccauugacaucgaggaaccuucuggacagaccgcugacugguauacaauuggcgucuacaucaucggguucacccuccccauugugcugaaagcccuguauaugcucagcacacgcggaagacaaaccguuaaggaaaacaaaggcacgcggauccgcuuuaaggaugacaccuccuucgaggauauuaaugggaucagacggccuaagcaccuguacgugucuaugcccacagcgcagagcaccaugaaagccgaggaacuuacaccuggacgcuuuagaaccauugucugcggccuguucccgacgcagauccaggugcggaacauuaugucccccgugaugggcgucaucggguuuagcuucuuuguuaaggacugggcugaucgcaucaaagaguucauggaaaaggaguguccuuuuauuaaacccgaaccuaagcccggaacaccggccucugagaucgaguuccucaaaagaaauaagauuuauuuuaugucccggcaagacgugcuggauaagaaccaugugccugacaucgauaaacuuauugacuacgcugccagcggcgaucccaccucuccugacaauaucgaagaccccaacgcgcccugggucuucuccugcgccccugauagauguccgcccacaugccuguauguggcugggauggccgagcucggagcuuucuuuagcauccugcaggacaugcgcaauaccauuauggccucuaagaccguuggcacagccgaagagaaacugaagaaaaaguccagcuucuaccaguccuaccuccggagaacgcaaucuauggggauccagcuggaucagcgcauuauccuucuguauaugcucgaauggggaaaggagaugguggaccacuuucaucugggcgaugacauggauccugagcuucggacccuggcucaggcgcucauugaccaaaaagucaaggaaaucagcaaccaggagccccugaaaaucuga

SEQ ID NO: 7234 - RNA, 1302 nt, Artificial Sequence
  derived and/or modified CDS sequence (opt5) from MUV(96-1)__DQ138133.1__N
augagcgaccugaaggagauccaggaagauauugccagacacgagcaacagcucguggucgcucggcagaaacugcgcgacgccgaaaaggcgguugagguggaucccgacgaugugaacaaaaauacccuucaggcuagacaacagacagucuccgcccuggaagacaagcucgccgauuucaaacggcagauggcugacuuugugucucgcaagaagauggauacgaaaccuaccgacccgacaggcaucgagcccgaugaccaucugaaggagagaagcucccuucgguacgggaacguucuggaugugaaugccauugacaucgaggaaccuucuggacagaccgcugacugguauacaauuggcgucuacgugaucggguucacccuccccaucguucugaaagcccuguauaugcucagcacacgcggaagacaaaccgugaaggaaaacaaaggcacgcggauucgcuuuaaggaugacaccuccuucgaggauaucaaugggauuagacggccuaagcaccuguacgucucuaugcccacagcgcagagcaccaugaaagccgaggaacuuacaccuggacgcuuuagaaccaucgugugcggccuguucccgacgcagauucaggugcggaacaucaugucccccgucaugggcguuauucgcuuuagcuuccucgugaaggacuggucugagaaaaucaaggaauuuauggagaaagaauguccuuucaucaagcccgagccuaaacccgggacaccggcuuccgagauugaauuucugaagagaaauaagaucuauuucaugaaccggcaagaugugcuugacaaaaaucaugucccugauauugacaagcugaucgauuacgccgcuagcggagaccccaccucuccugauaacauugaggcccccaaugcgcccuggguguuuuccugcgccccugacagauguccgcccacaugccucuauguugcuggcauggccgaacugggggcuuucuucagcauccugcaggacaugcgcaacaccaucauggccucuaaaaccgugggaacagccgaggaaaagcucaaaaagaaguccagcuuuuaccaguccuaccugcggagaacgcaaucuaugggcauucagcuugaucagcgcaucauucugcucuauaugcuggagugggggaaagagauggucgaccacuuccaucuuggagaugacauggauccugaacugcggacccucgcucaggcgcugaucgaccaaaaggugaaagagauuagcaaucaggaaccccugaagaucuga

SEQ ID NO: 7235 - RNA, 1302 nt, Artificial Sequence
  derived and/or modified CDS sequence (opt5) from MUV(99-28)__DQ138142.1__N
augagcgaccugaaggagauccaggaagauauugccagacacgagcaacagcucguggucgcucggcagaaacugcgcgacgccgaaaaggcgguugagguggaucccgacgaugugaacaaaaauacccuucaggcuagacaacagacagucuccgcccuggaagacaagcucgccgauuucaaacggcagauggcugacuuugugucucgcaagaagauggauacgaaaccuaccgacccgacaggcaucgagcccgaugaccaucugaaggagagaagcucccuucgguacgggaacguucuggaugugaaugccauugacaucgaagaaccuucuggacagaccgcugacugguauacaauuggcgucuacgugaucggguucacccuccccaucguucugaaagcccuguauaugcucagcacacgcggaagacaaaccgugaaggaaaacaaaggcacgcggauucgcuuuaaggaugacaccuccuucgaggauaucaaugggauuagaucuccuaagcaccuguacgucagcaugcccacagcgcaguccaccaugaaagccgaggaacuuacaccuggacgguuucgcaccaucgugugcggccuguucccgacgcagauucaggugagaaacaucaugagccccgucaugggcguuauuggguuuucuuucuuugugaaggacuggguggagcggaucaaagaguucauggagaaggaauguccuuuuaucaaacccgagccuaagcccggaacaccggcuuccgaggucgaguuccucaaacgcaauaagauuuauuuuaugaacagacaagaugugcuggacaagaaucauguuccugauaucgacaaacuuauugauuacgccgcuagcggcgaccccaccucuccugauaacaucgaagaccccaaugcccccuggguguucuccugcgcgccugaccgguguccgcccacaugccuguaugucgccgggauggcugaacucggagccuucuuuagcauucugcaggauaugagaaacaccaucauggcuucuaagaccgugggcacagccgaggaaaaacugaagaaaaaguccagcuucuaccaguccuaccuccgccggacgcaaucuauggggauccagcuggaccagagaauuauccuucuguauaugcucgaguggggaaaggagaugguugaucacuuucaucugggcgacgauauggacccugaacuucgcacccuggcccaggcucucauugaucaaaaagugaaggagaucagcaaucaggaaccccugaaaauuuga

SEQ ID NO: 7236 - RNA, 1290 nt, Artificial Sequence
  derived and/or modified CDS sequence (opt5) from SANGV(SA14)__NC_034526.1__N
auggccacccuggaggaaauccagaaggagauuaacauccacgaaggccaacucauuaucgcuaaacagaaggugaaagacgccgagaagcaguacgaaaaagaucccgacgaucugaauaagagagcgcuuagcgaccgggaggggauugcucauuccauccagucuaagaucgaugagcugcgcagacaacucgccgaccgggucgccgcuggacgcaaccugggccaggaaagagauccuacagggguugagccgggagaccaccuucgggaaaagagcaugcuguccuauggcaaugugauugaucucaaccaucuggacaucgaugagcccacggggcagaccgccgacuggcugucuauugugaucuaccucaccagcuucgucgugccuauucugcuuaaggcucuguauaugcucacaacacgcggaagacagaccacaaaagauaauaagggcaugcggauccgcuuuaaagacgacuccucuuucgaggauguuaacggcauuagaaagcccaagcaccuguuucuuagcaugccuaaugcccaauccagcaugaaagcggaagagaucacccccgggcgguuccgcacggccgugugcggacuguacccugcucagaucaaggccagaaacauggucucuccggugauguccguuauuggcuuuaucacccucgcucgggacuggacagaacgcauugagaauuggcuggaucagcccuguaaauucaugagcgaaccuucucagaccucccugcaaaaggggcccgccacaaacagagacuaucucaaucagcggcaggcgagccuggcccaaauggagaccaaagaggcucaggccgugagacagcaggcugucgaugccggaugcaaccuuguggaccauaucgauucuccuuccagcauuuggguguuugccggcgcucccgaccgcuguccgccuacgugccuguucaucuccgggauggcggaacucggagccuuuuucucuauccugcaagauaugcggaauacaauuauggcuagcaagaccgucggcacauccgaggaaaaacuuagaaagaaaagcucuuuuuaccaguccuaucugcgccggacccagagcaugggcauccagcucgaccaaagaauuaucauuauguucaugguugagugggggaaagaagccguggauggauuucaccugggcgacgacauggaucccgagcugcgcucuuucgcccaggcucucaucgaccagaaggugaaagagaucagcaaccaggaaccucugaagauuuga

SEQ ID NO: 7237 - RNA, 1290 nt, Artificial Sequence
  derived and/or modified CDS sequence (opt5) from SANGV(SA22)__JQ082303.1__N
auggccacccuggaggaaauccagaaggagauuaacauccacgaaggccaacucauuaucgcuaaacagaaggugaaagacgccgagaagcaguacgaaaaagaucccgacgaucugaauaagagagcgcuuagcgaccgggaggggauugcucauuccauccagucuaagaucgaugagcugcgcagacaacucgccgaccgggucgccgcuggacgcaaccugggccaggaaagagauccuacagggguugagccgggagaccaccuucgggaaaagagcaugcuguccuauggcaaugugauugaucucaaccaucuggacaucgaugagcccacggggcagaccgccgacuggcugucuauugugaucuaccucaccagcuucgucgugccuauucugcuuaaggcucuguauaugcucacaacacgcggaagacagaccacaaaagauaauaagggcaugcggauccgcuuuaaagacgacuccucuuucgaggauguuaacggcauuagaaagcccaagcaccuguuucuuagcaugccuaaugcccaauccagcaugaaagcggaagagaucacccccgggcgguuccgcacggccgugugcggacuguacccugcucagaucaaggccagaaacauggucucuccggugauguccguuauuggcuuuaucacccucgcucgggacuggacagaacgcauugagaauuggcuggaucagcccuguaaauucaugagcgaaccuucucagaccucccugcaaaaggggcccgccacaaacagagacuaucucaaucagcggcaggcgagccuggcccaaauggagaccaaagaggcucaggccgugagacagcaggcugucgaugccggaugcaaccuuguggaccauaucgauucuccuuccagcauuuggguguuugccggcgcucccgaccgcuguccgccuacgugccuguucaucuccgggauggcggaacucggagccuuuuucucuauccugcaagauaugcggaauacaauuauggcuagcaagaccgucggcacauccgaggaaaaacuuagaaagaaaagcucuuuuuaccaguccuaucugcgccggacccagagcaugggcauccagcucgaccaaagaauuaucauuauguucaugguugagugggggaaagaagugguggauggauuucaccugggcgacgacauggaucccgagcugcgcucuuucgcccaggcccucaucgaccagaaggucaaagagaucagcaaccaggaaccucugaagauuuga

SEQ ID NO: 7238 - RNA, 1290 nt, Artificial Sequence
  derived and/or modified CDS sequence (opt5) from SEOV(L99)__AF288299.1__N
auggccaccauggaggaaauccagagagagauuagcgcucacgaaggccaacuggugaucgcccggcagaaggucaaagacgcggagaagcaguacgaaaaagaucccgacgaucucaacaagcgcacacugcaugacagagaguccguugcugccucuauucagagcaaaaucgaugagcuuaagcggcaacuggccgaccgcauugcugccgggaagaauaucggacaggauagagacccuacgggcguggaaccgggggaucaccucaaagagcgguccgcucugucuuauggaaacacccuugaccugaauagccucgauaucgacgaacccacaggccagaccgccgauuggcugacaauuaucguguaccugaccuccuucgucgugccuauuauccucaaggcgcuguauaugcuuacaacccgcgggagacagacgucuaaagacaacaagggaaugcggauucgcuuuaaagacgauagcuccuacgaggacguuaauggcaucagaaagcccaagcaucuguaugugagcaugccuaacgcccaaucuuccaugaaagcugaggaaauuacccccggccgguuccgcacagccgucugcgggcucuacccugcucagaucaaggccagaaauauggugagcccgguuaugucuguggucggauuucuggcgcuugccaaagauuggaccucccggaucgaggaauggcugggcgcucccuguaaguucauggccgagagcccuauugcugggucucucuccggaaaccccgugaaucgcgacuauaucagacagcggcagggcgcccuggccgggauggaaccuaaagaguuucaagcucugagacagcacgcgaaggaugccggaugcacacucguggagcauauugaaagccccuccucuaucugggucuucgcuggcgccccggaccgcuguccuccuaccugccuguuuguuggcgggauggccgagcuuggagcuuucuuuagcauucugcaggauaugcggaacacgaucauggccuccaaaacagugggcaccgcggacgaaaagcucagaaagaaaagcucuuucuaccaauccuaccugcgccggacacagagcauggggauccagcuugaucagagaauuaucgugauguuuauggucgcuuggggaaaggaggccguguauaauuuccaccugggcgacgauauggaccccgaacuccgcucucuggcccaaauucugaucgaccagaaaguuaaggagauuagcaaccaggagcccaugaaacucuga

SEQ ID NO: 7239 - RNA, 1290 nt, Artificial Sequence
  derived and/or modified CDS sequence (opt5) from SEOV(SG42/2011)__KY807171.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauugguccaccauuaucguguaccugacaucuuucgucgugccuauuauccugaaggcccucuauaugcugaccacacgcgggagacagaccagcaaagacaacaagggaaugcggauucgcuuuaaagacgauuccagcuacgaggacguuaauggcaucagaaagcccaagcaucuuuaugugucuaugccuaacgcucaauccagcaugaaagccgaggaaauuacgcccggccgguuccgcaccgcugucugcgggcuguacccugcccagaucaaggcgagaaauauggugucuccgguuauguccguggucggauuucucgcccuggcuaaagauuggagcucucggaucgaggaauggcuuggcgcccccuguaaguucauggcugaguccccuauugccgggagccuguccggaaaccccgugaaucgcgacuauaucagacagcggcagggcgcccucgcugggauggaaccuaaagaguuucaagcgcugagacagcacucuaaggaugccggaugcacacugguggagcauauugaaagccccuccagcaucugggucuucgcuggcgccccggaccgcuguccuccuaccugccucuuuguuggcgggauggccgagcugggagcuuucuuuucuauucuucaggauaugcggaacacaaucauggccuccaaaaccgugggcacggcggacgaaaagcugagaaagaaaagcucuuucuaccaaagcuaccuccgccggacacaguccauggggauccagcuggaucagagaauuaucgugauguuuauggucgcuuggggaaaggaggccguggacaauuuccaccuuggcgaugacauggaccccgaacugcgcucucucgcccaaauucugaucgaucagaaaguuaaggagauuagcaaccaggagcccaugaaacuguga

SEQ ID NO: 7240 - RNA, 1290 nt, Artificial Sequence
  derived and/or modified CDS sequence (opt5) from SEOV(XJ2/2011)__KY807169.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcucuagacagaccagcaaagacaacaaggggaugcggauucgcuuuaaagacgauuccagcuacgaggacguuaauggaaucagaaagcccaagcaucuguaugugucuaugccuaacgcucaauccagcaugcgggccgaggaaauuacgcccggccgcuucagaaccgcugucugcggccucuacccugcccagaucaaagcgcggaauauggugucuccgguuauguccguggucggguuucuggcccuugcuaaggauuggacaagccgcaucgaggaauggcugggagcccccuguaaauucauggcugagucuccuauugccggcucccucagcgggaaccccgugaauagagacuauauccggcagagacagggagcccuggcuggcugggaaccuaaggaguuucaagcgcugcgccagcacuccaaagaugccgggugcacccucguggagcauauugaaucucccagcuccaucugggucuucgcuggagccccggaccgguguccucccacaugccuguuuguuggcggcauggccgagcuuggggcuuucuuuagcauucugcaggauaugagaaacaccaucauggccucuaagacggugggaacagcggacgaaaaacuccgcaagaaguccagcuucuaccaaucuuaccugcggagaacccagagcaugggcauccagcuugaucagcgcauuaucgugauguuuauggucgcuugggggaaagaggccguggacaauuuccaccugggagaugacauggacccugaacuccggucccuggcccaaauucugaucgaucagaagguuaaagagauuucuaaccaggagcccaugaagcucuga

SEQ ID NO: 7241 - RNA, 1290 nt, Artificial Sequence
  derived and/or modified CDS sequence (opt5) from SEOV(XJ5/2011)__KY807170.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugagagcccuauugccgggucucucuccggaaaccccgugaaucgcgacuauaucagacagcggcagggcgcccuggcugggauggaaccuaaagaguuucaagcgcugagacagcaccccaaggaugccggaugcacccucguggagcauauugaaagcccguccucuaucugggucuucgcuggcgccccugaccgcugucccccuacaugccuguuuguuggcgggauggccgagcuuggagcuuucuuuagcauucugcaggauaugcggaacaccaucauggccuccaaaacggugagcacagcggacgaaaagcucagaaagaaaucuuccuucuaccaaagcuaccugcgccggacccagucuaugggcauccagcuugaucagagaauuaucgugauguuuauggucgcuugggggaaggaggccguggacaauuuccaccugggagaugacauggaccccgaacuccgcagccuggcccaaauucugaucgaucagaaaguuaaggagauuuccaaccaggagcccaugaaacucuga

SEQ ID NO: 7242 - RNA, 1290 nt, Artificial Sequence
  derived and/or modified CDS sequence (opt5) from SEOV(10-134)__JF693882.2__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucguccucccuauuauccugaaggcccuuuauaugcugaccacacgcgggagacagaccucuaaagacaacaagggaaugcggauucgcuuuaaagacgauagcuccuacgaggacgugaauggcaucagaaagcccaagcaucucuauguuagcaugccuaacgcucaaucuuccaugaaagccgaggaaauuacgcccggccgguuccgcaccgcugugugcgggcuguacccugcccagaucaaggcgagaaauauggucagcccggugaugucuguugugggauuucuugcccuggcuaaagauuggacaucccggaucgaggaauggcucggcgcccccuguaaguucauggcugagagcccuauugccgggucucuguccggaaaccccgucaaucgcgacuauaucagacagcggcagggcgcccuggcugggauggaaccuaaagaguuucaagcgcucagacagcacagcaaggaugccggaugcacccugguggagcauauugaaucccccucuagcaucuggguguucgcuggcgccccggaccgcuguccucccacaugccuuuuugucggcgggauggccgagcugggagcuuucuuuuccauucuccaggauaugcggaacaccaucauggccagcaaaacgguuggcacagcggacgaaaagcugagaaagaaaucuuccuucuaccaaagcuaccuucgccggacccagucuauggggauccagcuggaucagagaauuaucgugauguuuaugguggcuuggggaaaggaggccgucgacaauuuccaccucggcgaugacauggacccugaacugcgcagccuggcccaaauucucaucgaucagaaagugaaggagauuuccaaccaggagcccaugaaacuguga

SEQ ID NO: 7243 - RNA, 1290 nt, Artificial Sequence
  derived and/or modified CDS sequence (opt5) from SEOV(DPRK08)__JX853575.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugagagcccuauugccgggucucucuccggaaaccccgugaaucgcgacuauaucagacagcggcagggcgcccuggcugggauggaaccuaaagaguuucaagcgcugagacagcacgccaaggaugcuggaugcacccucguggagcauauugaaagccccuccucuaucugggucuucgccggcgccccggaccgcuguccucccacaugccuguuuguuggcgggauggcugagcuuggagccuucuuuagcauucugcaggauaugcggaacaccaucauggcguccaaaacggugggcacagcugacgaaaagcucagaaagaaaagcucuuucuaccaauccuaccugcgccggacccagagcauggggauccagcuugaucagagaauuaucgugauguuuauggucgccuggggaaaggaggccguggacaauuuccaccugggcgaugacauggacccugaacuccgcucucuggcucaaauucugaucgaucagaaaguuaaggagauuagcaaccaggagcccaugaaacucuga

SEQ ID NO: 7244 - RNA, 1290 nt, Artificial Sequence
  derived and/or modified CDS sequence (opt5) from SEOV(Fj372/2013)__KP645198.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugagagcccuauugccgggucucucuccggaagccccgugaaccgcgacuauaucagacagcggcagggcgcccuggcugggauggaaccuaaagaguuucaagcgcugagacagcacgccaaggaugcuggaugcacccucguggagcauauugaaucccccucuagcaucugggucuucgccggcgccccggaccgcuguccucccacaugccuguuuguuggcgggauggcugagcuuggagccuucuuuuccauucugcaggauaugcggaauaccaucauggcgagcaaaacggugggcacagcugacgaaaagcucagaaagaaaucuuccuucuaccaaagcuaccugcgccggacccagucuauggggauccagcuugaucagagaauuaucgugauguuuauggucgccuggggaaaggaggccguggacaacuuccaccugggcgaugacauggacccugaacuccgcagccuggcucaaauucugaucgaucagaaaguuaaggagauuuccaaucaggagcccaugaaacucuga

SEQ ID NO: 7245 - RNA, 1290 nt, Artificial Sequence
  derived and/or modified CDS sequence (opt5) from SEOV(HeB38)__JN377553.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugaaaauucgguuuaaggacgauagcuccuacgaggacguuaauggcauccgcaagcccaaacaucuguaugugagcaugccuaacgcucaaucuuccaugaaggccgaggaaauuacgcccggcagauuccggaccgcugucugcgggcucuacccugcccagaucaaagcgcgcaauauggugagcccgguuaugucuguggucggauuucuggcccuugcuaaggauuggacauccagaaucgaggaauggcugggcgcccccuguaaauucauggcugagagcccuauugccgggucucucuccggaaaccccgugaaucgggacuauauccgccagagacagggcgcccuggcugggauggaaccuaaggaguuucaagcgcugcggcagcacagcaaagaugccggaugcacccucguggagcauauugaaucccccucuagcaucugggucuucgcuggcgccccggacagauguccucccacaugccuguuuguuggcgggauggccgagcuuggagcuuucuuuuccauucugcaggauaugcgcaacaccaucauggccagcaagacggugggcacagcggacgaaaagcuccggaaaaagucuccuuucuaccaauccuaccugagacgcacccagagcauggggauccagcuugaucagcggauuaucgugauguuuauggucgcuuggggaaaagaggccguggacaauuuccaccugggcgaugacauggaccccgaacucagagggcuggcccaaauucugaucgaucagaagguuaaagagauuucuaaccaggagcccaugaagcucuga

SEQ ID NO: 7246 - RNA, 1290 nt, Artificial Sequence
  derived and/or modified CDS sequence (opt5) from SEOV(JiangxiXinjianRn-07-2011)__KP859511.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugagagcccuauugccgggucucucuccggaaaccccgugaaucgcgacuauaucagacagcggcagggcgcccuggcugggauggaaccuaaagaguuucaagcgcugagacagcacagcaaggaugccggaugcacccucguggagcauauugaaucccccucuagcaucugggucuucgcuggcgccccggaccgcuguccucccacaugccuguuuguuggcgggauggccgagcuuggagcuuucuuuuccauucugcaggauaugcggaacaccaucauggccagcaaaacggugggcacagcggacgaaaagcucagaaagaaaucuuccuucuaccaaagcuaccugcgccggacccagucuauggggauccagcuugaucagagaauuaucgugauguuuauggucgcuuggggaaaggaggccguggacaauuuccaccugggcgaugacauggacccugaacuccgcagccuggcccaaauucugaucgaucagaaaguuaaggagauuuccaaccaggagcccaugaaacucuga

SEQ ID NO: 7247 - RNA, 1290 nt, Artificial Sequence
  derived and/or modified CDS sequence (opt5) from SEOV(JiangxiXinjianRn-09-2011)__KP859512.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaauucucuaugaaagccgaggaaauuacgcccggccgguuucgcaccgcugucugcgggcucuacccugcccagaucaaggcgagaaauaugguguccccgguuaugagcguggucggauuccuggcccuugcuaaagauuggacaucucggaucgaggaauggcugggcgcccccuguaaguuuauggcugaguccccuauugccgggagccucucuggaaaccccgugaaucgcgacuauaucagacagcggcagggcgcccuggcugggauggaaccuaaagaguuccaagcgcugagacagcacuccaaggaugccggaugcacccucguggagcauauugaaagccccuccucuaucugggucuuugcuggcgccccggaccgcuguccucccacaugccuguucguuggcgggauggccgagcuuggagccuuuuucagcauucugcaggauaugcggaacaccaucauggcuuccaaaacggugggcacagcggacgaaaagcucagaaagaaaagcucuuuuuaccaauccuaccugcgccggacccagagcauggggauccagcuugaucagagaauuaucgugauguucauggucgcuuggggaaaggaggccguggacaauuuucaccugggcgaugacauggacccugaacuccgcucucuggcccaaauucugaucgaucagaaaguuaaggagauuagcaaccaggagcccaugaaacucuga

SEQ ID NO: 7248 - RNA, 1290 nt, Artificial Sequence
  derived and/or modified CDS sequence (opt5) from SEOV(Singapore/06(RN41))__GQ274944.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugagagcccuauugccgggucucucuccggaaaccccgugaaucgcgacuauaucagacagcggcagggcgcccuggcugggauggaaccuaaagaguuucaagcgcugagacagcacagcaaggaugccggaugcacccucguggagcauauugaaucccccucuagcaucugggucuucgcuggcgccccggaccgcuguccucccacaugccuguuuguuggcgggauggccgagcuuggagcuuucuuuuccauucugcaggauaugcggaacaccaucauggccagcaaaacggugggcacagcggacgaaaagcucagaaagaaaucuuccuucuaccaaagcuaccugcgccggacccagucuauggggauccagcuugaucagagaauuaucgugauguuuauggucgcuuggggaaaggaggccguggacaauuuccaccugggcgaugacauggacccugaacuccgcgggcuggcccaaauucugaucgaucagaaaguuaaggagauuagcaaccaggagcccaugaaacucuga

SEQ ID NO: 7249 - RNA, 1290 nt, Artificial Sequence
  derived and/or modified CDS sequence (opt5) from SEOV(YaluRiver12)__HQ611980.1__N
auggccaccauggaggaaauccagagagagauuagcgcucacgaaggccaacuggugaucgcccggcagaaggucaaagacgcggagaagcaguacgaaaaagaucccggggaccucaacaagcgcgcucugcaugauagagaguccguugccgccucuauucagagcaaaaucgacgagcuuaagcggcaacuggcugaucgcauugccgcuggaaagaauaucggccaggacagagauccuacagggguggaaccgggagaccaccucaaagagcgguccgcccugucuuauggcaacacgcuugaucugaauagccucgacaucgaugaacccaccgggcagacagcggacuggcugaccauuaucguguaccugacauccuucgucgugccuauuauccucaaggcccuguauaugcuuaccacacgcggaagacagaccucuaaagauagcaagggcaugcggauucgcuuuaaagacgacuccagcuacgaggauguuaacggcaucagaaagcccaagcaucuguaugugucuaugccuaaugcucaauccagcaugaaaacggaggaaauuacccccgggcgguuccgcacagccgucugcggacucuacccugcucagaucaaggccagaaacauggugucuccgguuauguccguggucggcuuucuggcgcuugccaaagacuggaccagccggaucgaggaauggcugggggcucccuguaaguucauggccgagucuccuauugcuggaucccucagcgaaaaucccgugaaccgcgauuauaucagacagcggcagggcgcccuggccgggauggagccuaaagaguuucaagcucugagacagcacgcgaaggacgccggaugcacacucguggaacauauugagucccccucuagcaucugggucuucgcuggcgccccggaucgcuguccuccuaccugccuguuuguuggcgggauggccgaacuuggagcuuucuuuuccauucugcaggacaugcggaauacgaucauggccagcaaaacagugggcaccgcggaugagaagcucagaaagaaaucuuccuucuaccaaagcuaccugcgccggacacagucuauggggauccagcuugaccagagaauuaucgugauguuuauggucgcuuggggaaaggaagccguggauaacuuccaccugggcgacgauauggaccccgagcuccgcagccuggcccaaauucugaucgaccagaaaguuaaggagauuuccaaucaggaacccaugaaacucuga

SEQ ID NO: 7250 - RNA, 1290 nt, Artificial Sequence
  derived and/or modified CDS sequence (opt5) from SEOV(14D12)__AB618124.1__N
auggccaccauggaggaaauccagaaggagauuagcgcucacgaaggccaacuggugaucgccagacagaaagucaaggacgcggagaaacaguacgaaaaggaucccgacgaucucaacaaacgggcucugcaugaccgcgaguccguugccgccucuauucagagcaagaucgaugagcuuaagagacaacuggcugaccggauugccgcugggaaaaauaucggacaggaucgcgacccuacaggcguggaaccgggggaucaccucaaggagagauccgcccugucuuauggaaacacgcuugaccugaauagccucgauaucgacgaacccaccggccagacagcggauuggcugaccauuaucguguaccugacauccuucgucgugccuauuauccucaaagcccuguauaugcuuaccacacgggggcgccagaccucuaaggacaacaaaggaaugcggauuagauuuaaggacgauagcuccuacgaggacguuaauggcauccgcaagcccaaacaucuguaugugagcaugccuaacgcucaaucuuccaugaaggccgaggaaauuacgcccggcagauuccggaccgcugucugcgggcucuacccugcccagaucaaagcgcgcaauauggugagcccgguuaugucuguggucggauuucuggcccuugcuaaggauuggacauccagaaucgaggaauggcugggcgcccccuguaaauucauggcugagagcccuauugccgggucucucuccggaaaccccgugaaucgggacuauauccgccagagacagggcgcccuggcugggauggaaccuaaggaguuucaagcgcugcggcagcacagcaaagaugccggaugcacccucguggagcauauugaaucccccucuagcaucugggucuucgcuggcgccccggacagauguccucccacaugccuguuuguuggcgggauggccgagcuuggagcuuucuuuuccauucugcaggauaugcgcaacaccaucauggccagcaagacggugggcacagcggacgaaaagcuccggaaaaagucuuccuucuaccaaagcuaccugagacgcacccagucuauggggauccagcuugaucagcggauuaucgugauguuuauggucgcuuggggaaaagaggccguggacaauuuccaccugggcgaugacauggacccugaacucagaagccuggcccaaauucugaucgaucagaagguuaaagagauuuccaaccaggagcccaugaagcucuga

SEQ ID NO: 7251 - RNA, 1281 nt, Artificial Sequence
  derived and/or modified CDS sequence (opt5) from SEOV(19CSG)__AB618114.1__N
auggaggaaauccagagagagauuagcgcccacgaaggccaacuggugaucgcucggcagaaggucaaagacgccgagaagcaguacgaaaaagaucccgacgaucucaacaagcgcgcgcugcaugacagagaguccguugcugccucuauucagagcaaaaucgaugagcuuaagcggcaacuggccgaccgcauugcugccgggaagaauaucggacaggauagagacccuaccggcguggaaccgggggaucaccucaaagagcgguccgcucugucuuauggaaacacacuugaccugaauagccucgauaucgacgaacccacgggccagaccgccgauuggcugacaauuaucguguaccugaccuccuucgucgugccuauuauccucaaggcgcuguauaugcuuacaacccgcgggagacagacaucuaaagacaacaagggaaugcggauucgcuuuaaagacgauagcuccuacgaggacguuaauggcaucagaaagcccaagcaucuguaugugagcaugccuaacgcccaaucuuccaugaaagcugaggaaauuacccccggccgguuccgcacggccgucugcgggcucuacccugcucagaucaaggccagaaauauggugagcccgguuaugucuguggucggauuucuggcgcuugccaaagauuggaccucccggaucgaggaauggcugggcgcucccuguaaguucauggccgagagcccuauugcugggucucucuccggaaaccccgugaaucgcgacuauaucagacagcggcagggcgcccuggccgggauggaaccuaaagaguuucaagcucugagacagcacagcaaggaugcgggaugcacacucguggagcauauugaaucccccucuagcaucugggucuucgccggcgcuccggaccgcuguccuccuaccugccuguuuguuggcgggauggccgagcuuggagccuucuuuuccauucugcaggauaugcggaacacaaucauggcuagcaaaaccgugggcacggccgacgaaaagcucagaaagaaaucuuccuucuaccaaagcuaccugcgccggacacagucuauggggauccagcuugaucagagaauuaucgugauguuuauggucgcguggggaaaggaggcuguggacaauuuccaccugggcgaugacauggaccccgaacuccgcagccuggcccaaauucugaucgaucagaaaguuaaggagauuuccaaccaggagcccaugaaacucuga

SEQ ID NO: 7252 - RNA, 1290 nt, Artificial Sequence
  derived and/or modified CDS sequence (opt5) from SEOV(93HBX12)__EF192308.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucggcaagcccaagcaucuguaugugagcaugccuaacgcucaaucuuccaugaaagccgaggaaauuacgcccgggagauuccggaccgcugucugcggacucuacccugcccagaucaaggcgcgcaauauggugagcccgguuaugucuguggucggcuuucuggcccuugcuaaagauuggacauccagaaucgaggaauggcugggggcccccuguaaguucauggcugagagcccuauugccggaucucucuccggcaaccccgugaaucgggacuauauccgccagagacagggggcccuggcuggaauggaaccuaaagaguuucaagcgcugcggcagcacagcaaggaugccggcugcacccucguggagcauauugaaucccccucuagcaucugggucuucgcuggcgccccggacagauguccucccacaugccuguuuguugggggaauggccgagcuuggcgcuuucuuuuccauucugcaggauaugcgcaacaccaucauggccagcaaaacgguggggacagcggacgaaaagcuccggaagaaaucuuccuucuaccaaagcuaccugagacgcacccagucuaugggaauccagcuugaucagcggauuaucgugauguuuauggucgcuuggggcaaggaggccguggacaauuuccaccugggggaugacauggacccugaacucagaggacuggcccaaauucugaucgaucagaaaguuaaggagauuagcaaccaggagcccaugaaacucuga

SEQ ID NO: 7253 - RNA, 1290 nt, Artificial Sequence
  derived and/or modified CDS sequence (opt5) from SEOV(Cherwell)__KC626089.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauugcugagagcccuaucgccgggucucucuccggaaaccccgugaaucgcgacuauauuagacagcggcagggcgcccuggcugggauggaaccuaaagaguuucaagcgcugagacagcacagcaaggaugccggaugcacccucguggagcauaucgaaucccccucuagcauuugggucuucgcuggcgccccggaccgcuguccucccacaugccuguuuguuggcgggauggccgagcuuggagcuuucuuuuccauccugcaggauaugcggaacaccaucauggccagcaaaacggugggcacagcggacgaaaagcucagaaagaaaucuuccuucuaccaaagcuaccugcgccggacccagucuauggggauucagcuugaucagagaaucauugugauguuuauggucgcuuggggaaaggaggccguggacaauuuccaccugggcgaugacauggacccugaacuccgcagccuggcccaaauccugauugaucagaaaguuaaggagaucuccaaccaggagcccaugaaacucuga

SEQ ID NO: 7254 - RNA, 1290 nt, Artificial Sequence
  derived and/or modified CDS sequence (opt5) from SEOV(CixiRf23)__FJ803201.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugagagcccuauugccgggucucucuccggaaaccccgugaaucgcgacuauaucagacagcggcagggcgcccuggcugggauggaaccuaaagaguuucaagcgcugagacagcacgccaaggaugcuggacgcacccucguggagcauauugaaagccccuccucuaucugggucuucgccggcgccccggaccggugcccucccacaugucuguuuguuggcgggauggcugagcuuggagccuucuuuagcauucugcaggauaugagaaacaccaucauggcguccaaaacggugggcacagcugacgaaaagcuccgcaagaaaagcucuuucuaccaauccuaccugcggagaacccagagcauggggauccagcuugaucagcgcauuaucgugauguuuauggucgccuggggaaaggaggccguggacaauuuccaccugggcgaugacauggacccugaacuccggucucuggcucaaauucugaucgaucagaaaguuaaggagauuagcaaccaggagcccaugaaacucuga

SEQ ID NO: 7255 - RNA, 1290 nt, Artificial Sequence
  derived and/or modified CDS sequence (opt5) from SEOV(CixiRf56)__FJ803202.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugagagcccuauugccgggucucucuccggaaaccccgugaaucgcgacuauaucagacagggccagggggcccuggcuggaauggaaccuaaagaguuucaagcgcugcggcagcacgccaaggaugcuggcugcacccucguggagcauauugaaagccccuccucuaucugggucuucgccggcgccccggacagauguccucccacaugccuguuuguugggggaauggcugagcuuggcgccuucuuuagcauucugcaggauaugcgcaacaccaucauggcguccaaaacgguggggacagcugacgaaaagcuccggaagaaaagcucuuucuaccaauccuaccugagacgcacccagagcaugggaauccagcuugaucagcggauuaucgugauguuuauggucgccuggggcaaggaggccguggacaauuucccucugguucacgauauggaccccaaacucagaucucugagccaaauucugaucgaccagaaggugaacgaaauuuccaaucaggagcccaugaaacucuga

SEQ ID NO: 7256 - RNA, 1290 nt, Artificial Sequence
  derived and/or modified CDS sequence (opt5) from SEOV(CixiRn21)__FJ803205.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugagagcccuauugccgggucucucuccggaaaccccgugaaucgcgacuauaucagacagcggcagggcgcccuggcugggauggaaccuaaagaguuucaagcgcugagacagcacagcaaggaugccggaugcacccucguggagcauauugaaucccccucuagcaucugggucuucgcuggcgccccggaccgcuguccucccacaugccuguuuguuggcgggauggaugagcuuggagccuucuuuuccauucugcaggacaugcggaacaccaucauggcuagcaaaacggugggcacagccgaugaaaagcucagaaagaaaucuuccuucuaccaaagcuaccugcgccggacccagucuauggggauccagcuugaccacagaauuaucgugauguuuauggucgcguggggaaaggaggcuguggauaauuuccaccugggcgacgacauggauccugaacuccgcacacuggcccagauucugaucgaccaaaaaguuaaggagauuagcaaccaggagcccaugaaacucuga

SEQ ID NO: 7257 - RNA, 1290 nt, Artificial Sequence
  derived and/or modified CDS sequence (opt5) from SEOV(CixiRn76)__FJ803206.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcucucaaaacgcucaguccagcaugaaagccgaggaaauuacgccuggccgguuccgcaccgcugucugcgggcucuaccccgcccagaucaaggcgagaaauauggugucuccuguuauguccguggucggauuucuggcccuugcuaaagauuggacaagccggaucgaggaauggcugggcgccccguguaaguucauggcugagucucccauugccgggucccucagcggaaacccugugaaucgcgacuauaucagacagggccaaggggcccuggcuggaauggaacccaaagaguuucaggcgcugcggcagcacgccaaggaugcuggcugcacccucguggagcauauugaauccccuucuagcaucugggucuucgccggcgccagagaccgcugucccccgacaugccuguuuguugggggaauggcugagcuuggcgccuucuuuuccauucugcaagauaugcggaacaccaucauggcgagcaaaacgguggggacagcugacgaaaagcucagaaagaaaucuuccuucuaccagagcuaccugcgccggacccagucuaugggaauccagcuugaucaaagaauuaucgugauguuuauggucgccuggggcaaggaggccguggacaauuuccaccugggggaugacauggacccugaacuccgcagccuggcucagauucugaucgaucagaaaguuaaggagauuuccaaccaggagcccaugaaacucuga

SEQ ID NO: 7258 - RNA, 1290 nt, Artificial Sequence
  derived and/or modified CDS sequence (opt5) from SEOV(CUI)__GQ279395.1__N
auggccaccauggaggaacugcagagagagaucagcgcucacgaaggccaacucgugauugcccggcagaaggucaaggacgcggagaagcaguacgaaaaagaucccgacgaucugaacaagcgcgcccuucaugacagagaguccguugcugccucuauccagagcaaaauugaugagcugaagcggcaacucgcugaccgcaucgccgcugggaagaauauuggacaggauagagacccuacaggcguggaaccgggggaucaccugaaagagcgguccgcccuuucuuauggaaacacgcuggaccucaauagccuggauaucgacgaacccaccggccagacagcggauuggcugaccaucauuguguaccucacauccuucgucgugccuaucauucugaaggcccuuuauaugcugaccacacgcgggagacagaccucuaaagacaacaagggaaugcggauccgcuuuaaagacgauagcuccuacgaggacguuaauggcauuagaaagcccaagcaucucuaugugagcaugccuaacgcucaaucuuccaugaaagccgaggaaaucacgcccggccgguuccgcaccgcugucugcgggcuguacccugcccagauuaaggcgagaaauaugcuuagcccggugaugucuguugugggauuucuggcccucgcuaaagauuggacaucccggaucgaggaauggcugggcgcccccuguaaguucauggcugagagcccuaucgccgggucucuguccggaaaccccgucaaucgcgacuauauuagacagcggcagggcgcccucgcugggauggaaccuaaagaguuucaagcgcugagacagcacagcaaggaugccggaugcacccuuguggagcauaucgaaucccccucuagcauuuggguguucgcuggcgccccggaccgcuguccucccacaugccuguuugucggcgggauggccgagcucggagcuuucuuuuccauccugcaggauaugcggaacaccauuauggccagcaaaacgguuggcacagcggacaagaaacuuagaaagaagucuuccuucuaccaaagcuaccugcgccggacccagucuauggggauccagcucgaucagagaaucauugugauguuuauguucgcuuggggaaaagaagccguggacaauuuucaccugggcgaugacauggacccugagcugcgcgggcucgcccaaauccugauugaucagaaggucaaagaaaucagcaaccaggagcccaugaaacuuuga

SEQ ID NO: 7259 - RNA, 1290 nt, Artificial Sequence
  derived and/or modified CDS sequence (opt5) from SEOV(FeixianRn1)__GU592942.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugagagcccuauuaccgggucucucuccggaaaccccgugaaucgcgacuauaucagacagcggcagggcgcccuggccgggauggaaccuaaagaguuucaagcucugagacagcacgcgaaggaugccggaugcacacucguggagcauauugaaagccccuccucuaucugggucuucgcuggcgccccggaccgcuguccuccuaccugccuguuuguuggcgggauggccgagcuuggagcuuucuuuagcauucugcaggauaugcggaacacgaucauggccuccaaaacagugggcaccgcggacgaaaagcucagaaagaaaagcucuuucuaccaauccuaccugcgccggacacagagcauggggauccagcuugaucagagaauuaucgugauguuuauggucgcuuggggaaaggaggccguggacaauuuccaccugggcgaugacauggaccccgaacuccgcucucuggcccaaauucugaucgaucagaaaguuaaggagauuagcaaccaggagcccaugaaacucuga

SEQ ID NO: 7260 - RNA, 1290 nt, Artificial Sequence
  derived and/or modified CDS sequence (opt5) from SEOV(GanyuRn66)__GU592932.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucaccgcugagagcccuauugccgggucucucuccggaaaccccgugaaucgcgacuauaucagacagcggcagggcgcccuggcugggauggaaccuaaagaguuucaagcgcugagacagcacgccaaggaugcuggaugcacacucguggagcauauugaaagccccuccucuaucugggucuucgccggcgccccggaccgcuguccuccuaccugccuguuuguuggcgggauggcugagcuuggagccuucuuuagcauucugcaggauaugcggaacacgaucauggcguccaaaacagugggcaccgcugacgaaaagcucagaaagaaaagcucuuucuaccaauccuaccugcgccggacacagagcauggggauccagcuugaucagagaauuaucgugauguuuauggucgccuggggaaaggaggccguggacaauuuccaccugggcgaugacauggaccccgaacuccgcucucuggcucaaauucugaucgaucagaaaguuaaggagauuagcaaccaggagcccaugaaacucuga

SEQ ID NO: 7261 - RNA, 1290 nt, Artificial Sequence
  derived and/or modified CDS sequence (opt5) from SEOV(Gongzhuling108)__KF745947.1__N
auggccaccauggaggaaauccagagagagauuagcgcucacgaaggccaacuggugaucgcccggcagaaggucaaagacgcggagaagcaguacgaaaaagaucccgacgaucucaacaaguccgcucugcaugaccgcgagucuguugccgccagcauucaguccaaaaucgaugagcuuaagagacaacuggcugaccggauugccgcugggaagaauaucggacaggaucgcgacccuacaggcguggaaccgggggaucaccucaaagagagaucugcccugagcuauggaaacacgcuugaccucaauucccuggauaucgacgaacccaccggccagacagcggauuggcugaccauucugguguaccucacaucuuucgucgugccuaucauucugaaggcccuuuauaugcugaccacacgggggcgccagaccagcaaagacaacaagggaaugagaauccgguuuaaagacgauggcuccuacgaggacguuaauggcauucgcaagcccaagcaucucuaugugccuaugcccaacgcucaaagcucuaugaaagccgaggaaaucacgccugggagauuccggaccgcugucugcggacuguacccggcccagauuaagccccgcaauaugguguccccuguuaugagcguggucggcuuucuugcgcuggccaaagauuggacaucuagaaucgaggaauggcucggggcucccuguaaguucauggccgaguccccuaucgcuggaagccugucuggcaaccccgugaaucgggacuauauucgccagagacagggggcccuggccggaauggaaccgaaagaguuucaagcucuccggcagcacgcgaaggaugccggcugcacccugguggagcauaucgaauccccuagcuccauuagagucuucgcuggcgcccccgcccgcuguccucccacaugccuuuuuguugggggaauggcugagcugggcgccuucuuuucuauccuccaggacaugcggaacaccauuauggcgagcaaaacgguggggacagcugaugaaaagcugagaaagaaauccagcuucuaccaaucuuaccuucgccggucccagagcaugggaauccagcuggaccagagaaucauugugauguuuauggucgccucuggcaaggaggccguggauaauuuccaccucggggacgauauggaccccgaacugcgcagccugguucaaauccucauugaccagaaagugaaggagaucuccaaccaggagccuaugaaacuguga

SEQ ID NO: 7262 - RNA, 1290 nt, Artificial Sequence
  derived and/or modified CDS sequence (opt5) from SEOV(Gongzhuling147)__KF745948.1__N
auggccaccauggaggaaauccagagagagauuagcgcucacgaaggccaacuggugaucgcccggcagauugucaaggacgcggagaaacaguacgaaaaggaucccgcugaccucaacaaacgcgcccugcaugauagagaguccguugccgcuucuauccagagcaagauugacgagcuuaaacggcaccuggccgaucgcaucgcugccgggaagaauaucggacaagacagagauccuacaggcguggaaccgggggaccaucucaaggagcgguccgcgcugucuuauggaaacacgcuugaucugaauagccucgacauugaugaacccaccggccagacagccgacuggcugaccaucauuguguaccugacauccuucgucgugccuaucauucucaaagcucuguauauccuuaccacaucugggcgccagaccagcaaggauaacaaaggaaugcggauuagauuuaaggacgacuccagcuacgaggauguuaauggcauccgcaugcccaaacaccuguaugugccuaugcccaacgcccagucuuccaugaaggcugaggacaucacgccuggcagauuccggaccgccgucugcgggcucuacccggcgcaaauuaaggcccgcaauauggugagcccccugaugucuguugugggauuucuugcucugccuaaagauuggacauccagaaucgacgaauggcucggcgcccccuguaaguucauggcugagagcccuauugccgggucucuguccggaaaccccgucaaucgggaucauauccgccagagacagggcgcccuggcugggauggacccgaaagaauuucaggcggugcggcaacacgccaaggaugcuggaugcacccucguggagcacauugaaagcccuuccucuaucugggucuucgccggcgcccccgacagauguccucccacaugccuguuuguuggcgggauggcugagcuuggagccuucuuuaccauccugcaggauaugcgcaacacgauuaugcccagcaaaacagugggcaccgcggacgagaagcuccggaaaaaguccagcuucuaucagucuuaccugagacgcacacaauccauggggauccagcuugaucagcggauuaucgugauuuuuauggucgcuugggccaaggaagccguggacaauuuccaucugggagacgauauggacccugagcucagaagccuggcucagauccugaucgaucaaaaaguuaaggaaauuucuaaccaggugccgaugaaacucuga

SEQ ID NO: 7263 - RNA, 1290 nt, Artificial Sequence
  derived and/or modified CDS sequence (opt5) from SEOV(Gongzhuling415)__KF745949.1__N
auggccaccauggaggaaauccagagagagauuagcgcucacgaaggccaacuggugaucgcccggcagauggucaaggacgcggagaaacaguacgaaaaggaucucgcugaccugaacaaacgcgcccuucaugauagagaguccguugccgcuucuauucagagcaagaucgacgagcugaaacggcaacucgccgaucgcauugcugccgggaagaauaucgaacaggacagagaucccacaggaguggagccuggcgaccaccugaaggaacgguccgcgcuuucuuaugggaacacgcuggaucucaauagccuggacaucgaugagccgaccggacagacagccgacuggcugaccauuaucguguaccucacauccuucgucgugcccauuauccugaaagcucuuuauauucugaccacacgcggcagacagaccucuaaggauaacaaagggaugacgauccgguuuaaggacgacagcuccuacgaggauguuaauggcauucgcaugccuaaacaucucuaugugcccaugccuaacgcccaaagcucuaugaaggcugaagacaucacccccggaagauuccggacagccgucugcggccuguacccugcgcagaucaaggcccgcaauaugguguccccgcuuaugagcguugugggguuucuggcucuccccaaagauuggaccucuagaauugacgaguggcugggagccccuuguaaguucauggcugaaucccccaucgccggcagccugucugggaacccugucaaucgggaucacauucgccagagacagggagcccucgcuggcauggaccccaaagaguuucaagcggugcggcagcaugccaaggaugcugggugcacacugguggaacacaucgaguccccgagcuccauuugggucuucgccggagccccugacagaugucuuccuaccugccuguuuguuggcggcauggcugagcucggggccuucuuuacgauccugcaggauaugcgcaacacaaucauggcgucuaaaaccgugggaacagcugacgaaaagcugggcaaaaagagcuccuucuaucaaagcuaccuucggagaacccagucuauggggauucagcucgaucagcgcaucauugugauguuuauggucgccugggccaaggaggcuguggacaauauccaccugggagacgauauggaccccgaacugcggucccucgcccaaauucugaucgaucagaaaguuaaggagaucagcaaccaggugcccaugaaacuuuga

SEQ ID NO: 7264 - RNA, 1290 nt, Artificial Sequence
  derived and/or modified CDS sequence (opt5) from SEOV(Gongzhuling42)__KF745942.1__N
auggccaccauggaggaaauccagagagagauuagcgcucacgaaggccaacuggugaucgcccggcagaaggucaaagacgcgcagaagcaguacgagaaagaucccgacgaucucaacaagcgcgcucugcaugacagagaauccguugccgccucuauucaacuuaaaaucgaugagcugaagcggcagcucgcugaccgcauugccgcugggaagaauaucggacaggauagagacccuacaggcguggagccgggggaucaccugaaagaacggagcgcccuuuccuauggaaacacgcuggaccucaauucucuggauaucgacgagcccaccggccagacagcggauuggcugaccauuaucguguaccucaccagcuucgucgugccuauuauccugaaggcccuuuauaugcugacaacacgcgggagacaaaccuccaaagacaacaagggaaugcggauucgcuuuaaagacgauucuagcuacgaagacguuaagggcaucagaaagcccaaacaucucuaugugccuaugcccaaugcucaguccagcaugaaggccgaggagauuacgccuggccggugccgcaccgcugucugugggcuguacccggcccagaucaaagcgagaaacauggugucucccguuauguccgccgugggaauccuugcucuggccaaggauuggacaagccggauugaagaguggcucggcaccccuugcaaauucauggcugaaucucccaucgccgggucccugagcggaaauccugucaaccgcgaccacauuagacagcggcaaggcgcccuggcugggauggagcccaaggaauuucagggacucagacagcaugcgaaagaugccggcuguacacugguggagcacaucgagucuccguccagcauuuggguguucgcuggcgccccugaccgcugucccccuaccugccuuuuugucgggggaauggccgaacugggcgcuuucuuugccauccuccaagauaugcggaauacgaucauggcguccaagacaguugggaccgcugacgagaagcugcgcaaaaagucuagcuucuaucaguccuaccuuagacggacacagagcaugggcauucagcuggaucaaagaaucauugugauguuuaugguggccugggccaaagaagcugucgacaacuuccaccucggagaugacauggaccccgagcugcgcucucuggcccagauccucauggaucagaaggugaaagaaauuuccaaucaggagcccaugaagcuguga

SEQ ID NO: 7265 - RNA, 1290 nt, Artificial Sequence
  derived and/or modified CDS sequence (opt5) from SEOV(Gongzhuling45)__KF745943.1__N
auggccaccauggaggaaauccagagagagauuagcgcucacgaaggccaacuggugaucgcccggcagauggucaaggacgcggagaaacaguacgaaaaggaucccgcugaccucaacaaacgcgcccugcaugauagagaguccguugccgcuucuauucagagcaagaucgacgagcuuaaacggcaacuggccgaucgcauugcugccgggaagaauaucggacaggacagagauccuacaggcguggaaccgggggaccaccucaaggagcgguccgcgcugucuuaucgcaacacgcuugaucugaauagccucgacaucgaugaacccaccggacagacagccgacuggcugaccauuaucguguaccugacauccuucgucgugccuauuauccucaaagcucuguauauucuuaccacaagaggccggcagaccucuaaggauaacaaagggaugcgcaucagauuuaaggacgacagcuccuacgaggauguuaauggcauucggaugcccaaacaucuguaucucccuaugcccaacgcccaaagcucuaugaaggcugaggacaucacgccuggacgcuucagaaccgccgugugcggccuguacccggcgcagaucaaggcccggaauauggucagcccccuuauguccgugguuggguuucuggcucucccuaaagauuggacaucucgcauugacgaauggcugggagcccccuguaaguucauggcugaguccccuaucgccggcagccugucugggaaccccgugaauagagaucacauucggcagagacagggagcccucgcuggcauggacccgaaagaauuucaagcgguccgccagcaugccaaggaugcugggugcacccugguggagcacaucgaauccccuagcuccauuuggguguucgccggagcccccgaccgguguccucccacaugccuuuuugucggcggcauggcugagcugggggccuucuuuaccauccuccaggauaugagaaacacgaucauggcgucuaaaacaguuggaaccgcugacgagaagcugcgcaaaaagagcuccuucuaucaaagcuaccuucggagaacacagucuaugggcauucagcuggaucagcgcaucauugugauguuuaugguggccugggccaaggaagcugucgacaauuuccaccucggggacgauauggaccccgagcugcggucccuggcccaaauccucauugaucauaaagugaaggaaaucagcaaccagguuccuaugaaacuguga

SEQ ID NO: 7266 - RNA, 1290 nt, Artificial Sequence
  derived and/or modified CDS sequence (opt5) from SEOV(Gongzhuling58)__KF745944.1__N
auggccaccauggaggaaauccagagagagauuagcgcucacgaaggccaacuggugaucgcccggcagauggucaaggacgcggagaaacaguacgaaaaggaucccgcugaccucaacaaacgcgcccugcaugauagagaguccguugccgcuucuauucagagcaagaucgacgagcuuaaacggcaacuggccgaucgcauugcugccgggaagaauaucggacaggacagagauccuacaggcguggaaccgggggaccaccucaaggagcgguccgcgcugucuuauggaaacacgcuugaucugaauagccucgacaucgaugaacccaccggccagacagccgacuggcugaccauuaucguguaccugacauccuucgucgugccuauuauccucaaagcucuguauauucuuaccacacgcgggagacagaccucuaaggauaacaaaggaaugcggauccgcuuuaaggacgacagcuccuacgaggauguuaauggcauuagaaugcccaaacaucuguaugugccuaugcccaacgcccaaagcucuaugaaggcugaggacaucacgccuggccgguuccgcaccgccgucugcgggcucuacccggcgcagaucaaggccagaaauauggugagcccccugauguccguugugggauuucuugcucugccuaaagauuggacaucucggauugacgaauggcucggcgcccccuguaaguucauggcugaguccccuaucgccgggagccugucuggaaaccccgucaaucgcgaucacauuagacagcggcagggcgcccuggcugggauggacccgaaagaauuucaagcggugagacagcaugccaaggaugcuggaugcacccucguggagcacaucgaauccccuagcuccauuugggucuucgccggcgcccccgaccgcuguccucccacaugccuguuuguuggcgggauggcugagcuuggagccuucuuuaccauccugcaggauaugcggaacacgaucauggcgucuaaaacagugggcaccgcugacgagaagcuccgcaaaaagagcuccuucuaucaaagcuaccugagacggacacagucuauggggauucagcuugaucagagaaucauugugauguuuauggucgccugggccaaggaagcuguggacaauuuccaccugggagacgauauggaccccgagcuccgcucccuggcccaaauccugauugaucagaaaguuaaggaaaucagcaaccaggugccuaugaaacucuga

SEQ ID NO: 7267 - RNA, 1290 nt, Artificial Sequence
  derived and/or modified CDS sequence (opt5) from SEOV(Gongzhuling85)__KF745945.1__N
auggccaccauggaggaaauccagagagagauuagcgcucacgaaggccaacuggugaucgcccggcagauggucaaggacgcggagaaacaguacgaaaaggaucccgcugaccucauuaaacgcgcccugcaugauagagaguccguugccgcuucuauccagagcaagauugacgagcuuaaacggcaacuggccgaucgcaucgcugccgggaagaacaucggacaggacagagauccuacaggccucgaaccgggggaccaccugaaggagcgguccgcgcuuucuuauggaaauacgcuggaucucaacagccuggacauugaugaacccaccggccagacagccgacuggcugaccgugaucguguaccucacauccuucgucgugccuauuauccugaaagcucuuuauauucugaccacacgcgggagacagaccucuaaggauaauaaaggaaugcggauccgcuuuaaggacguuagcuccuacgaggacgugaacggcauuagaaugcccaaacaucucuaugucccuaugcccaaugcccaaagcucuaugaaggcugaggauaucacgccuggccgguuccgcaccgccgugugcgggcuguacccggcgcagaucaaggccagaaacaugguuagcccccuuauguccguggucggauuucuggcucucccuaaagacuggacaucucggauugaugaauggcugggcgcccccuguaaguucauggcugaguccccuaucgccgggagccugucuggaaaucccgugaaccgcgaccacauuagacagcggcagggcgcccucgcugggauggauccgaaagaauuucaagcggugagacagcaugccaaggacgcuggaugcacccuggucgagcacaucgaauccccuagcuccauuuggguuuucgccggcgcccccgaucgcuguccucccacaugccuuuuugugcggggcauggcugagcugggggccuucuuuaccauccuccaggacaugagaaauacgaucauggcgucuaaaacagugggaaccgcugaugagaagcugcgcaaaaagagcuccuucuaucaaagcuaccuucggagaacacagucuaugggcauucagcuggaccagcgcaucauugucauguuuaugguggccugggccaaggaagcuguugauaacuuccaccucggggacgacaugcaucccgagcugcggucccuggcccaaauccucauugaucagaaagugaaggaaaucagcaaucaggucccuaugaaacuguga

SEQ ID NO: 7268 - RNA, 1290 nt, Artificial Sequence
  derived and/or modified CDS sequence (opt5) from SEOV(Gongzhuling97)__KF745946.1__N
auggccaccauggaggaaauccagagagagauuagcgcucacgaaggccaacuggugaucgcccggcagauggucaaggacgcggagaaacaguacgaaaaggaucccgcugaccucaacaaacgcgcccugcaugauagagaguccguugccgcuucuauucagagcaagaucgacgaucuuaaacggcaacuggccgaccgcauugcugccgggaagaauaucggacaggauagagacccuacaggcguggagccgggggaucaccucaaggaacgguccgcgcugucuuauggaaacacgcuugaccugaauagccucgauaucgacgagcccaccggccagacagccgauuggcugaccauuaucguguaccugacauccuucgucgugccuauuauccucaaagcucuguauaugcuuaccacacgcgggagacagaccucuaaggacaacaaaggaaugcggauucgcuuuaaggacgauagcuccuacgaagacguuaauggcaucagaaugcccaaacaucuguaugugcggaugccuaacgcccaaagcucuaugaaggcugaggauauuacgcccggccgcuucagaaccgccgucugcgggcucuacccugcgcagaucaaggcccggaauaugguguccccgcugaugagcguugugggauuucuugcucugcccaaagacuggacaucucgcaucgaugaguggcucggcgccccuuguaaguucauggcugaaucccccauugccgggagccugucuggaaacccugucaauagagaccacauccggcagagacagggcgcccuggcugggauggaucccaaagaguuucaagcggugcgccagcaugccaaggacgcuggaugcacccucguggaacacauugaguccccgagcuccaucugggucuucgccggcgccccugaucggugucccccuacaugccuguuuguuggcgggauggcugaacuuggagccuucuuuaccauucugcaggacaugagaaucacgaucauggcgucuaaaacagugggcaccgcugaugagaagcuccgcaaaaagagcuccuucuaucaaagcuaccugcggagaacacagucuauggggauucagcuugaccagcgccugaucgugauguuuauggucgccugggccaaggaggcuguggacaacuuccaccucggagaugacauggaucccgaacugcggucccuggcccaaauucucaucgaccagaaaguuaagcagauuagcaaucaggugcccaugaaacuguga

SEQ ID NO: 7269 - RNA, 1290 nt, Artificial Sequence
  derived and/or modified CDS sequence (opt5) from SEOV(Gou3)__AB027522.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggcagcuuccggaccgcugucugcgggcucuacccugccacaaucaaggcgcgcaauauggugucuccgguuauguccguggucggauuucuggcccuugcuaaagauuggaccagcagaaucgaggacuggcugggcgcccccuguaaguucauggcugaaucuccuauugccgggucccucagcggaaaccccgugaaucgggauuauauccgccagagacagggcgcccuggcugggauggagccuaaagaauuucaggcgcugcggcaacacuccaaggacgccggaugcacaaugguggagcagauugagucucccagcuccaucugggucuucgcuggcgccccggauagauguccuccuaccugccucuuuguuggcgggauggccgaacugggagcuuucuuuagcauucuucaggacaugcgcaacacgaucauggccucuaaaacagugggcaccgcggaugagaagcugcggaagaaauccagcuucuaccaaucuuaccucagacgcacacagagcauggggauccagcuggaccagcggauuaucgugauguuuauggucgcuuggggaaaggaagccguggauaauuuccaucuuggcgacgacauggaucccgagcugagaucccucgcccaaauucugaucgaccagaaaguuaaggaaauuucuaaccaggagcccaugaaacuguga

SEQ ID NO: 7270 - RNA, 1290 nt, Artificial Sequence
  derived and/or modified CDS sequence (opt5) from SEOV(Hb8610)__AF288643.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaaguccaucggacaggauagagacccuacaggcguggaaccgggggaucaccucaaagagcggucugcccugagcuauggaaauacgcuugaccugaacucccucgauaucgacgaacccaccggccagacagcggauuggcugaccauuaucguguaccugacaucuuucgucgugccuauuauccucaaggcccuguauaugcuuaccacacgcgggagacagaccagcaaagacaauaagggaaugcggauucgcuuuaaagacgauuccagcuacgaggacguuaacggcaucagaaagcccaagcaucuguaugugucuaugccuaaugcucaauccagcaugaaagccgaggaaauuacgcccggccgguuccgcaccgcugucugcgggcucuacccugcccagaucaaggcgagaaacauggugucuccgguuauguccguggucggauuucuggcccuugcuaaagauuggacaagccggaucgaggaauggcugggcgcccccuguaaguucauggcugagucuccuauugccgggucccucagcggaaaucccgugaaccgcgacuauaucagacagcggcagggcgcccuggcugggauggaaccuaaagaguuucaagcgcugagacagcacgccaaggaugcuggaugcacccucguggagcauauugaaucccccucuagcaucugggucuucgccggcgccccggaccgcuguccucccacaugccuguuuguuggcgggauggcugagcuuggagccuucuuuuccauucugcaggauaugcggaauaccaucauggcgagcaaaacggugggcacagcugacgaaaagcucagaaagaaaucuuccuucuaccaaagcuaccugcgccggacccagucuauggggauccagcuugaucagagaauuaucgugauguuuauggucgccuggggaaagaaagccguggacaacuuccaccugggcgaugacauggacccugagcuccgcagccuggcucaaauucugaucgaucagaagguuaaagaaauuuccaaucaggagcccaugaagcucuga

SEQ ID NO: 7271 - RNA, 1290 nt, Artificial Sequence
  derived and/or modified CDS sequence (opt5) from SEOV(HuBJ16)__GQ279380.1__N
auggccaccauggaggaaauccagagagagauuagcgcucacgaaggccaacuggugaucgcccggcagaaggucaaaaacgcggagaagcaguacgaaaaagaccccgaugaccucaauaagcgcgcucugcaugauagagaguccguugccgccucuauucagagcaaaaucgacgagcuuaagcggcaacuggcugaucgcauugccgcugggaagaacaucggacaggacagagauccuacaggcguggaaccgggggaccaccucaaagagcgguccgcccugucuuauggaaauacgcuugaucugaacagccucgacaucgaugaacccaccggccagacagcggacuggcugaccauuaucguguaccugacauccuucgucgugccuauuauccucaaggcccuguauaugcuuaccacacgcgggagacagaccucuaaagauaauaagggaaugcggauucgcuuuaaagacgacagcuccuacgaggauguuaacggcaucagaaagcccaagcaucuguaugugagcaugccuaaugcucaaucuuccaugaaagccgaggaaauuacgcccggccgguuccgcaccgcugucugcgggcucuacccugcccagaucaaggcgagaaacauggugagcccgguuaugucuguggucggauuucuggcccuugcuaaagacuggacaucccggaucgaggaauggcugggcgcccccuguaaguucauggcugagagcccuauugccgggucucucuccggaacccccgugaaucgcgauuauaucagacagcggcagggcgcccuggcugggauggaaccuaaagaguuucaagcgcugagacagcacgccaaggacgcuggaugcacacucguggagcauauugaaagccccuccucuaucugggucuucgccggcgccccggaucgcuguccuccuaccugccuguuuguuggcgggauggcugagcuuggagccuucuuuagcauucugcaggacaugcggaacacgaucauggcguccaaaacagugggcaccgcugaugaaaagcucagaaagaaaagcucuuucuaccaauccuaccugcgccggacacagagcauggggauccagcuugaccagagaauuaucgugauguuuauggucgccuggggaaaggaggccguggauaauuuccaccugggcgacgauauggaccccgaacuccgcucucuggcucaaauucugaucgaccagaaaguuaaggagauuagcaaccaggagcccaugaaacucuga

SEQ ID NO: 7272 - RNA, 1290 nt, Artificial Sequence
  derived and/or modified CDS sequence (opt5) from SEOV(HuBJ22)__GQ279379.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugagagcccuauugccgggucucucuccggaacccccgugaaccgcgacuauaucagacagcggcagggcgcccuggcugggauggaaccuaaagaguuucaagcgcugagacagcacgccaaggaugcuggaugcacacucguggagcauauugaaagccccuccucuaucugggucuucgccggcgccccggaccgcuguccuccuaccugccuguuuguuggcgggauggcugagcuuggagccuucuuuagcauucugcaggauaugcggaauacgaucauggcguccaaaacagugggcaccgcugacgaaaagcucagaaagaaaagcucuuucuaccaauccuaccugcgccggacacagagcauggggauccagcuugaucagagaauuaucgugauguuuauggucgccuggggaaaggaggccguggacaacuuccaccugggcgaugacauggaccccgaacuccgcucucuggcucaaauucugaucgaucagaaaguuaaggagauuagcaaucaggagcccaugaaacucuga

SEQ ID NO: 7273 - RNA, 1290 nt, Artificial Sequence
  derived and/or modified CDS sequence (opt5) from SEOV(HuBJ3)__GQ279391.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaaguuaacaagggaaugcggauucgcuuuaaagacgacagcuccuacgaggaugugaauggcaucagaaagcccaagcaucuguaugucagcaugccuaacgcucaaucuuccaugaaagccgaggaaauuacgcccggccgguuccgcaccgcugugugcgggcucuacccugcccagaucaaggcgagaaauaugguuagcccggugaugucugucgugggauuucuggcccuugcuaaagacuggacaucccggaucgaggaauggcugggcgcccccugucgcuucauggcugagagcccuauugccgggucucucuccggaaaccccgugaauagagauuauauccggcagagacagggcgcccuggcugggauggaaccuaaggaguuucaagcgcugcgccagcacgccaaagacgcuggaugcacccucgucgagcauauugaaagccccuccucuaucuggguuuucgccggcgccccggagggcuguccucccacaugccuguuugucgggggaauggcugaacuuggcgccuucuuuagcauucugcaggauaugcggaacaccaucauggcguccaagacgguggggacagcugacgagaaacucagaaagaaaagcucuuucuaccaauccuaccugcgccggacccagagcaugggaauccagcuugaucagagaauuaucgugauguuuaugguggccuggggcaaggaagccguugacaauuuccaccugggggaugacauggauccugagcuccgcucucuggcucaaauucugaucgaccagaaggugaaagagauuagcaaccaggaacccaugaagcucuga

SEQ ID NO: 7274 - RNA, 1290 nt, Artificial Sequence
  derived and/or modified CDS sequence (opt5) from SEOV(K24-e7)__AF288653.1__N
auggccaccauggaggaaauccagagagagauuagcgcucacgaaggccaacuggugaucgcccggcagaaggucaaagacgcggagaagcaguacgaaaaagaucccgacgauuucaacaagcgcgcucuccaugacagagaguccguugccgccucuauucagagcaaaaucgaugagcugaagcggcaacuugcugaccgcauugccgcugggaagaauaucggacaggauagagacccuacaggcguggaaccgggggaucaccugaaagagcgguccgcccucucuuauggaaacacgcuggaccuuaauagccuggauaucgacgaacccaccggccagacagcggauuggcucaccauuaucguguaccugacauccuuugucgugccuauuauccugaaggcccucuauaugcugaccacacgcgggagacagaccucuaaagacaacaagggaaugcggauucgcuucaaagacgauagcuccuacgaggacguuaauggcaucagaaagcccaagcaucuuuaugugagcaugccuaacgcucaaucuuccaugaaagccgaggaaauuacgcccggccgguuucgcaccgcugucugcgggcuguacccugcccagaucaaggcgagaaauauggugagcccgguuaugucuguggucggauuccucgcccuggcuaaagauuggacaucccggaucgaggaauggcuuggcgcccccuguaaguuuauggcugagagcccuauugccgggucucuguccggaaaccccgugaaucgcgacuauaucagacagcggcagggcgcccucgcugggauggaaccuaaagaguuccaagcgcugagacagcacgccaaggaugcuggaugcacccugguggagcauauugaaagccccuccucuaucugggucuuugccggcgccccggaccgcuguccucccacaugccucuucguuggcgggauggcugagcugggagccuuuuucagcauucuucaggauaugcggaacaccaucauggcguccaaaacggugggcacagcugacgaaaagcugagaaagaaaagcucuuuuuaccaauccuaccuccgccggacccagagcauggggauccagcuggaucagagaauuaucgugauguucauggucgccuggggaaaggaggccguggacaauuuucaccuuggcgaugacauggacccugaacugcgcucucucgcucaaauucugaucgaucagaaaguuaaggagauuagcaaccaggagcccaugaaacuguga

SEQ ID NO: 7275 - RNA, 1290 nt, Artificial Sequence
  derived and/or modified CDS sequence (opt5) from SEOV(K24-v2)__AF288655.1__N
auggccaccauggaggaaauccagagagagauuagcgcucacgaaggccaacuggugaucgcccggcagaaggucaaagacgcggagaagcaguacgaaaaagaucccgacgauuucaacaagcgcgcucuccaugacagagaguccguugccgccucuauucagagcaaaaucgaugagcugaagcggcaacuugcugaccgcauugccgcugggaagaauaucggacaggauagagacccuacaggcguggaaccgggggaucaccugaaagagcgguccgcccucucuuauggaaacacgcuggaccuuaauagccuggauaucgacgaacccaccggccagacagcggauuggcucaccauuaucguguaccugacauccuuugucgugccuauuauccugaaggcccucuauaugcugaccacacgcgggagacagaccucuaaagacaacaagggaaugcggauucgcuucaaagacgauagcuccuacgaggacguuaauggcaucagaaagcccaagcaucuuuaugugagcaugccuaacgcucaaucuuccaugaaagccgaggaaauuacgcccggccgguuucgcaccgcugucugcgggcuguacccugcccagaucaaggcgagaaauauggugagcccgguuaugucuguggucggauuccucgcccuggcuaaagauuggacaucccggaucgaggaauggcuuggcgcccccuguaaguuuauggcugagagcccuauugccgggucucuguccggaaaccccgugaaucgcgacuauaucagacagcggcagggcgcccucgcugggauggaaccuaaagaguuccaagcgcugagacagcacgccaaggaugcuggaugcacccugguggagcauauugaaagccccuccucuaucugggucuuugccggcgccccggaccgcuguccucccacaugccucuucguuggcgggauggcugagcugggagccuuuuucagcauucuucaggauaugcggaacaccaucauggcguccaaaacggugggcacagcugacgaaaagcugagaaagaaaagcucuuuuuaccaauccuaccuccgccacacccagagcauggggauccagcuggaucagcggauuaucgugauguucauggucgccuggggaaaggaggccguggacaauuuucaccuuggcgaugacauggacccugaacugagaucucucgcucaaauucugaucgaucagaaaguuaaggagauuagcaaccaggagcccaugaaacuguga

SEQ ID NO: 7276 - RNA, 1290 nt, Artificial Sequence
  derived and/or modified CDS sequence (opt5) from SEOV(OuhaiRf35)__FJ803208.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugagagcccuauugccgggucucucuccggaaaccccgugaaucgcgacuauaucagacagcggcagggcgcccuggcugggauggaaccuaaagaguuucaagcgcugagacagcacgccaaggaugcuggaugcacccucguggagcauauugaaagccccuccucuaucugggucuucgccggcgcccgcgaccgguguccgccuacaugccuguuuguuggcgggauggcugagcuuggagccuucuuuagcauucugcaggauaugagaaacaccaucauggcguccaaaacggugggcacagcugacgaaaagcuccgcaagaaaagcucuuucuaccaauccuaccugcggagaacccagagcauggggauccagcuugaucagcgcauuaucgugauguuuauggucgccuggggaaaggaggccguggacaauuuccaccugggcgaugacauggaccccgaacuccggucucuggcucaaauucugaucgaucagaaaguuaaggagauuagcaaccaggagccuaugaaacucuga

SEQ ID NO: 7277 - RNA, 1290 nt, Artificial Sequence
  derived and/or modified CDS sequence (opt5) from SEOV(OuhaiRn146)__FJ803210.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugagagcccuauugccgggucucucuccggaaaccccgugaaucgcgacuauaucagacagggccagggggcccuggcuggaauggaaccuaaagaguuucaagcgcugcggcagcacgccaaggaugcuggcugcacccucguggagcauauugaaagccccuccucuaucugggucuucgccggcgccagagaccgcuguccgccuacaugccuguuuguugggggaauggcugagcuuggcgccuucuuuagcauucugcaggauaugcggaacaccaucauggcguccaaaacgguggggacagcugacgaaaagcucagaaagaaaagcucuuucuaccaauccuaccugcgccggacccagagcaugggaauccagcuugaucagagaauuaucgugauguuuauggucgccuggggcaaggaggccguggacaauuuccaccugggggaugacauggaccccgaacuccgcucucuggcucaaauucugaucgaucagaaaguuaaggagauuagcaaccaggagccuaugaaacucuga

SEQ ID NO: 7278 - RNA, 1290 nt, Artificial Sequence
  derived and/or modified CDS sequence (opt5) from SEOV(Pf26)__AY006465.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucugugcagagcaaaauugaugagcuuaagcggcaacuggcugaccgcaucgccgcugggaagaauauuggacaggauagagacccuacaggcguggaaccgggggaucaccucaaagagcgguccgcccugucuuauggaaacacgcuugaccugaauagccucgauaucgacgaacccaccggccagacagcggauuggcugaccaucauugucuaccugacauccuucgugguuccuaucauucucaaggcccuguauaugcuuaccacacgcgggagacagaccucuaaagacaacaagggaaugcggauccgcuuuaaagacgauagcuccuacgaggacgugaauggcauuagaaagcccaagcaucuguaugucagcaugccuaacgcucaaucuuccaugaaagccgaggaaaucacgcccggccgguuccgcaccgcugugugcgggcucuacccugcccagauuaagccgagaaauaugguuagccccgugaucucugucgugggauuucuggcgcuugccaaagauuggacaucccggaucgaggaauggcugggcgcuccuuguaaguucauggccgagagccccauugcugggucucucuccggaaacccugugaaucgcgacuauaucagacagcggcagggcgcccuggccgggauggaacccaaagaguuucaagcucugagacagcacgcgaaggaugccggaugcacccucgucgagcauauugaaagcccguccucuaucuggguuuucgcuggcgccccugaccgcugucccccuacaugccuguuugugggcgggauggccgagcuuggagcuuucuuuagcauucugcaggauaugcggaacaccaucauggccuccaaaacggugggcacagcggacgaaaagcucagaaagaaaagcucuuucuaccaauccuaccugcgccggacccagagcauggggauccagcuugaucagagaauuaucgucauguuuaugguggcuuggggaaaggaggccguugacaauuuccaccugggcgaugacauggaccccgaacuccgcucucuggcccaaauucugaucgaucagaaagugaaggagauuagcaaccaggagcccaugaaacucuga

SEQ ID NO: 7279 - RNA, 1290 nt, Artificial Sequence
  derived and/or modified CDS sequence (opt5) from SEOV(Rn-CP7)__GQ279382.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaagcauggugucuccgguuauguccguggucggauuucuggcccuugcuaaagauuggacaagccggaucgaggaauggcugggcgcccccuguaaguucauggcugagucuccuauugccgggucccucagcggaaaucccgugaaccgcgacuauaucagacagcggcagggcgcccuggcugggauggaaccuaaagaguuucaagcgcugagacagcacgccaaggaugcuggaugcacccucguggagcauauugaaucccccucuagcaucugggucuucgccggcgccccggaccgcuguccucccacaugccuguuuguuggcgggauggcugagcuuggagccuucuuuuccauucugcaggauaugcggaauaccaucauggcgagcaaaacggugggcacagcugacgaaaagcucagaaagaaaucuuccuucuaccaaagcuaccugcgccggacccagucuauggggauccagcuugaucagagaauuaucgugauguuuauggucgccuggggaaaggaggccguggacaacuuccaccugggcgaugacauggacccugaacuccgcagccuggcucaaauucugaucgaucagaaaguuaaggagauuuccaaucaggagcccaugaaacucuga

SEQ ID NO: 7280 - RNA, 1290 nt, Artificial Sequence
  derived and/or modified CDS sequence (opt5) from SEOV(Rn-DC8)__GQ279386.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccgcucgcgggagacagacaucuaaagacaacaagggaaugcggauucgcuuuaaagacgauagcuccuacgaggacguuaauggcaucagaaagcccaagcaucuguaugugagcaugccuaacgcccaaucuuccaugaaagcugaggaaauuacccccggccgguuccgcacggccgucugcgggcucuacccugcgcagaucaaggccagaagcauggugucuccgguuauguccguggucggauuucuggcucuugccaaagauuggaccagccggaucgaggaauggcugggcgcucccuguaaguucauggccgagucuccuauugccgggucccucagcggaaaucccgugaaccgcgacuauaucagacagcggcagggcgcucuggcggggauggaaccuaaagaguuucaagcccugagacagcacgcuaaggaugccggaugcacacucguggagcauauugaaucccccucuagcaucugggucuucgccggcgcuccggaccgcuguccuccuaccugccuguuuguuggcgggauggccgagcuuggagcguucuuuuccauucugcaggauaugcggaauacaaucauggcuagcaaaaccgugggcacggccgacgaaaagcucagaaagaaaucuuccuucuaccaaagcuaccugcgccggacacagucuauggggauccagcuugaucagagaauuaucgugauguuuauggucgccuggggaaaggaggcuguggacaacuuccaccugggcgaugacauggaccccgaacuccgcagccuggcccaaauucugaucgaucagaaaguuaaggagauuuccaaucaggagcccaugaaacucuga

SEQ ID NO: 7281 - RNA, 1290 nt, Artificial Sequence
  derived and/or modified CDS sequence (opt5) from SEOV(Rn-M11)__GQ279383.1__N
auggccaccauggaggaaauccagagagagauuagcgcucacgaaggccaacuggugaucgcccggcagaaggucaaaaacgcggagaagcaguacgaaaaagaccccgaugaccucaauaagcgcgcucugcaugauagagaguccguugccgccucuauucagagcaaaaucgacgagcuuaagcggcaacuggcugaucgcauugccgcugggaagaacaucggacaggacagagauccuacaggcguggaaccgggggaccaccucaaagagcgguccgcccugucuuauggaaauacgcuugaucugaacagccucgacaucgaugaacccaccggccagacagcggacuggcugaccauuaucguguaccugacauccuucgucgugccuauuauccucaaggcccuguauaugcuuaccacacgcgggagacagaccucuaaagauaauaagggaaugcggauucgcuuuaaagacgacagcuccuacgaggauguuaacggcaucagaaagcccaagcaucuguaugugagcaugccuaaugcucaaucuuccaugaaagccgaggaaauuacgcccggccgguuccgcaccgcugucugcgggcucuacccugcccagaucaaggcgagaagcauggugucuccgguuauguccguggucggauuucuggcccuugcuaaagacuggacaagccggaucgaggaauggcugggcgcccccuguaaguucauggcugagucuccuauugccgggucccucagcggaaaccccgugaaucgcgauuauaucagacagcggagaggcgcccuggcugggauggaaccuaaagaguuucaggcgcugcgccaacacgccaaggacgcuggaugcacccucguggagcauauugaaucccccucuagcaucugggucuucgccggcgccccggaucgguguccucccacaugccuguuuguuggcgggauggcugagcuuggagccuucuuuuccauucugcaggacaugagaaacaccaucauggcgagcaaaacggugggcacagcugaugaaaagcuccgcaagaaaucuuccuucuaccagagcuaccugcggagaacccaaucuauggggauccagcuugaccagcgcauuaucgugauguuuauggucgccuggggaaaggaggccguggauaauuuccaccugggcgacgauauggacccugaacuccggagccuggcucagauucugaucgaccaaaaaguuaaggagauuuccaaccaggagcccaugaaacucuga

SEQ ID NO: 7282 - RNA, 1290 nt, Artificial Sequence
  derived and/or modified CDS sequence (opt5) from SEOV(RuianRf74)__FJ803213.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcauggcugucugcgggcucuacccugcccagaucaaggcgagaaauauggugagcccgguuaugucuguggucggauuucuggcccuugcuaaagauuggaccucccggaucgaggaauggcugggcgcccccuguaaguucauggcugagagcccuauugccgggucucucuccggaaaccccgugaaucgcgacuauaucagacagcggcagggcgcccuggcugggauggaaccuaaagaguuucaagcgcugagacagcacgccaaggaugcuggaugcacacucguggagcauauugaaagccccuccucuaucugggucuucgccggcgccccggaccgcuguccuccuaccugccuguuuguuggcgggauggcugagcuuggagccuucuuuagcauucugcaggauaugcggaacacaaucauggcguccaaaaccgugggcacggcugacgaaaagcucagaaagaaaagcucuuucuaccaauccuaccugcgccggacacagagcauggggauccagcuugaucagagaauuaucgugauguuuauggucgccuggggaaaggaggccguggacaauuuccaccugggcgaugacauugaccccgaacuccgcucucuggcucaaauccugauugaucagaaaguuaaggagaucagcaaccaggagcccaugaaacucuga

SEQ ID NO: 7283 - RNA, 1290 nt, Artificial Sequence
  derived and/or modified CDS sequence (opt5) from SEOV(RuianRn23)__FJ803214.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugagagcccuauugccgggucucucuccggaaaccccgugaaucgcgacuauaucagacagcggcagggcgcccuggcugggauggaaccuaaagaguuucaagcgcugagacagcacgccaaggaugcuggaugcacccucguggagcauauugaaagccccuccucuaucugggucuucgccggcgccccggaccgcuguccucccacaugccuguuuguuggcgggauggcugagcuuggagccuucuuuagcauucugcaggauaugcggaacaccaucaaagcguccaagacggugggcacagcugacgaaaagcuccgcaaaaagagcucuuucuaccaauccuaccugagacggacccagagcauggggauccagcuugaucagagaauuaucgugauguuuauggucgccuggggaaaagaggccguggacaauuuccaccugggcgaugacauggacccugaacuccgcucucuggcucaaauucugaucgaucagaagguuaaagagauuagcaaccaggagcccaugaagcucuga

SEQ ID NO: 7284 - RNA, 1290 nt, Artificial Sequence
  derived and/or modified CDS sequence (opt5) from SEOV(RuianRn33)__FJ803215.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugagagcccuauugccgggucucucuccggaaaccccgugaaucgcgacuauaucagacagcggcagggcgcccuggcugggauggaaccuaaagaguuucaagcgcugagacagcacgccaaggaugcuggaugcacccucguggagcauauugaaagccccuccucuaucugggucuucgccggcgccccggaccgcuguccucccacaugccuguuuguuggcgggauggcugagcuuggagccuucuuuagcauucugcaggauaugcggaacaccaucauggcguccaaaacggugggcacagcugacgaaaagcucagaaagaaaagcucuuucuaccaauccuaccugcgccggacccagagcauggggauccagcuugaucagagaauuaucgugauguuuauggucgcccgcggaaaggaggccauguauaaucugcaccuccgggacgauaugacaccucaacugcugcuccuggugcagauucuucuggaccaccagguuaaagaaaucucuaaccaggagcucaugaagcuguga

SEQ ID NO: 7285 - RNA, 1290 nt, Artificial Sequence
  derived and/or modified CDS sequence (opt5) from SEOV(SC106)__GU361893.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugccuaugcccaacgcucaaagcucuaugaaagccgaggaaauuacgccuggccgguuccgcaccgcugucugcgggcucuacccggcccagaucaaggcgagaaauauggugucccccguuaugagcguggucggauuucuggcccuugcuaaagauuggacaucucggaucgaggaauggcugggcgccccuuguaaguucauggcugagucccccauugccgggagccucucuggaaacccugugaaucgcgacuauaucagacagcggcagggcgcccuggcugggauggaacccaaagaguuucaagcgcugagacagcacgccaaggaugcuggaugcacccucguggagcauauugaauccccgagcuccaucugggucuucgccggcgccccugaccgcugucccccuacaugccuguuuguuggcgggauggcugagcuuggagccuucuuuucuauucugcaggauaugcggaacaccaucauggcgagcaaaacggugggcacagcugacgaaaagcucagaaagaaauccagcuucuaccaaucuuaccugcgccggacccaguccauggggauccagcuugaucagagaauuaucgugauguuuauggucgccuggggaaaggaggccguggacaauuuccaccugggcgaugacauggaccccgaacuccgcagccuggcucaaauucugaucgaucagaaaguuaaggagauuucuaaccaggagcccaugaaacucuga

SEQ ID NO: 7286 - RNA, 1290 nt, Artificial Sequence
  derived and/or modified CDS sequence (opt5) from SEOV(SEO/Belgium/Rn895/2005)__JQ898106.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugacagcccuauugccgggucucucuccggaaaccccgugaaucgcgauuauaucagacagcggcagggcgcccuggcugggauggagccuaaagaauuucaagcgcugagacagcacagcaaggacgccggaugcacccucguggagcauauugagucccccucuagcaucugggucuucgcuggcgccccggaucgcuguccucccacaugccuguuuguuggcgggauggccgaacuuggagcuuucuuuuccauucugcaggacaugcggaacaccaucauggccagcaaaacggugggcacagcggaugagaagcucagaaagaaaucuuccuucuaccaaagcuaccugcgccggacccagucuauggggauccagcuugaccagagaauuaucgugauguuuauggucgcuuggggaaaggaagccguggauaauuuccaccugggcgacgacauggauccugagcuccgcagccuggcccaaauucugaucgaccagaaaguuaaggaaauuuccaaccaggagcccaugaaacucuga

SEQ ID NO: 7287 - RNA, 1290 nt, Artificial Sequence
  derived and/or modified CDS sequence (opt5) from SEOV(Taonan420)__KF745951.1__N
auggccaccauggaggaaauccagagagagauuagcgcucacgaaggccaacuggugaucgcccggcagaacgucaaggacgcggagaaacaguacgaaaaggaucccgacgaucucaauaaacgcgcucugcaugacagagaguccguugccgccucuauucagagcaagaucgaugagcuuaaacggcaaccugcugaccgcauugccgcugggaagaacaucggacaggauagagacccgacaggcguggaacccggggaucaccugaaggagcgguccgcccucucuuauggaaauacgcuggaccuuaaccgccuggauaucgacgaaccuaccggccagagagcggauuggcucacaauuaucguguaccugaccagcuucgucgugcggauuauccugaaagcccucuauauguuuuccacacgcgggagacagaccucuaaggacaauaaaggacugcggauucgcuucaaggacgauagcuccuacgaggacuuuaacggcaucagaaaacccaagcaucuuuauguuccuaugcccaaugcucaaagcucuaugaaggccgaggaaauuacaccuggccgguuccgcaccgcugugugcgggcuguacccggcccagaucaaagcgagaaacauggucucccccgugaugagcguugugggauuucucgcccuggcuaaggauuggacgucucggaucgaggaauggcuuggcgccccuuguaaauucauggcugagucccccauugccgggagccugucuggaaauccugucaacagagacuauauccgccagcggcagggcgcccucgcugcgauggaacccaaggaguuucaagcccugagacagcacgcuaaagauccggggugcacccugguggagcauauugaauccccuagcuccaucugggugucugccggagcccccgaccgcuguccucccacaugccucuucgucggcggcauggcugagcugggggccuuuuucagcauuuuucaggauaugcggaauaccaucaugcccuccaagacaguuggaaccgcggacgaaaaacuuagaaagaaaagccuguucuaccaaucuuaccuccgccggacgcaguccaugggcauccagcuggaucagagaauuaucgugauguuuaugguggcuugggggaaggaggccgucgacaacuuccaccuuccugaugacauggacccggaacugcgcagccucgcccaaauucugaucgugcagaagguuaaagagauuucuaaucaggagcccaugaagcuguga

SEQ ID NO: 7288 - RNA, 1290 nt, Artificial Sequence
  derived and/or modified CDS sequence (opt5) from SEOV(Taonan52)__KF745950.1__N
auggccaccauggaggaaauccagagagagauuagcgcucacgaaggccaacuggugacagcccggcagaaggucaaagacgcggagaagcaguacgaaaaagaucccgacgaucucaacaagcgcgcucugcaugacagagaguccguugccgccucuauccagagcaaaauugaugaggugaagcggcaacuugcugaccgcaucgccgcugggaagaauauuggacaggauagagacccuacgggcguggaaccgggggaucaccccaaagagcgguccgcccugucuuauggaaacacccucgaccugaauagccuugauaucgacgaaccuacaggccagaccgcggauuggcugacaaucauugucuaccucaccuccuucgugguucccaucauucugaaggcccuguauaugucuacaacccgcgggagacagacgagcaaagacaaccggggaaugcgcaucagauuucaagacgauuccagcuacgaggacgugaauggcauucggaagccuaaacaucucuauguccccaugccuaacgcucagucuuccaugaaggccgaggaagugaccccgggccgcuucagaacagcuguuugcgggcuguaccccgcccagaucaaggcgcggaauauggugcgcccugucaugagcguggugggauuucuugcccuggcuaaagccuggaccucuagaauugaggaauggcucggcgcucccuguaaguucauggccgaguccccuaucgccgggagccugucuggaaaccccgucuaucgggauuacaucagacagcgccaaggcgcucuugcggggauggaaccgaaagaguuucaggcccugcggcagcacgcuaaggacgccggaugcacacucguugagcugauugaauccccuagcuccaucucuguguucgccggcgcucccgauagauguccucggaccugccuguuugugggcgggauggccgagcucggagcgaauuucagcaugcugcaagacauguccaacacgauuauggcuagcaaaacagucggcaccgccgaugaaaaacuucgcaagaagucuuccuuuuaccagagcuaucugagacgcacacagucuauggggauccagcucgaccaacggauuaucgugauguucaugguugccagcggaaaggaggcuguggauuacuuucaucugggcgacgauauggaccccgaacuuagaucccuggcccccauccucauugaccagaaagucaaggagaucucuaaucaggagccuaugaaacuguga

SEQ ID NO: 7289 - RNA, 1290 nt, Artificial Sequence
  derived and/or modified CDS sequence (opt5) from SEOV(WuhanMm24)__JQ665911.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccgccgccgcuucuauucagagcaaaaucgaugagcuuaagcggcaacuggccgaccgcauugcugccgggaagaauaucggacaggauagagacccuacaggcguugaaccgggggaucaccucaaagagcgguccgcgcugucuuauggaaacacgcuugaccugaauagccucgauaucgacgaacccaccggccagacagccgauuggcugaccauuaucguguaccugacauccuucguggucccuauuauccucaaggcucuguauaugcuuaccacacgcgggagacagaccucuaaagacaacaagggaaugcggauucgcuuuaaagacgauagcuccuacgaggacgugaauggcaucagaaagcccaagcaucuguauguuagcaugccuaacgcccaaucuuccaugaaagcugaggaaauuacgcccggccgguuccgcaccgccgugugcgggcucuacccugcgcagaucaaggccagaaauauggucagcccggugaugucuguugugggauuucuggcucuugccaaagauuggacaucccggaucgaggaauggcugggcgcucccuguaaguucauggccgagagcccuauugccgggucucucuccggaaaccccgucaaucgcgacuauaucagacagcggcagggcgcucuggcggggauggaaccuaaagaguuucaagcccugagacagcacagcaaggaugcuggaugcacccucguggagcauauugaaucccccucuagcaucuggguguucgccggcgccccggaccgcuguccucccacaugccuguuugucggcgggauggcuggacuuggcgccuucuuuuccauucugcaggauaugcggaacaccaucauggcgagcaaaacgguugggacagcugacgagaagcucagaaagaaaucuuccuucuaccaaagcuaccugcgccggacccagucuaugggaauccagcuugaucagagaauuaucgugauguuuaugguggccuggggcaaggaagccgucgacaauuuccaccugggggaugacauggacccugagcuccgcagccuggcucaaauucugaucgaucagaaagugaaggaaauuuccaaccaggagcccaugaaacucuga

SEQ ID NO: 7290 - RNA, 1290 nt, Artificial Sequence
  derived and/or modified CDS sequence (opt5) from SEOV(WuhanRf02)__JQ665912.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucgaggaacgguccgcccugucuuauggaaacacgcuugaccugaauagccucgauaucgacgagcccaccggccagacagcggauuggcugaccauuaucguguaccugacauccuucgucgugccuauuauccucaaagcccuguauaugcuuaccacacgcgggagacagaccucuaaggacaacaaaggaaugcggauucgcuuuaaggacgauagcuccuacgaggacguuaauggcaucagaaaacccaagcaucuguaugugagcaugccuaacgcucaaucuuccaugaaggccgaagagauuacgcccggccgguuccgcaccgcugucugcgggcucuacccugcccagaucaaagcgagagauauggugagcccgguuaugucuguggucggauuucuggcccuugcuaaggacuggacaucccggaucgaagaguggcugggcgcccccuguaaauucauggcugaaagcccuauugccgggucucucuccggaaaucccgugaaccgcgauuauaucagacagcggcagggcgcccuggcugggauggagccuaaggaguuucaagcgcugagacagcacagcaaagacgccggaugcacccucguggaacauauugagucccccucuagcaucugggucuucgcuggcgcccgcgaucgguguccgccuacaugccuguuuguuggcgggauggccgaacuuggagcuuucuuuuccauucugcaggacaugagaaauaccaucauggccagcaagacggugggcacagcggaugagaaacuccgcaagaagucuuccuucuaccaaagcuaccugcggagaacccagucuauggggauccagcuugaccagcgcauuaucgugauguuuauggucgcuuggggaaaagaagccguggauaacuuccaccugggcgacgacauggaucccgagcuccggagccuggcccaaauucugaucgaccagaagguuaaagagauuuccaaucaggaaccuaugaagcucuga

SEQ ID NO: 7291 - RNA, 1290 nt, Artificial Sequence
  derived and/or modified CDS sequence (opt5) from SEOV(WuhanRf07)__JQ665913.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugagagcccuauugccgggucucucuccggaaaccccgugaaucgcgacuauaucagacagcggcagggcgcccuggcugggauggaaccuaaagaguuucaagcgcugagacagcacagcaaggaugccggaugcacccucguggagcauauugaaucccccucuagcaucugggucuucgcuggcgcccgcgaccgguguccgccuacaugccuguuuguuggcgggauggccgagcuuggagcuuucuuuuccauucugcaggauaugagaaacaccaucauggccagcaaaacggugggcacagcggacgaaaagcuccgcaagaaaucuuccuucuaccaaagcuaccugcggagaacccagucuauggggauccagcuugaucagcgcauuaucgugauguuuauggucgcuuggggaaaggaggccguggacaauuuccaccugggcgaugacauggaccccgaacuccggagccuggcccaaauucugaucgaucagaaaguuaaggagauuuccaaccaggagccuaugaaacucuga

SEQ ID NO: 7292 - RNA, 1290 nt, Artificial Sequence
  derived and/or modified CDS sequence (opt5) from SEOV(ZJ5)__FJ753400.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugagagcccuauugccgggucucucuccggaaaccuggugaaucgcgacuauaucagacagcggcagggcgcccuggcugggauggaacccaaagaguuucaagcgcucagacagcacagcaaggaugccggaugcacccugguggagcauauugaauccccuucuagcaucugggucuucgcuggcgcccccgaccgcuguccgccuacaugccuuuuuguuggcgggauggccgagcugggagcuuucuuuuccauucuccaggauaugcggaacaccaucauggccagcaaaacggugggcacagcggacgaaaagcugagaaagaaaucuuccuucuaccaaagcuaccuucgccggacccagucuauggggauccagcuggaucagagaauuaucgugauguuuauugucgcuuggggaaaggaggccguggacaauuuccaccucggcgaugaccuggaccccgaacugcgcagccucgcccaaauccugauugaucagaaaguuaaggagaucuccaaccaggagccuaugaaacuuuga

SEQ ID NO: 7293 - RNA, 1290 nt, Artificial Sequence
  derived and/or modified CDS sequence (opt5) from SEOV(ZT10)__AY766368.1__N
auggcccugugcgaggaaauccagagagagauuagcgcucacgaaggccaacucgugaucgcccggcagaaggucaaagacgcggagaagcaguacgaaaaagaucccgacgauuucaacaagcgcgcucugcaugacagagaguccguugccgccucuauucagagcaaaaucgaugagcuuaagcggcaacuggcugaccgcauugccgcugggaagaauaucggacaggauagagacccuaccggcguggaaccgggggaucaccucaaagagcgguccgcccugucuuauggaaacacacuugaccugaauagccucgauaucgacgaacccacgggccagaccgcggauuggcugacaauuaucguguaccugaccuccuuugucgugccuauuauccucaaggcccuguauaugcuuacaacccgcgggagacagacaucuaaagacaacaagggaaugcggauucgcuucaaagacgauagcuccuacgaggacguuaauggcaucagaaagcccaagcaucuguaugugagcaugccuaacgcucaaucuuccaugaaagccgaggaaauuacccccggccgguuucgcacggcugucugugggcucuacccugcccagaucaaggcgagaaauauggugagcccgguuaugucuguggucggauuccuggcccuugcuaaagauuggaccucccggaucgaggaauggcugggcgcccccugcaaguuuauggcugagagcccuauugccgggucucucuccggaaaccccgugaaucgcgacuauaucagacagcggcagggcgcccuggcugggauggaaccuaaagaguuccaagcgcugagacagcacgccaaggaugcuggauguacacucguggagcauauugaaagccccuccucuaucugggucuuugccggcgccccggaccgcugcccucccaccugucuguucguuggcgggauggcugagcuuggagccuuuuucagcggccuggcggauaugcggaacacaauuauggcuuccaaaaccgaagggacggccgacgagaagcucagaaagaaaagcucuuuuuaccaguccuaccugcgccggcaacagagcaugggaauccagcuugaucagagaaucauugugauguucaugguggccuggggcaaggaagcugucgacaauuuucaccugggggaugacauggacccugagcuccgcucucuggcccaaauccugauugaucagaaagugaaggagaucagcaaccaggaacccaugaaacucuga

SEQ ID NO: 7294 - RNA, 1290 nt, Artificial Sequence
  derived and/or modified CDS sequence (opt5) from SEOV(ZT71)__AY750171.1__N
auggccaccauggaggaaauccagagagagauuagcgcucacgaaggccaacuggugaucgcccggcagaaggucaaagacgcggagaagcaguacgaaaaagaucccgacgauuucaacaagcgcgcucuccaugacagagaguccguugccgccucuauucagagcaaaaucgaugagcugaagcggcaacuugcugaccgcauugccgcugggaagaauaucggacaggauagagacccuacaggcguggaaccgggggaucaccugaaagagcgguccgcccucucuuauggaaacacgcuggaccuuaauagccuggauaucgacgaacccaccggccagacagcggauuggcucaccauuaucguguaccugacauccuuugucgugccuauuauccugaaggcccucuauaugcugaccacacgcgggagacagaccucuaaagacaacaagggaaugcggauucgcuucaaagacgauagcuccuacgaggacguuaauggcaucagaaagcccaagcaucuuuaugugagcaugccuaacgcucaaucuuccaugaaagccgaggaaauuacgcccggccgguuucgcaccgcugucugcgggcuguacccugcccagaucaaggcgagaaauauggugagcccgguuaugucuguggucggauuccucgcccuggcuaaagauuggacaucccggaucgaggaauggcuuggcgcccccuguaaguuuauggcugagagcccuauugccgggucucuguccggaaaccccgugaaucgcgacuauaucagacagcggcagggcgcccucgcugggauggaaccuaaagaguuccaagcgcugagacagcacgccaaggaugcuggaugcacccugguggagcauauugaaagccccuccucuaucugggucuuugccggcgccccggaccgcuguccucccacaugccucuucguuggcgggauggcugagcugggagccuuuuucagcauucuucaggauaugcggaacaccaucauggcguccaaaacggaaggcacagcugacgagaagcugagaaagaaaagcucuuuuuaccaauccuaccuccgccggcagcagagcauggggauccagcuggaucaaagaauuaucgugauguucaugguggccuggggaaaggaagccgucgacaauuuucaccuuggcgaugacauggacccugagcugcgcucucucgcucagauucugaucgaucagaaagugaaggagauuagcaaccaggaacccaugaaacuguga

SEQ ID NO: 7295 - RNA, 1290 nt, Artificial Sequence
  derived and/or modified CDS sequence (opt5) from SEOV(zy27)__AF406965.1__N
auggccaccauggaggaaauccagagagagauuagcgcucacgaaggccaacuggugaucgcccggcagaaggucaaagacgcggagaagcaguacgaaaaagaucccgacgauuccaacaagcgcgcucuccaugacagagagucuguugccgccagcauucaguccaaaaucgaugagcugaagcggcaacuugcugaccgcauugccgcugggaagaauaucggacaggauagagacccuacaggcguggaaccgggggaucaccugaaagagcggucugcccccagcuauggaaacacgcucgaccuuaauucccuugauaucgacgaaccuaccggccagacagcggauuggcugaccauuaucguguaccucacaucuuucgucgugcccauuauccugaaggcccuguauaugcucaccacacgcgggagacagaccagcaaagacaacaagggaaugcggauucgcuuuaaagacgauuccagcuacgaggacguuaauggcaucagaaagccuaagcaucuguaugugucuaugcccaacgcucaauccagcaugaaagccgaggaaauuacgccugagcgguuccgcaccgcugucugcggccuuuacccggcccagaucaaggcgagaaauauggugucucccguuauguccguggucggguuucuggcccucgcuaaagauuggacaagccggaucgaagaguggcugggagccccuuguaaguucauggcugaaucucccauugccggcucccuuagcgggaacccugugaaucgcgaccacaucagacagcggcagggagcccuggcuggcauggagcccaaagaguuucaagcgcucagacagcaugccaaggaugcugggugcacccugguggaacacauugaguccccgucuagcaucugggucuucgccggagccccugaccgcugucccccuacaugccuguuuguuggcggcauggcugaacucggggccuucuuuuccauucugcaggauaugcggaacaccaucauggcgagcaaaacggugggaacagcugacgagaagcugagaaagaaaucuuccuucuaucaaagcuaccugcgccggacccagucuaugggcauccagcucgaucagagaauuaucgugauguuuauggucgccugggggaaggaagccguggacaauuuccaccugggagaugacauggaccccgagcuucgcagccuggcucaaauucucaucgaucagaaaguuaaggagauuuccaaccaggaacccaugaaacuguga

SEQ ID NO: 7296 - RNA, 1290 nt, Artificial Sequence
  derived and/or modified CDS sequence (opt5) from SEOV(DN2)__KX289954.1__N
auggccaccauggaggaaauccagagagagauuagcgcucacgaaggccaacuggugaucgcccggcagaaggcgaaagacgcugagaagcaguacgaaaaagaucccgacgaucucaacaagcgcgcccugcaugacagaggguccgucgccgcuucuauucagagcaaaaucgaugagcuuaagcggcaacuggccgaccgcauugcugccggaaagaauaucggccaggauagagacccuacagggguugagccgggagaucaccucaaagaacgguccgcgcugucuuauggcaacacgcuugaccugaauagccucgauaucgacgagcccaccgggcagacagccgauuggcugaccauuaucguguaccugacauccuucguggucccuauuauccucaaggcucuguauaugcuuaccacacgcggaagacagaccucuaaagacaacaagggcaugcggauucgcuuuaaagacgauagcuccuacgaagacgugaauggcaucagaaagcccaagcaucuguauguuagcaugccuaacgcccaaucuuccaugaaagcugaggagauuacgcccgggcgguuccgcaccgccgugugcggacucuacccugcgcagaucaaggccagaaauauggucagcccggugaugucuguugugggcuuucuggcucuugccaaagauuggacaucccggaucgaagaguggcugggggaacccuguaaguucauggcugagagcccuauugccggaucucucuccggcaaccccgucaaucgcgacuauaucagacagcggcagggggcccuggcuggaauggaaccuaaagaguuucaagcgcugagacagcacagcaaggaugccggcugcacccucguggagcauauugaaucccccucuagcaucuggguguucgcuggcgccccggaccgcuguccucccacaugccuguuugucgggggaauggccgagcuuggcguuuucuuuuccauucugcaggauaugcggaacaccaucauggcuagcaaaacgguggggacagccgacgaaaagcucagaaagaaaucuuccuucuaccaaagcuaccugcgccggacccagucuaugggaauccagcuugaucagagaauuaucgugauguuuauggucgcguggggcaaggaggcuguggacaauuuccaccugggggaugacauggacccugaacuccgcagccuggcccaaauucugaucgaucagaaaguuaaggagauuuccaaccaggagcccaugaaacucuga

SEQ ID NO: 7297 - RNA, 1290 nt, Artificial Sequence
  derived and/or modified CDS sequence (opt5) from SEOV(IR162)__KX079476.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcuggacacccccuguaaguucaugguggagagcccuauugccggcucucucuccgggaaccccgugaaucgcgauuauaucagacagcggcagggagcucuggccggcauggaaccuaaagaguuucaagcccugagacagcacagcaaggacgcugggugcacacucgucgagcauauugaaucccccucuagcaucuggguuuucgcgggagccccggaucgcuguccuccuaccugccuguuugugggcggcauggcugagcuuggggccuucuuuuccauucugcaggacaugcggaacacgaucauggccagcaaaacagugggaaccgcugaugaaaagcucagaaagaaaucuuccuucuaccaaagcuaccugcgccggacacagucuaugggcauccagcuugaccagagaauuaucgucauguuuaugguggccugggggaaggaggcgguugauaauuuccaccugggagacgacauggaucccgaacuccgcagccuggcucaaauucugaucgaccagaaagugaaggagauuuccaaccaggagcccaugaaacucuga

SEQ ID NO: 7298 - RNA, 1290 nt, Artificial Sequence
  derived and/or modified CDS sequence (opt5) from SEOV(Gou3)__AF184988.1__N
auggccaccauggaggaaauccagagagagauuagcgcucacgaaggccaacuggugaucgcccggcgcaaggucaaagacgcggagaagcaguacgaaaaagaucccgacgaucucaacaagagagcucugcaugaccgggaguccguugccgccucuauucagagcaaaaucgaugagcuuaagcgccagcuggcugacagaauugccgcugggaagaauaucggacaagaucgggacccuacaggcguggaaccgggggaucaccucaaagagcgcuccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacaagagggcggcagaccucuaaagacaacaagggaaugcgcauuagauuuaaagacgauagcuccuacgaggacguuaauggcauccggaagcccaagcaucuguaugugagcaugccuaacgcucagucuuccaugaaagccgaggaaauuacgcccggccgcuucagaaccgcugucugcgggcucuacccugcccaaaucaaggcgcggaauauggugagcccgguuaugucuguggucggauuucuggcccuugcuaaagauuggacaucccgcaucgaggacuggcugggcgcccccuguaaguucauggcugaaagcccuauugccgggucucucuccggaaaccccgugaauagagauuauauccggcagagacagggcgcccuggcugggauggagccuaaagaauuucaggcgcugcgccaacacagcaaggacgccggaugcacccucguggagcauauugagucccccucuagcaucugggucuucgcuggcgccccggaucgguguccucccacaugccuguuuguuggcgggauggccgaacuuggagcuuucuuuuucauucugcaggacaugagaaacaccaucauggccuccaaaacggugggcacagcggaugagaagcuccgcaagaaaagcucuuuuuaccaguccuaccugcggagaacccaaagcauggggauccagcuugaccagcgcauuaucgugauguucauggucgcuuggggaaaggaagccguggauaauuuucaccugggcgacgacauggauccugagcuccggucucuggcccagauucugaucgaccaaaaaguuaaggaaauuagcaaccaggagcccaugaaacucuga

SEQ ID NO: 7299 - RNA, 1290 nt, Artificial Sequence
  derived and/or modified CDS sequence (opt5) from SEOV(Gou3-v9)__AF288651.1__N
auggccaccaaggaggaaauccagagagagauuagcgcucacgaaggccaacuggugaucgcccggcagaaagucaaggacgcggagaaacaguacgaaaaggaucccgacguucucaacaaacgcgcucugcaugauagagaguccguggccgccucuauucagagcaagaucgacgagcuuaagcggcaacuggcugaucgcauugccgcugggaaauccaucggacaggacagagauccuacaggcguggaaccgggggaccaccucaaggagcggucugcccugagcuauggaaauacgcuugaucugaacucccucgacaucgaugaacccaccggccagacagcggacuggcugaccauuaucgucuaccugacaucuuucgugguuccuauuauccucaaagcccuguauaugcuuaccacacgcgggagacagaccagcaaggauaaucggggaaugcgcauuagauuuaaagacgacuccagcuacgaggaugugaacggcauccggaagcccaagcaucuguaugucucuaugccuaaugcucaauccagcaugaaagccgaggaaauuacgcccggccgcuucagaaccgcugugugcgggcucuacccugcccagaucaaggcgcggaacaugguuucuccggugauguccgucgugggauuucuggcccuugcuaaagacuggacaagccgcaucgaggauuggcugggcgcccccuguaaguucauggcugaaucuccuauugccgggucccucagcggaaaucccgugaacagagacuauauccggcagagacagggcgcccuggcugggauggagccuaaagaauuucaagcgcugcgccagcacuccaaggaugccggaugcacccucgucgagcauauugagucucccagcuccaucuggguuuucgcuggcgccccggaccgguguccucccacaugccuguuugugggcgggauggccgaacuuggagcuuucuuuagcauucugcaggauaugagaaauaccaucauggccucuaaaacggugggcacagcggacgagaagcuccgcaagaaauccagcuucuaccaaucuuaccugcggagaacccagagcauggggauccagcuugaucagcgcauuaucgucauguuuaugguggcuuggggaaaggaagccguugacaacuuccaccugggcgaugacauggacccugagcuccggucccuggcccaaauucugaucgaucagaaagugaaggaaauuucuaaucaggagcccaugaaacucuga

SEQ ID NO: 7300 - RNA, 1290 nt, Artificial Sequence
  derived and/or modified CDS sequence (opt5) from SEOV(IR461)__AF329388.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggcauucggauccgcuuuaaagacgauagcuccuacgagaauguuaacggaauuagaaagcccaagcaucuguaugugagcaugccuaaugcucaaucuuccaugaaagccgaggaaaucacgcccggccgguuccgcaccgcugucugcgggcucuacccugcccagaucaaggcgggaaacauggugagcccgguuaugucuguggucggcuuucuggcccuugcuaaagacuggacauccagaauugaggaauggcuggauacccccuguaaguucaugguggagagcccuaucgccgggucucucuccggaaaucccgugaaccgggacuauauucgccagagacagggcgcucuggccgggauggaaccuaaagaguuucaagcccugcggcagcacagcaaggaugcuggaugcacacucgucgagcauaucgaaucccccucuagcauuuggguuuucgcgggcgccccggacagauguccuccuaccugccuguuugugggcgggauggcugagcuuggagccuucuuuuccauccugcaggauaugcgcaauacgaucauggccagcaaaacagugggcaccgcugacgaaaagcuccggaagaaaucuuccuucuaccaaagcuaccugagacgcacacagucuauggggauucagcuugaucagcggaucauugucauguuuaugguggccuggggaaaggaggcgguugacaacuuccaccugggcgaugacauggaccccgaacucagaagccuggcucaaauccugauugaucagaaagugaaggagaucuccaaucaggagcccaugaaacucuga

SEQ ID NO: 7301 - RNA, 1290 nt, Artificial Sequence
  derived and/or modified CDS sequence (opt5) from SEOV(JUN5-14)__DQ217791.1__N
auggccaccauggaggaguuccagagagaaaucagcgcucacgaaggccaacuggugauugcccggcagaaggucaaagacgcggagaagcaguacgaaaaagaucccgacgaucucaacaagcgcgcucugcaugacagagaguccguugccgccucuauccagagcaaaauugaugagcuuaagcggcaacuggcugaccgcaucgccgcugggaagaauauuggacaggauagagacccuacaggcguggaaccgggggaucaccucaaagagcgguccgcccugucuuauggaaacacgcuugaccugaauagccucgauaucgacgaacccaccggccagacagcggauuggcugaccaucauuguguaccugacauccuuugucgugccuaucauucucaaggcccuguauaugcuuaccacacgcgggagacagaccucuaaagacaacaagggaaugcggauccgcuucaaagacgauagcuccuacgaggacguuaauggcauuagaaagcccaagcaucuguaugugagcaugccuaacgcucaaucuuccaugaaagccgaggaaaucacgcccggccgguuucgcaccgcugucugcgggcucuacccugcccagauuaaggcgagaaauauggugagcccgguuaugucuguggucggauuccuggcccuugcuaaagauuggacaucccggaucgaggaauggcugggcgcccccuguaaguuuauggcugagagcccuaucgccgggucucucuccggaaaccccgugaaucgcgacuauauuagacagcggcagggcgcccuggcugggauggaaccuaaagaguuccaagcgcugagacagcacgccaaggaugcuggaugcacccucguggagcauaucgaaagccccuccucuauuugggucuuugccggcgccccggaccgcuguccucccacaugccuguucguuggcgggauggcugagcuuggagccuuuuucagcauccugcaggauaugcggaacaccauuauggcguccaaaacggugggcacagcugacgaaaagcucagaaagaaaagcucuuuuuaccaauccuaccugcgccggacccagagcauggggauccagcuugaucagagaaucauugugauguucauggucgccuggggaaaggaggccguggacaauuuucaccugggcgaugacauggacccugaacuccgcucucuggcucaaauccugauugaucagaaaguuaaggagaucagcaaccaggagcccaugaaacucuga

SEQ ID NO: 7302 - RNA, 1290 nt, Artificial Sequence
  derived and/or modified CDS sequence (opt5) from SEOV(L99)__AF488708.1__N
auggccaccauggaggaaauccagagagagauuagcgcucacgaaggccaacuggugaucgcccggcagaaggucaaagacgcggagaagcaguacgaaaaagaucccgacgaucucaacaagcgcacacugcaugacagagaguccguugcugccucuauucagagcaaaaucgaugagcuuaagcggcaacuggccgaccgcauugcugccgggaagaauaucggacaggauagagacccuacgggcguggaaccgggggaucaccucaaagagcgguccgcucugucuuauggaaacacccuugaccugaauagccucgauaucgacgaacccacaggccagaccgccgauuggcugacaauuaucguguaccugaccuccuucgucgugccuauuauccucaaggcgcuguauaugcuuacaacccgcgggagacagacgucuaaagacaacaagggaaugcggauucgcuuuaaagacgauagcuccuacgaggacguuaauggcaucagaaagcccaagcaucuguaugugagcaugccuaacgcccaaucuuccaugaaagcugaggaaauuacccccggccgguuccgcacagccgucugcgggcucuacccugcucagaucaaggccagaaauauggugagcccgguuaugucuguggucggauuucuggcgcuugccaaagauuggaccucccggaucgaggaauggcugggcgcucccuguaaguucauggccgagagcccuauugcugggucucucuccggaaaccccgugaaucgcgacuauaucagacagcggcagggcgcccuggccgggauggaaccuaaagaguuucaagcucugagacagcacgcgaaggaugccggaugcacacucguggagcauauugaaagccccuccucuaucugggucuucgcuggcgccccggaccgcuguccuccuaccugccuguuuguuggcgggauggccgagcuuggagcuuucuuuagcauucugcaggauaugcggaacacgaucauggccuccaaaacagugggcaccgcggacgaaaagcucagaaagaaaagcucuuucuaccaauccuaccugcgccggacacagagcauggggauccagcuugaucagagaauuaucgugauguuuauggucgcuuggggaaaggaggccguggacaauuuccaccugggcgaugacauggaccccgaacuccgcucucuggcccaaauucugaucgaucagaaaguuaaggagauuagcaaccaggagcccaugaaacucuga

SEQ ID NO: 7303 - RNA, 1290 nt, Artificial Sequence
  derived and/or modified CDS sequence (opt5) from SEOV(R22)__AF488707.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcugggcgcccccuguaaguucauggcugagagcccuauugccgggucucucuccggaaaccccgugaaucgcgacuauaucagacagcggcagggcgcccuggcugggauggaaccuaaagaguuucaagcgcugagacagcacgccaaggaugcuggaugcacccucguggagcauauugaaagccccuccucuaucugggucuucgccggcgccccggaccgcuguccucccacaugccuguuuguuggccggauggcugagcuuggggccuucuuuagcauucugcaggauaugaaaaacaccaucauggcguccaagacggugggaacagcugacgaaaagcuccgcaaaaagagcucuuucuaccaauccuaccugagacggacccagagcaugggcauccagcuugaucagagaauuaucgugauguuuauggucgccugggggaaagaggccguggacaauuuccaccugggagaugacauggacccugaacuccgcucucuggcucaaauucugaucgaucagaagguuaaagagauuagcaaccaggagcccaugaagcucuga

SEQ ID NO: 7304 - RNA, 1290 nt, Artificial Sequence
  derived and/or modified CDS sequence (opt5) from SEOV(TURCKHEIM/Hu/FRA/2016/2016.00044)__KX064270.1__N
auggccaccauggaggaaauccagagagagauuagcgcucacgaaggccaacuggugaucgcccggcagaaggucaaagacgcggagaagcaguacgaaaaagaucccgacgaucucaacaagcgcgcucugcaugacagagaguccguugccgccucuauucagagcaaaaucgaugagcuuaagcggcaacuggcugaccgcauugccgcugggaagaauaucggacaggauagagacccuacaggcguggaaccgggggaucaccucaaagagcgguccgcccugucuuauggaaacacgcuugaccugaauagccucgauaucgacgaacccaccggccagacagcggauuggcugaccauuaucguguaccugacauccuucgucgugccuauuauccucaaggcccuguauaugcuuaccacacgcgggagacagaccucuaaagacaacaagggaaugcggauucgcuuuaaagacgauagcuccuacgaggacguuaauggcaucagaaagcccaagcaucuguaugugagcaugccuaacgcucaaucuuccaugaaagccgaggaaauuacgcccggccgguuccgcaccgcugucugcgggcucuacccugcccagaucaaggcgagaaauauggugagcccgguuaugucuguggucggauuucuggcccuugcuaaagauuggacaucccggaucgaggaauggcuggacgcccccuguaaguucauugcugagagcccuaucgccggcucucucuccgggaaccccgugaaucgcgauuauauuagacagcggcagggagcccuggcuggcauggaaccuaaagaguuucaagcgcugagacagcacagcaaggacgccgggugcacccucguggagcauaucgaaucccccucuagcauuugggucuucgcuggagccccggaucgcuguccucccacaugccuguuuguuggcggcauggccgagcuuggggcuuucuuuuccauccugcaggacaugcggaacaccaucauggccagcaaaacggugggaacagcggaugaaaagcucagaaagaaaucuuccuucuaccaaagcuaccugcgccggacccagucuaugggcauucagcuugaccagagaaucauugugauguuuauggucgcuugggggaaggaggccguggauaauuuccaccugggagacgacauggauccugaacuccgcagccuggcccaaauccugauugaccagaaaguuaaggagaucuccaaccaggagcccaugaaacucuga

SEQ ID NO: 7305 - RNA, 1290 nt, Artificial Sequence
  derived and/or modified CDS sequence (opt5) from SEOV(Z37)__AF187082.1__N
auggccaccauggaggaaauccagagagagauuagcgcucacgaaggccaacuggugaucgcccggcagaaggucaaagacgcggagaagcaguacgaaaaagaucccgacgauuucaacaagcgcgcucuccaugacagagaguccguugccgccucuauucagagcaaaaucgaugagcugaagcggcaacuugcugaccgcauugccgcugggaagaauaucggacaggauagagacccuacaggcguggaaccgggggaucaccugaaagagcgguccgcccucucuuauggaaacacgcuggaccuuaauagccuggauaucgacgaacccaccggccagacagcggauuggcucaccauuaucguguaccugacauccuuugucgugccuauuauccugaaggcccucuauaugcugaccacacgcgggagacagaccucuaaagacaacaagggaaugcggauucgcuucaaagacgauagcuccuacgaggacguuaauggcaucagaaagcccaagcaucuuuaugugagcaugccuaacgcucaaucuuccaugaaagccgaggaaauuacgcccggccgguuucgcaccgcugucugcgggcuguacccugcccagaucaaggcgagaaauauggugagcccgguuaugucuguggucggauuccucgcccuggcuaaagauuggacaucccggaucgaggaauggcuuggcgcccccuguaaguuuauggcugagagcccuauugccgggucucuguccggaaaccccgugaaucgcgacuauaucagacagcggcagggcgcccucgcugggauggaaccuaaagaguuccaagcgcugagacagcacgccaaggaugcuggaugcacccugguggagcauauugaaagccccuccucuaucugggucuuugccggcgccccggaccgcuguccucccacaugccucuucguuggcgggauggcugagcugggagccuuuuucagcauucuucaggauaugcggaacaccaucauggcguccaaaacggugggcacagcugacgaaaagcugagaaagaaaagcucuuuuuaccaauccuaccuccgccggacccagagcauggggauccagcuggaucagagaauuaucggaauguucaugguggccuggggcaaggaggccgucgacaauuuucaccuuggggaugacauggacccugaacugcgcucucucgcucaaauucugaucgaucagaaagugaaggagauuagcaaccaggagcccaugaaacuguga

SEQ ID NO: 7306 - RNA, 1290 nt, Artificial Sequence
  derived and/or modified CDS sequence (opt5) from SEOV(Tchoupitoulas (TCH))__AF329389.1__N
auggccaccauggaggaaauccagagagagauuagcgcucacgaaggccaacuggugaucgcccggcagaaggucaaagacgcggagaagcaguacgaaaaagaucccgacgauuucuauaagcgcgcucuccaugacagagaguccguugccgccucuauucagagcaaaaucgaugagcugaagcggcaacuugcugaccgcauugccgcugggaagaacaucggacaggauagagacccuacaggcguggaaccgggggaucaccugaaagagcgguccgcccucucuuacggaaauacgcuggaccuuaacagccuggauaucgacgaacccaccggccagacagcggauuggcucaccauuaucguguaucugacauccuuugucgugccuauuauccugaaggcccucuacaugcugaccacacgcgggagacagaccucuaaagacaauaagggaaugcggauucgcuucaaagacgauagcuccuaugaggacguuaacggcaucagaaagcccaagcaucuuuacgugagcaugccuaaugcucaaucuuccaugaaagccgaggaaauuacgcccggccgguuucgcaccgcugucugcgggcuguauccugcccagaucaaggcgagaaacauggugagcccgguuaugucuguggucggauuccucgcccuggcuaaagauuggacaucccggaucgaggaauggcuuggcgcccccuguaaguuuauggcugagagcccuauugccgggucucuguccggaaaucccgugaaccgcgacuacaucagacagcggcagggcgcccucgcugggauggaaccuaaagaguuccaagcgcugagacagcacagcaaggaugccggaugcacccugguggagcauauugaaucccccucuagcaucugggucuuugcuggcgccccggaccgcuguccucccacaugccucuucguuggcgggauggccgagcugggagccuuuuucuccauucuucaggauaugcggaauaccaucauggcuagcaaaacggugggcacagcggacgaaaagcugagaaagaaaucuuccuuuuaccaaagcuaucuccgccggacccagucuauggggauccagcuggaucagagaauuaucgugauguucauggucgcuuggggaaaggaggccguggacaacuuucaccuuggcgaugacauggacccugaacugcgcagccucgcccaaauucugaucgaucagaaaguuaaggagauuuccaaucaggagcccaugaaacuguga

SEQ ID NO: 7307 - RNA, 1290 nt, Artificial Sequence
  derived and/or modified CDS sequence (opt5) from SEOV__M34881.1__N
auggccaccauggaggaaauccagagagagauuagcgcucacgaaggccaacuggugaucgcccggcagaaggucaaggacgcggagaagcaguacgaaaaagaucccgacgaucucaacaagcgcgcucugcaugacagagaguccguugccgccucuauucagagcaaaaucgaugagcuuaagcggcaacuggcugaccgccuccagcaggggagaacauccggacaggaucgggacccuacgggcguggaaccgggggaucaccugaaggagcgcucugcccuuagcuauggaaauacccuggaccucaacucccuggauauugacgaacccacaggccaaaccgcugauuggcugacaaucaucguguaccucaccucuuucgucgugccuauuauccugaaagcccuuuauaugcugacaaccagagggcggcagacgagcaaggacaauaaaggaaugcgcauuagauuuaaggacgauuccagcuacgaggacguuaacggcauccggaaacccaagcaucucuaugugucuaugccuaaugcgcaguccagcaugaaggccgaggaaauuacccccggccgcuucagaacagcugucugcgggcuguacccugcccagaucaaagcucggaacauggugucuccgguuauguccguggucggauuucuugcccuggcgaaggauuggaccagccgcauugaggaauggcucggcgcccccuguaaauucauggcugagucucugaucgccgggucccugagcggaaauccugugaacagagacuauauccggcaaagacagggcgcucucgccgggauggaacccaaggaguuucaggcccugcgccaacacuccaaagaugcuggaugcacacuuguggagcauauugaaucuccuagcuccaucugggucuucgcgggcgcccccgaccgguguccgccuaccugccuguuuguuggcgggauggcugagcucggagccuucuuuagcauucugcaggauaugagaaauacgaucauggccucuaagacagugggcaccgcugacgaaaaacuucgcaagaaguccagcuucuaccagucuuaccugcggagaacacagagcauggggauucaacucgaucagcgcaucaucgugauguuuauggucgccuggggaaaagaggcgguggacaacuuccaccugggcgaugacauggaccccgaacugcggucccucgcucagauucugaucgaucagaagguuaaagagauuucuaaucaagagccuaugaaacuuuga

SEQ ID NO: 7308 - RNA, 1287 nt, Artificial Sequence
  derived and/or modified CDS sequence (opt5) from SNV(H10)__NC_005216.1__N
augagcacccugaaggaggugcaggacaacaucacacuccacgaacaacagcuggucacggccagacagaaacuuaaggaugcugagcgggccguugaacuggaccccgaugacgugaauaaauccacccuccagucucgcagagcggcugugagcgcccuggagacaaaacuuggcgaacugaagcgggagcucgccgaucugauugcugcccaaaagcuggcuuccaagccugucgacccgaccgggaucgagcccgaugaccaucucaaagaaaagucuagccugcgcuacggaaacgugcuugauguuaauuccauugaccuggaggaaccuucuggccagacagccgauuggaaaagcaucgggcucuauauucuguccuucgcgcuucccaucauccugaaggcccucuacaugcugagcaccagaggacggcagacaauuaaagagaacaagggcacccgcaucagauuuaaggacgauucuuccuaugaggaagugaaugggauucggaaaccucgccaccuguacgucagcaugcccacggcucagucuaccaugaaggccgacgagaucacaccuggaagauuccggaccauugcuugcggccucuuuccggcccaagugaaagcgcgcaacaucauuucccccguuaugggcgugaucggguucagcuuuuucgucaaggacuggauggaaagaaucgaugacuuucuggccgcucgguguccuuuccuucccgagcagaaagauccucgcgacgccgcucuggccacaaauagagccuauuuuauuacccggcagcuccagguggaugaaucuaagguguccgacaucgaggaucugauugcugacgcgagagccgagagcgcuacgaucuucgccgauauugccacaccccauuccgucuggguuuuugcuugcgccccggaccgcuguccucccaccgcgcuuuacguggcuggaaugccugaacugggcgccuucuuugccauccuccaagauaugcggaacacaaucauggcuucuaaaagcguggggaccuccgaggaaaagcugaagaaaaagagcgccuucuaucagucuuaccugagacgcacccaguccaugggcauucaacucgaccagaaaaucauuauccuguacaugagccacuggggacgggaggcugucaaucauuuccaccuuggggacgauauggaccccgaacugagagagcucgcccagacacugguggauauuaagguucgcgagaucucuaaccaggaaccccuuaaacuguga

SEQ ID NO: 7309 - RNA, 1287 nt, Artificial Sequence
  derived and/or modified CDS sequence (opt5) from SNV(2)__JQ690282.1__N
augagcacccugaaggaggugcaggacaacaucacacuccacgaacaacagcuggucacggccagacagaaacuuaaggaugcugagcgggccguugaacuggaccccgaugacgugaauaaauccacccuccagucucgcagagcggcugugagcgcccuggagacaaaacuuggcgaacugaagcgggagcucgccgaucugauugcugcccaaaagcuggcuuccaagccugucgacccgaccgggaucgagcccgaugaccaucucaaagaaaagucuagccugcgcuacggaaacgugcuugauguuaauuccauugaccuggaggaaccuucuggccagacagccgauuggaaaagcaucgggcucuauauucuguccuucgcgcuucccaucauccugaaggcccucuacaugcugagcaccagaggacggcagacaauuaaagagaacaagggcacccgcaucagauuuaaggacgauucuuccuaugaggaagugaaugggauucggaaaccucgccaccuguacgucagcaugcccacggcucagucuaccaugaaggccgacgagaucacaccuggaagauuccggaccauugcuugcggccucuuuccggcccaagugaaagcgcgcaacaucauuucccccguuaugggcgugaucggguucagcuuuuucgucaaggacuggauggaaagaaucgaugacuuucuggccgcucgguguccuuuccuucccgagcagaaagauccucgcgacgccgcucuggccacaaauagagccuauuuuauuacccggcagaugcaaguggaugaaucuaagguguccgacaucgaggaucucauugcugacgcgagagccgagagcgcuacgaucuucgccgauauugccacaccccauuccgucuggguuuuugcuugcgccccggaccgcuguccucccaccgcgcuguacguggcuggaaugccugaacuuggcgccuucuuugccauccugcaggauaugcggaacacaaucauggcuucuaaaagcguggggaccuccgaggaaaagcucaagaaaaagagcgccuucuaucagucuuaccugagacgcacccaguccaugggcauucaacuggaccagaaaaucauuauccucuacaugagccacuggggacgggaggcugucaaucauuuccaccugggggacgauauggaccccgaacuuagagagcuggcccagacacucguggauauuaagguucgcgagaucucuaaccaggaaccccugaaacuuuga

SEQ ID NO: 7310 - RNA, 1287 nt, Artificial Sequence
  derived and/or modified CDS sequence (opt5) from SNV(3)__JQ690278.1__N
augagcacccugaaggaggugcaggacaacaucacacuccacgaacaacagcuggucacggccagacagaaacuuaaggaugcugagcgggccguugaacuggaccccgaugacgugaauaaauccacccuccagucucgcagagcggcugugagcgcccuggagacaaaacuuggcgaacugaagcgggagcucgccgaucugauugcugcccaaaagcuggcuuccaagccugucgacccgaccgggaucgagcccgaugaccaucucaaagaaaagucuagccugcgcuacggaaacgugcuugauguuaauuccauugaccuggaggaaccuucuggccagacagccgauuggaaaagcaucgggcucuauauucuguccuucgcgcuucccaucauccugaaggcccucuacaugcugagcaccagaggacggcagacaauuaaagagaacaagggcacccgcaucagauuuaaggacgauucuuccuaugaggaagugaaugggauucggaaaccucgccaccuguacgucagcaugcccacggcucagucuaccaugaaggccgacgagaucacaccuggaagauuccggaccauugcuugcggccucuuuccggcccaagugaaagcgcgcaacaucauuucccccguuaugggcgugaucggguucagcuuuuucgucaaggacuggauggaaagaaucgaugacuuucuggccgcucgguguccuuuccuucccgagcagaaagauccucgcgacgccgcucuggccacaaauagagccuauuuuauuacccggcagcuccagguggaugaaucuaagguguccgacaucgaggaucugauugcugacgcgagagccgagagcgcuacgaucuucgccgauauugccacaccccauuccgucuggguuuuugcuugcgccccggaccgcuguccucccaccgcgcuuuacguggcuggaaugccugaacugggcgccuucuuugccauccuccaagauaugcggaacacaaucauggcuucuaaaagcguggggaccuccgaggaaaagcugaagaaaaagagcgccuucuaucagucuuaccugagacgcacccaguccaugggcauucaacccgaccagaaaaucauuauccucuacaugagccacuggggacgggaggcugucaaucauuuccaccugggggacgauauggaccccgaacuuagagagcuggcccagacacucguggauauuaagguucgcgagaucucuaaccaggaaccucugaaacuuuga

SEQ ID NO: 7311 - RNA, 1287 nt, Artificial Sequence
  derived and/or modified CDS sequence (opt5) from SNV(CC107/POR)__KT885046.1__N
augagcacccugaaggaggugcaggacaacaucacacuccacgaacaacagcuggucacgaccagacagaaacuuaaggaugccgagcgggcuguugaacuggaccccgaugacgugaauaaauccacacuccagucucgcagagccgcggugagcgcucuggagaccaaacuuggcgaacugaagcgggagcucgccgaucugauugccgcucaaaagcuggccuccaagccugucgacccgacagggaucgagcccgaugaccaucucaaagaaaagucuagccugcgcuacggaaacgugcuugauguuaauuccauugaccuggaggaaccuucuggccagaccgcugauuggaaaagcaucgggcucuauauucuguccuucgcccuucccaucauccugaaggcgcucuacaugcugagcacaagaggacggcagaccauuaaagagaacaagggcacgcgcaucagauuuaaggacgauucuuccuaugaggaagugaaugggauucggaaaccucgccaccuguacgucagcaugcccaccgcccagucuacaaugaaggcugacgagaucaccccuggaagauuccggacaauugccugcggccucuuuccggcucaagugaaagcccgcaacaucauuucccccguuaugggcgugaucggguucagcuuuuucgucaaggacuggauggaaagaaucgaugaguuucuggcggcccgguguccuuuccuucccgaacagaaagacccucgcgaugcugcccuggcuaccaauagagccuauuuuauuacgcggcagaugcaaguggacgagucuaagguguccgauaucgaggaccucauugccgaugcuagagcggaaagcgccacaaucuucgcugacauugccacaccccauuccgucuggguuuuugccugcgcuccggaucgcuguccucccaccgcccuguacguggcgggaaugccugagcuuggcgcuuucuuugccauccugcaggacaugcggaacaccaucauggccucuaaaagcguggggaccuccgaagagaagcucaagaaaaagagcgcuuucuaucagucuuaccugagacgcacacaguccaugggcauucaacuggaucagaaaaucauuauccucuacaugagccacuggggacgggaagccgucaaucauuuccaccugggggacgacauggaucccgagcuuagagagcuggcucagacgcucguggacauuaagguucgcgaaaucucuaaccaggagccccugaaacuuuga

SEQ ID NO: 7312 - RNA, 1287 nt, Artificial Sequence
  derived and/or modified CDS sequence (opt5) from HPS(Convict Creek 107)__L33683.1__N
augagcacccugaaggaggugcaggacaacaucacacuccacgaacaacagcuggucacgaccagacagaaacuuaaggaugccgagcgggcuguugaacuggaccccgaugacgugaauaaauccacacuccagucucgcagagccgcggugagcgcucuggagaccaaacuuggcgaacugaagcgggagcucgccgaucugauugccgcucaaaagcuggccuccaagccugucgacccgacagggaucgagcccgaugaccaucucaaagaaaagucuagccugcgcuacggaaacgugcuugauguuaauuccauugaccuggaggaaccuucuggccagaccgcugauuggaaaagcaucgggcucuauauucuguccuucgcccuucccaucauccugaaggcgcucuacaugcugagcacaagaggacggcagaccauuaaagagaacaagggcacgcgcaucagauuuaaggacgauucuuccuaugaggaagugaaugggauucggaaaccucgccaccuguacgucagcaugcccaccgcccagucuacaaugaaggcugacgagaucaccccuggaagauuccggacaauugccugcggccucuuuccggcucaagugaaagcccgcaacaucauuucccccguuaugggcgugaucggguucagcuuuuucgucaaggacuggauggaaagaaucgaugaguuucuggcggcccgguguccuuuccuucccgaacagaaagacccucgcgaugcugcccuggcuaccaauagagccuauuuuauuacgcggcagaugcaaguggacgagucuaagguguccgauaucgaggaccucauugccgaugcuagagcggaaagcgccacaaucuucgcugacauugccacaccccauuccgucuggguuuuugccugcgcuccggaucgcuguccucccaccgcccuguacguggcgggaaugccugagcuuggcgcuuucuuugggauccugcaggacaugcggaacaccaucauggccucuaaaagcgugggaaccuccgaagagaagcucaagaaaaagagcgccuucuaucagucuuaccugagacgcacacaguccaugggcauucaacuggaucagaaaaucauuauccucuacaugagccacugggggcgggaagcugucaaucauuuccaccugggagacgacauggaucccgagcuuagagagcuggcccagacgcucguggacauuaagguucgcgaaaucucuaaccaggagccccugaaacuuuga

SEQ ID NO: 7313 - RNA, 1287 nt, Artificial Sequence
  derived and/or modified CDS sequence (opt5) from HPS(Convict Creek 74)__L33816.1__N
augagcacccugaaggaggugcaggacaacaucacacuccacgaacaacagcuggucacguccagacagaaacuuaaggaugccgagcgggcuguugaacuggaccccgaugacgugaauaaaucuacccuccagagccgcagagccgcgguguccgcucuggagacaaagcugggcgaacugaaacgggagcucgccgaucauauugccgcucaaaagcuggccucuaagccugucgacccgaccgggaucgagcccgaugaccaccugaaagaaaagagcucccuccgcuacggaaacgugcuggauguuaauucuauugaccuugaggaaccuaacggccagacagcugauuggaaaagcaucgggcuguauauucucuccuucgcccugcccaucauccuuaaggcgcuguacaugcucagcaccagaggacggcagacaauuaaagagaauaagggcacccgcaucagauuuaaggacgauucuuccuaugaggaagugaacgggauucggaaaccucgccaucuguacgucagcaugcccacggcccagucuaccaugaaggcugacgagaucacaccuggaagauuccggaccauugccugcggccuguuuccggcucaagugaaagcccgcaauaucauuucccccguuaugggcgugaucggguucagcuuuuucgucaaggacuggauggaaagaaucgaugaguuucucgcggcccgguguccuuuccugcccgaacagaaagacccucgcgaugcugcccuugcuacaaacagagccuauuuuauuacccggcagcuucagguggacgagucuaagguguccgauaucgaggaccucauugccgaugcuagagcggaaagcgccacgaucuucgcugacauugccacaccccacuccgucuggguuuuugccugcgcuccggaucgcuguccucccaccgcccuguacguggcgggaaugccugagcuuggcgcuuucuuugggauccugcaagacaugcggaauacaaucauggccucuaaaagcgugggaaccuccgaagagaagcucaagaaaaagagcgccuucuaucagucuuaccugagacgcacccaguccaugggcauucaacuggaucagaaaaucauuauccucuacaugagccauugggggcgggaagcugucaaccacuuccaccugggagacgacauggaucccgagcuuagagagcuggcccagacacucguggacauuaagguucgcgaaaucucuaaucaggagccccugaaacuuuga

SEQ ID NO: 7314 - RNA, 1287 nt, Artificial Sequence
  derived and/or modified CDS sequence (opt5) from HPS(H-NY1)__U47135.1__N
augagcacccugaaggaggugcaggacaacaucacacuccacgaacaacagcuggucacggccagacagaaacuuaaggaugcugagaaagccguugaaguggaccccgaugacgugaauaaguccacccugcagggccggcgcgcggcugucucugcccucgagacaaaacugggggaacuuaagagacaacuggccgaucucauugcugcccagaagcuggcuagcaaaccuaucgacccgaccggaauugagcccgaugaccaucugaaggagaaauccucucuccgguacggcaacgugcuggauguuaauagcaucgaccuugaagaaccuuccgggcagacagccgauuggaaggcgauuggaauguauauccugucuuucgccauccccauuauccucaaagcucuguacaugcuuagcacccgcggcagacagacagugaaggaaaacaaggggacccggauucgcuuuaaagacgauuccagcuaugaggaggucaauggaaucagaaagccucggcaccuguacgugucuaugcccacggcccaauccaccaugaaagcugacgaaauuacaccuggccgcuucagaaccaucgccugcggccucuuuccggcgcagguuaaggcccggaacauuaucagccccgugaugggggucaucggauucaacuuuuucgugaaagacuggauggaucgcauugacgauuuucuggcugagagauguccuuuccugcccgaaccucgggaccccaaggaugccgcucucggcacaaaucgcgccuauuuuaucaccagacaggcccagguggacgagucuaaagucguugauauugaggagcugaucguggacgcucgggcggaguccgccacgcuuuucacagauauugcuaccccgcauagcgugugggucuuugccugcgccccugacagaugucccccuacagcucuguacguggccgggaugcccgaacucggagcguucuuugcuauccugcaagauaugcgcaauaccaucauggccucuaaguccguuggcaccgccgaggaaaaacuuaagaagaaaagcgcuuucuaucaguccuaccugcggagaacacagucuauggggauucaacucgaccagaagaucauuauccuguacaugauucacuggggaaaagaggccgugaaccauuuccaccugggcgacgauauggaccccgaacuccgcgagcuggcucaggcccuugucgaugcgaaggugaaggagaucagcaaucaggaaccucugaaacucuga

SEQ ID NO: 7315 - RNA, 1290 nt, Artificial Sequence
  derived and/or modified CDS sequence (opt5) from THAIV(Nakhon Ratchasima/Bi0017/2004)__AM397664.1__N
auggccaccauggaggaacugcagagagagaucaacgcucacgaaggccaacucguggucgcccggcagaagguuaaagacgcggagaagcaguacgaaaaagaucccgacgaucugaaucgcagagcccuucaugaccgggagagcguggcugccuccauucagucuaagaucgaugagcugaaacgccaacucgcugacagaauugccagcgggcggacaaucggacaggaucgcgacccuacgggcguggaaccgggggaucaccugagagagcgguccaugcuuucuuauggaaacguccuggaccucaauaaccuggauauugaggaacccaccggccagacagcugacuggcugaccaucaucguguaccucaccagcuucguuauuccuaucauucugaaggcccuuuauaugcugaccacacgcgggagacagaccacgaaggauaauaaaggaaugcggauccgcuuuaaggacgacuccucuuacgaggaugugaacggcauuagaaaacccaagcaucucuauaucagcaugccuaaugcgcaauccagcaugaaagccgaagagauuacccccggccgguuccgcacagcugucugcgggcuguacccugcccaggugaaggcuagaaacaugguuucuccggugauguccgucaucggauuuauggcccuugcgaaggacuggaccgaucggauccaggacuggcugggcgcccccuguaaauuccucccugaucugagcacacagucucugcacgcuuccccucccaccaaugccgacuauauugcucaaagacaggggcuccuggccggaauggaaacgaaggagagcaaaggcauccgcgaucaugcccgggacgcugggugcacacuuguggaucaccuggacucucccuccagcauuuggguguuugcgggagccccggauagauguccucccacaugccucuucaucgcuggcauggccgaacugggcgccuuuuucuccauucuucaggacaugcgcaacacaaucauggcuucuaagaccgucgggaccagcgaggagaaacugaagaaaaaguccagcuuuuaccaaucuuaccuccggagaacacaguccaugggaauccagcuggaccagcgcauuaucguuauguucaugguggccuggggcaaggaagcgguggauaauuuucaccugggggacgauauggacccugagcuccggaaccuggcucaacuucugauugaucagaaagucaaggaaaucagcaaucaggagccccucaaacuguga

SEQ ID NO: 7316 - RNA, 1290 nt, Artificial Sequence
  derived and/or modified CDS sequence (opt5) from TULV(Tula/Moravia/5302Ma/94)__NC_005227.2__N
augagccagcugaaggagauccaagaagagauuaccagacacgaacagcagaucgugauugcccggcagaaacucaaggacgcugagaaaacagucgaagccgaucccgacgauguuaacaaguccacgcugcaaucucgcagagcggcugugagcgcccuugaggacaaacuggccgauuucaagcggcagcucgcugaccugguguccucucagaagaugggcgagaaaccugucgauccgaccgggcuugaacccgacgaucaucugaaggagcgcagcucccucagauacggaaaugugcuggacguuaacgccaucgauauugacgaaccuucuggccagacagcugauugguuuagcaucgggcaauauaucaccggauucgcccuggcgauuauccucaaagcccuguacaugcuuuccacacggggccgccagaccauuaaggagaauaaagggacaagaauccgguuuaaggacgacagcucuuaugaggaaauuaacggaauccgcagacccaagcaccuguacguguccaugccuaccgcucagagcacgaugaaagccgaugagcucacccccggccgguuccgcacaauugucugcggccuguuuccugcucagaucaugcauagaaauaucauuucuccggugauggggguuaucggauucuccuuuuucgugaaggacuggcccgaaaagauugaggaauuucuuaucaagccuugucccuuccugaaaaagagcggcccuucuaaagaggaggauuuucucgucuccaacgacgccuaucugcuggggcgggaaaaggcgcuccgcgagagccaccuggccgaaauugaugaccuuaucgaucuggcugccuccggagaccccaccccgccugauucuaucaagagcccccaagcuccuuggguguucgccugcagacccgaccggugucccccuacaugcauuuacaucgccggcauggcugagcucggggcguuuuucuccauucugcaggauaugagaaauaccaucauggccagcaaaacggugggaacagcugaagagaaacuuaaaaagaaaucuuccuucuaucagagcuaccugcgccggacccaaucuaugggcauucagcucgaccagagaaucauccugcuguuuaugacagaguggggcagcgacauugucaaccauuuccaccucggggaugacauggauccggaacugcgcacccuugcccagucccugaucgaccaaaagguuaaggagauuucuaaucaggaaccccucaaaaucuga

SEQ ID NO: 7317 - RNA, 1293 nt, Artificial Sequence
  derived and/or modified CDS sequence (opt5) from TULV(D17-98)__AF289820.1__N
augagccagcugaaggagauccaagaagagauuaccagacacgaacagcagaucgugauugcccggcagaaacucaaggacgcugagaaaacagucgaagccgaucccgacgauguuaacaaguccacgcugcaaucucgcagagcggcugugagcgcccuugaggacaaacuggccgauuucaagcggcagcucgcugaccugguguccucucagaagaugggcgagaaaccugucgauccgaccgggcuugaacccgacgaucaucugaaggagcgcagcucccucagauacggaaaugugcuggacguuaacgccaucgauauugacgaaccuucuggccagacagcugauugguuuagcaucgggcaauauaucauuggauucgcccuggcgaucgugcucaaagcccuguacaugcuuuccacccggggccgccagacaauuaaggagaauaaagggaccagaauccgguuuaaggacgacagcucuuaugaggaaauuaacggaauccgcagacccaagcaccuguacgucuccaugccuacagcucagagcaccaugaaagccgaugagcucacgcccggccgguuccgcaccauugugugcggccuguuuccugcucagaucaugcauagaaauaucauuucuccgguuaugggggugaucggauucuccuuuuucgucaaggacuggcccgauaaaauugaagaguuucuuaucaagccuugucccuuccugaaaaagcaaggcgggccuaacaaagacgaagaguuucucgugagcuaugaugccuaccugcugggacgggagaaggcgcuccgcgaaucucaccuggccgagauugacgaucuuaucgaccuggcugccuccggcgaucccacaccgccugacagcaucaagucuccccaggggccuuggguguucgcuugcgcccccgauagaugucccccuaccugcauuuaugucgccggaauggcugaacucggcgcguuuuucuccauccugcaggacaugcggaauacaauuauggccagcaaaaccguuggcacggcugaggaaaaacuuaagaagaaauccagcuucuaccaaucuuaccugagacgcacacaguccauggggauccagcucgaccagcggauuauccugcuguuuaugauggaguggggaagcgauaucgugaaccauuuccaccucggcgacgauauggacccggagcugagaacccuugcccaaucucugauugaucagaaggugaaggaaaucagcaaucaggagccccucaaaauuuga

SEQ ID NO: 7318 - RNA, 1293 nt, Artificial Sequence
  derived and/or modified CDS sequence (opt5) from TULV(D5-98)__AF289819.1__N
augagccagcugaaggagauccaagaagagauuaccagacacgaacagcagaucgugauugcccggcagaaacucaaggacgcugagaaaacagucgaagccgaucccgacgauguuaacaaguccacgcugcaaucucgcagagcggcugugagcgcccuugaggacaaacuggccgauuucaagcggcagcucgcugaccugguguccucucagaagaugggcgagaaaccugucgauccgaccgggcuugaacccgacgaucaucugaaggagcgcagcucccucagauacggaaaugugcuggacguuaacgccaucgauauugacgaaccuucuggccagacagcugauugguuuagcaucgggcaauauaucauuggauucgcccuggcgaucgugcucaaagcccuguacaugcuuuccacccggggccgccagacaauuaaggagaauaaagggaccagaauccgguuuaaggacgacagcucuuaugaggaaauuaacggaauccgcagacccaagcaccuguacgucuccaugccuacagcucagagcaccaugaaagccgaugagcucacgcccggccgguuccgcaccauugugugcggccuguuuccugcucagaucaugcauagaaauaucauuucuccgguuaugggggugaucggauucuccuuuuucgucaaggacuggcccgauaaaauugaagaguuucuuaucaagccuugucccuuccugaaaaagcaaggcgggccuaacaaagacgaagaguuucucgugagcuaugaugccuaccugcugggacgggagaaggcgcuccgcgaaucucaccuggccgagauugacgaucuuaucgaccuggcugccuccggcgaucccacaccgccugacagcaucaagucuccccaggcuccuuggguguucgccugcgcccccgauagaugucccccuaccugcauuuaugucgcugggauggcggaacucggagccuuuuucuccauccugcaggacaugcggaauacaauuauggcuagcaaaaccguuggcacggccgaggaaaaacuuaagaagaaauccagcuucuaccaaucuuaccugagacgcacacaguccaugggcauccagcucgaccagcggauuauccugcuguuuaugauggagugggggagcgauaucgugaaccauuuccaccucggagacgauauggacccggagcugagaacccuugcccaaucucugauugaucagaaggugaaggaaaucagcaaucaggagccccucaaaauuuga

SEQ ID NO: 7319 - RNA, 1293 nt, Artificial Sequence
  derived and/or modified CDS sequence (opt5) from TULV(D63-98)__AF289821.1__N
augagccagcugaaggagauccaagaagagauuaccagacacgaacagcagaucgugauugcccggcagaaacucaaggacgcugagaaaacagucgaagccgaucccgacgauguuaacaaguccacgcugcaaucucgcagagcggcugugagcgcccuugaggacaaacuggccgauuucaagcggcagcucgcugaccugguguccucucagaagaugggcgagaaaccugucgauccgaccgggcuugaacccgacgaucaucugaaggagcgcagcucccucagauacggaaaugugcuggacguuaacgccaucgauauugacgaaccuucuggccagacagcugauugguuuagcaucgggcaauauaucauuggauucgcccuggcgaucgugcucaaagcccuguacaugcuuuccacccggggccgccagacaauuaaggagaauaaagggaccagaauccgguuuaaggacgacagcucuuaugaggaaauuaacggaauccgcagacccaagcaccuguacgucuccaugccuacagcucagagcaccaugaaagccgaugagcucacgcccggccgguuccgcaccauugugugcggccuguuuccugcucagaucaugcauagaaauaucauuucuccgguuaugggggugaucggauucuccuuuuucgucaaggacuggcccgauaaaaaggaagaguuucuuauuaaaccuugucccuuccugaagaaacaaggcgggccuaacaaggacgaagaguuucucgugagcaaugaugccuaucugcugggacgggagaaggcgcuccgcgaaucucaccuggccgagaucgacgaucuuauugaccuggcugccuccggcgaucccacaccgccugacagcaucaaaucuccccaggggccuuggguguucgcuugcgcccccgauagaugucccccuaccugcaucuacgucgccggaauggcugaacucggcgcguuuuucuccauucugcaggacaugcggaacacaaucauggccagcaagaccguuggcacggcugaggaaaaacuuaagaaaaaguccagcuucuaucaaucuuaccugagacgcacacaguccauggggauucagcucgaccagcggaucauucugcuguuuaugauggaguggggaagcgauaucgugaaucauuuccaccucggcgacgauauggacccggagcugagaacccuugcccaaucucugaucgaucagaaggugaaagaaauuagcaaccaggagccccucaagaucuga

SEQ ID NO: 7320 - RNA, 1290 nt, Artificial Sequence
  derived and/or modified CDS sequence (opt5) from TULV(MG23/Omsk)__AF442621.1__N
augagcacccugaaggagauccaggaagagauuacaagacacgaacaacagaucgugauugcccggcagaaacucaaggacgcugagaaaacggucgaagccgaucccgacgauguuaacaagaauacccugcagucccgcagagcggcugugucuacacuugaggacaaacuggccgaguucaagcggcaacucgccgaucuggugagcucccagaagaugggcgaaaaaccugucgacccgaccgggcuugagcccgaugaccaucugaaggaacgcucuagccucagauacggaaacgugcuggauguuaaugcuacagacaucgaugagccuuccggccagaccgccgacugguuuucuauugggcaguauaucaugggauucgcucuggccaucgugcucaaagcgcuguacaugcuuagcacacggggccgccaaaccauuaaggagaacaaagggacgagaaucaaguuuaaggaugacuccagcauugaagagaucaauggcauucggcgccccaaacaccuguaugucucuaugccuaccgcccaguccacaaugaaggcugacgaacucacccccggaagauuccggacaaucgugugcggccuguuuccugcccagauuaugcaucgcaacaucaucagcccgguuaugggggugauuggauucuccuuuuucgucaaagauuggcccgacaagaucgaggaauuucuuauuaaaccuugucccuuccugaagaaacagggcucuaccaaggaggaggaauuucucgugagcaaugaugcuuacaugcuggggagagagaaggcccugcgggaaucucaccucgcggagaucgacgaacugauugaucuugccgacuccggagauccuacgcccccggacagcaucaaauccccucaagcucccuggguguucgccugcgcuccugaucgcuguccucccacaugcaucuauauugccggcauggccgagcugggggcguuuuucucuauccuccaggacaugagaaacaccauuauggcuagcaagacagucggaaccgccgaggaaaaacugaagaaaaaguccagcuucuaccagucuuaucuucggagaacccaauccaugggcauccagcuggaucagcgcauuauccuccuguuuaugauggaguggggcagcgacaucguuaaucauuuccaccugggggacgauauggaccccgaacuccggacacuggcucagucucuuauugaucaaaaggugaaagagaucagcaaccaggaaccgcugaagauuuga

SEQ ID NO: 7321 - RNA, 1290 nt, Artificial Sequence
  derived and/or modified CDS sequence (opt5) from TULV(c109-s)__AF164094.1__N
augagccagcugaaggagauccaagaagagauuaccagacacgaacagcagaucgugauugcccggcagaaacucaaggacgcugagaaaacagucgaagccgaucccgacgauguuaacaaguccacgcugcaaucucgcagagcggcugugagcgcccuugaggacaaacuggccgauuucaagcggcagcucgcugaccugguguccucucagaagaugggcgagaaaccugucgauccgaccgggcuugaacccgacgaucaucugaaggagcgcagcucccucagauacggaaaugugcuggacguuaacgccaucgauauugacgaaccuucuggccagacagcugauugguuuagcaucgggcaauauaucaccggauucgcccuggcgauuauccucaaagcccuguacaugcuuuccacacggggccgccagaccauuaaggagaauaaagggacaagaauccgguuuaaggacgacagcucuuaugaggaaauuaacggaauccgcagacccaagcaccuguacguguccaugccuaccgcucagagcacgaugaaagccgaugagcucacccccggccgguuccgcacaauugucugcggccuguuuccugcucagaucaugcauagaaauaucauuucuccggugauggggguuaucggauucuccuuuuucgugaaggacuggcccgaaaagauugaggaauuucuuaucaagccuugucccuuccugaaaaagagcggcccuucuaaagaggaggauuuucucgucuccaacgacgccuaucugcuggggcgggaaaaggcgcuccgcgagagccaccuggccgaaauugaugaccuuaucgaucuggcugccuccggagaccccaccccgccugauucuaucaagagcccccaagcuccuuggguguucgccugcgcccccgacagaugucccccuacaugcauuuacaucgcuggcauggcggagcucggggccuuuuucuccauucugcaggauaugcggaauaccaucauggcuagcaaaacggugggaacaucugaagagaaacuuaaaaagaaauccagcuucuaucagucuuaccugagacgcacccaaagcaugggcauucagcucgaccagcggaucauccugcuguuuaugacagaguggggcuccgacauugucaaccauuuccaccucggggaugacauggauccggaacugagaacccuugcccagucucugaucgaccaaaagguuaaggagauuagcaaucaggaaccccucaaaaucuga

SEQ ID NO: 7322 - RNA, 1290 nt, Artificial Sequence
  derived and/or modified CDS sequence (opt5) from TULV(CHEVRU/Hu/FRA/2015/15.00453)__KT946591.1__N
augagccagcugaaggagauccaagaagagauuaccagacacgaacagcagaucgugauugcccggcagaaacucaaggacgcugagaaaacagucgaagccgaucccgacgauguuaacaaguccacgcugcaaucucgccaggcggcugugagcgcccuugaggacaaacuggccgauuucaagagaaagcucgcugaccugguguccucucagaaaaugggcgagaagccugucgauccgaccgggcuugaacccgacgaucaucugaaagagcggagcucccuccgcuacggaaaugugcuggacguuaacgccaucgauauugacgaaccuucuggccagacagcugauugguuuagcaucgggcaauaugugaugggauucgcccuggcgaucauucucaaggcccuguacaugcuuuccaccagaggccggcagacaaucaaagagaauaaggggacccgcauuagauuuaaggacgacagcucuuaugaggaaaucaacggcauucggcgccccaaacaccuguacgucuccaugccuacagcucagagcaccaugaaggccgaugagcucacgcccggaagauuccggaccaucgugugcggccuguuuccugcucagauuaugcaucgcaauaucaucucuccgguuaugggggugauuggauucuccuuuuucgucaaagacuggcccgaaaagaucgaggaauuucuuauuaaaccuugucccuuccugaagaaaagcggcccuucuaaggaggaggauuuucucguguccaacgacgccuaucugcuggggagagaaaaggcgcuccgggauagccaccuggccgagaucgacgaucuuauugaccuggcugaauccggagaucccacaccgccugacucuaucaaaagcccccaagccccuuggguguucgcuugcgcccccgaucgcugucccccuaccugcaucuacauugccggcauggcugagcucggggcguuuuucuccauccugcaggacaugagaaauacaauuauggccagcaagaccgucggaacggcugaagagaaacuuaagaaaaagucuuccuucuaucagagcuaccugcggagaacacaaucuaugggcauccagcucgaccagcgcauuauccugcuguuuaugaucgaguggggcagcgauauuguuaaccauuuccaccucggggacgauauggacccggaacugcggacccuugcccagucccugaucgaucaaaaggugaaagagauuucuaaucaggaaccccucaagaucuga

SEQ ID NO: 7323 - RNA, 1290 nt, Artificial Sequence
  derived and/or modified CDS sequence (opt5) from TULV(g20-s)__AF164093.1__N
augagccagcugaaggagauccaagaagagauuaccagacacgaacagcagaucgugauugcccggcagaaacucaaggacgcugagaaaacagucgaagccgaucccgacgauguuaacaaguccacgcugcaaucucgccaggcggcugugagcgcccuugaggacaaacuggccgauuucaagagaaagcucgcugaccugguguccucucagaaaaugggcgagaagccugucgauccgaccgggcuugaacccgacgaucaucugaaagagcggagcucccuccgcuacggaaaugugcuggacguuaacgccaucgauauugacgaaccuucuggccagacagcugauugguuuagcaucgggcaauaugugaugggauucgcccuggcgaucauucucaaggcccuguacaugcuuuccaccagaggccggcagacaaucaaagagaauaaggggacccgcauuagauuuaaggacgacagcucuuaugaggaaaucaacggcauucggcgccccaaacaccuguacgucuccaugccuacagcucagagcaccaugaaggccgaugagcucacgcccggaagauuccggaccaucgugugcggccuguuuccugcucagauuaugcaucgcaauaucaucucuccgguuaugggggugauuggauucuccuuuuucgucaaagacuggcccgaaaagaucgaggaauuucuuauuaaaccuugucccuuccugaagaaaagcggcccuucuaaggaggaggauuuucucguguccaacgacgccuaucugcuggggagagaaaaggcgcuccgggauagccaccuggccgagaucgacgaucuuauugaccuggcugaauccggagaucccacaccgccugacucuaucaaaagcccccaagccccuuggguguucgcuugcgcccccgaucgcugucccccuaccugcaucuacauugccggcauggcugagcucggggcguuuuucuccauccugcaggacaugagaaauacaauuauggccagcaagaccgucggaacggcugaagagaaacuuaagaaaaagucuuccuucuaucagagcuaccugcggagaacacaaucuaugggcauccagcucgaccagcgcauuauccugcuguuuaugaccgaguggggcagcgauaucguuaaccauuuccaccucggggacgauauggacccggaacugcggacacuugcccagucccugauugaucaaaaggugaaagagaucucuaaucaggaaccccucaagauuuga

SEQ ID NO: 7324 - RNA, 1293 nt, Artificial Sequence
  derived and/or modified CDS sequence (opt5) from TULV(Sennickerode Sen05/174)__EU439948.1__N
augagccagcugaaggagauccaagaagagauuaccagacacgaacagcagaucgugauugcccggcagaaacucaaggacgcugagaaaacagucgaagccgaucccgacgauguuaacaaguccacgcugcaaucucgcagagcggcugugagcgcccuugaggacaaacuggccgauuucaagcggcagcucgcugaccugguguccucucagaagaugggcgagaaaccugucgauccgaccgggcuugaacccgacgaucaucugaaggagcgcagcucccucagauacggaaaugugcuggacguuaacgccaucgauauugacgaaccuucuggccagacagcugauugguuuagcaucgggcaauauaucauuggauucgcccuggcgaucgugcucaaagcccuguacaugcuuuccacccggggccgccagacaauuaaggagaauaaagggaccagaauccgguuuaaggacgacagcucuuucgaggaaauuaacggaauccgcagacccaagcaccuguaugucuccaugccuacagcucagagcaccaugaaagccgaugagcucacgcccggccgguuucgcaccauugugugcggccuguucccugcucagaucaugcauagaaauaucauuucuccgguuaugggggugaucggauuuuccuucuuugucaaggacuggcccgauaaaauugaagaguuccuuaucaagccuugucccuuucugaaaaagcaaggcgggccuaacaaagacgaagauuuccucgugagcaaugacgccuacuuucugggacgggagaaggcgcugcgcgagucucaccucaacgaaauugaugaccugaucgagcuugccgcuuccggcgaucccacaccgccugacagcaucaagucuccccaggccccuuggguguucgcuugcgcccccgauagaugucccccuaccugcauuuaugucgccgggauggcugaacugggagcguucuuuuccauccuccaggacaugcggaauacaauuauggccagcaaaaccguuggcacggcugaggaaaagcugaaaaagaaauccagcuucuaccaaucuuaucuuagacgcacacaguccaugggcauccagcuggaccagcggauuauccuccuguuuaugauggagugggggagcgauaucgugaaccauuuccaccugggagacgauauggacccggagcucagaacccuggcccaaucucuuauugaucagaaggugaaggaaaucagcaaucaggagccccugaaaauuuga

SEQ ID NO: 7325 - RNA, 1293 nt, Artificial Sequence
  derived and/or modified CDS sequence (opt5) from TULV(Sennickerode Sen05/175)__EU439949.1__N
augagccagcugaaggagauccaagaagagauuaccagacacgaacagcagaucgugauugcccggcagaaacucaaggacgcugagaaaacagucgaagccgaucccgacgauguuaacaaguccacgcugcaaucucgcagagcggcugugagcgcccuugaggacaaacuggccgauuucaagcggcagcucgcugaccugguguccucucagaagaugggcgagaaaccugucgauccgaccgggcuugaacccgacgaucaucugaaggagcgcagcucccucagauacggaaaugugcuggacguuaacgccaucgauauugacgaaccuucuggccagacagcugauugguuuagcaucgggcaauauaucauuggauucgcccuggcgaucgugcucaaagcccuguacaugcuuuccacccggggccgccagacaauuaaggagaauaaagggaccagaauccgguuuaaggacgacagcucuuucgaggaaauuaacggaauccgcagacccaagcaccuguaugucuccaugccuacagcucagagcaccaugaaagccgaugagcucacgcccggccgguuucgcaccauugugugcggccuguucccugcucagaucaugcauagaaauaucauuucuccgguuaugggggugaucggauuuuccuucuuugucaaggacuggcccgauaaaauugaagaguuccuuaucaagccuugucccuuucugaaaaagcaaggcgggccuaacaaagacgaagauuuccucgugagcaaugacgccuacuuucugggacgggagaaggcgcugcgcgagucucaccucaacgaaauugaugaccugaucgagcuugccgcuuccggcgaucccacaccgccugacagcaucaagucuccccaggccccuuggguguucgcuugcgcccccgauagaugucccccuaccugcauuuaugucgccgggauggcugaacugggagcguucuuuuccauccuccaggacaugcggaaaagcauuauggccuccaagacaguuggcaccgcugaggaaaaacugaagaaaaagagcucuuucuaccaauccuaucuuagacgcacgcagagcaugggcauccagcuggaccagcggauuauccuccuguuuaugauggagugggggucugauaucgugaaucauuuccaccugggagacgauauggacccggagcucagaacacuggcccaaagccuuauugaucagaaggugaaagaaaucuccaaccaggagccccugaagauuuga

SEQ ID NO: 7326 - RNA, 1293 nt, Artificial Sequence
  derived and/or modified CDS sequence (opt5) from TULV(TUL/Karatal/Ma322/2003)__AM945877.1__N
augagccagcugaaggagauccaagaagagauuaccagacacgaacagcagaucgugauugcccggcagaaacucaaggacgcugagaaaacagucgaagccgaucccgacgauguuaacaagaauacgcugcaaucccgcagagcggcugugucugcccuugaggacaaacuggccgaguucaagcggcagcucgcugaucuggugagcucccagaagaugggcgaaaaaccugucgacccgaccgggcuugagcccgaugaccaucugaaggaacgcucuagccucagauacggaaacgugcuggauguuaaugccaucgacauugaugagccuuccggccagacagcugacugguuuucuaucgggcaauaugugaugggauucgcccuggcgaucguccucaaagcccuguacaugcuuagcacccggggccgccagacaauuaaggagaacaaagggaccagaauccgguuuaaggaugacuccagcuucgaagagauuaauggaauccgcagacccaagcaccuguaugugucuaugccuacagcucaguccaccaugaaagccgacgaacucacgcccggccgguuucgcaccauuguuugcggccuguucccugcucagaucaugcauagaaacauuaucagcccggugaugggggucaucggauuuucuuucuuugugaaggauuggcccgagaaaauugaagaguuccuuaucaagccuugucccuuucugaaaaagcaaggcuccagcgggaaagaggaagaguuccucgugucuaaugacgccuaccugauuggacgggaaaagacacugcaggagucccaccucaccgaaaucgaugaccugauugaucuugcggacagcggcgauccuacacccccggacuccaucaagucuccucaggcccccugggucuuugcuugcgccccugaucgcugucccccuaccugcaucuauauugcugggauggccgagcugggagccuucuucagcauccuccaagacaugagaaacacgauuauggcuuccaaaacaguuggcaccgcggaggaaaagcugaaaaagaaaagcucuuuuuaccaguccuaucuucggagaacacagagcaugggcauccagcuggaucaacgcauuauccuccuguucaugauggagugggggucugacaucgugaaucauuuucaccugggagacgauauggaccccgaacuccggacccuggcccagagccuuauugaucagaaggugaaggagaucuccaaccaggaaccgcugaaaauuuga

SEQ ID NO: 7327 - RNA, 1293 nt, Artificial Sequence
  derived and/or modified CDS sequence (opt5) from TULV(Tula/Kosice144/Ma/95)__Y13979.1__N
augagccagcugaaggagauccaagaagagauuaccagacacgaacagcagaucgugauugcccggcagaaacucaaggacgcugagaaaacagucgaagccgaucccgacgauguuaacaaguccacgcugcaaucucgcagagcggcugugagcgcccuugaggacaaacuggccgauuucaagcggcagcucgcugaccugguguccucucagaagaugggcgagaaaccugucgauccgaccgggcuugaacccgacgaucaucugaaggagcgcagcucccucagauacggaaaugugcuggacguuaacgccaucgauauugacgaaccuucuggccagacagcugauugguuuagcaucgggcaauauaucauuggauucgcccuggcgaucgugcucaaagcccuguacaugcuuuccacccggggccgccagacaauuaaggagaauaaagggaccagaauccgguuuaaggacgacagcucuuucgaggaaauuaacggaauccgcagacccaagcaccuguaugucuccaugccuacagcucagagcaccaugaaagccgaugagcucacgcccggccgguuucgcaccauugugugcggccuguucccugcucagaucaugcauagaaauaucauuucuccgguuaugggggugaucggauuuuccuucuuugucaaggacuggcccgaaaagauugaggaguuccuuaucaagccuugucccuuucugaaaaagcaaggcgccccugggaaagaagaggauuuccucgugagcaacgacgcguaccugcugggacgggaaaaggcccuccgcgagucucaccuggcugaaauugaugaccuuaucgaucuggccgcuuccggcgaccccacaccgccugauagcaucaagucuccccaggccccuuggguguuugccugcgcucccgacagaugucccccuaccugcauuuauaucgcggggauggccgagcucggagcuuucuucuccauucugcaggauaugcggaauacaaucauggccagcaaaaccgucggcacggccgaagagaaacuuaaaaagaaauccagcuuuuaccaaucuuaucugagacgcacacaguccaugggcauucagcucgaccagcggaucauccugcuguucaugaccgagugggggagcgacauuguuaaccauuuucaccucggagaugacauggauccggaacugagaacacuugcucaaucucugaucgaccagaaggugaaggagauuagcaaucaggaaccccucaaaaucuga

SEQ ID NO: 7328 - RNA, 1293 nt, Artificial Sequence
  derived and/or modified CDS sequence (opt5) from TULV(Tula/Kosice667/Ma/95)__Y13980.1__N
augagccagcugaaggagauccaagaagagauuaccagacacgaacagcagaucgugauugcccggcagaaacucaaggacgcugagaaaacagucgaagccgaucccgacgauguuaacaaguccacgcugcaaucucgcagagcggcugugagcgcccuugaggacaaacuggccgauuucaagcggcagcucgcugaccugguguccucucagaagaugggcgagaaaccugucgauccgaccgggcuugaacccgacgaucaucugaaggagcgcagcucccucagauacggaaaugugcuggacguuaacgccaucgauauugacgaaccuucuggccagacagcugauugguuuagcaucgggcaauauaucauuggauucgcccuggcgaucgugcucaaagcccuguacaugcuuuccacccggggccgccagacaauuaaggagaauaaagggaccagaauccgguuuaaggacgacagcucuuucgaggaaauuaacggaauccgcagacccaagcaccuguaugucuccaugccuacagcucagagcaccaugaaagccgaugagcucacgcccggccgguuucgcaccauugugugcggccuguucccugcucagaucaugcauagaaauaucauuucuccgguuaugggggugaucggauuuuccuucuuugucaaggacuggcccgaaaagauugaggaguuccuuaucaagccuugucccuuucugaaaaagcaaggcgccccugggaaagaagaggauuuccucgugagcaacgacgcguaccugcugggacgggaaaaggcccuccgcgagucucaccuggcugaaauugaugaccuuaucgaucuggccgcuuccggcgaccccacaccgccugauagcaucaagucuccccaggccccuuggguguuugccugcgcucccgacagaugucccccuaccugcauuuauaucgcggggauggccgagcucggagcuuucuucuccauucugcaggauaugcgggacacaaucauggccagcaaaaccgucggcacggccgaagagaaacuuaaaaagaaauccagcuuuuaccaaucuuaucugagacgcacacaguccaugggcauucagcucgaccagcggaucauccugcuguucaugaccgagugggggagcgauauuguuaaucauuuucaccucggagacgauauggacccggaacugagaacacuugcucaaucucugaucgaucagaaggugaaggagauuagcaaccaggaaccccucaaaaucuga

SEQ ID NO: 7329 - RNA, 1290 nt, Artificial Sequence
  derived and/or modified CDS sequence (opt5) from TULV(Tula/Koziky/5247Ma/94)__AJ223600.1__N
augagccagcugaaggagauccaagaagagauuaccagacacgaacagcagaucgugauugcccggcagaaacucaaggacgcugagaaaacagucgaagccgaucccgacgauguuaacaaguccacgcugcaaucucgcagagcggcugugagcgcccuugaggacaaacuggccgauuucaagcggcagcucgcugaccugguguccucucagaagaugggcgagaaaccugucgauccgaccgggcuugaacccgacgaucaucugaaggagcgcagcucccucagauacggaaaugugcuggacguuaacgccaucgauauugacgaaccuucuggccagacagcugauugguuuagcaucgggcaauauaucaccggauucgcccuggcgauuauccucaaagcccuguacaugcuuuccacacggggccgccagaccauuaaggagaauaaagggacaagaauccgguuuaaggacgacagcucuuaugaggaaauuaacggaauccgcagacccaagcaccuguacguguccaugccuaccgcucagagcacgaugaaagccgaugagcucacccccggccgguuccgcacaauugucugcggccuguuuccugcucagaucaugcauagaaauaucauuucuccggugauggggguuaucggauucuccuuuuucgugaaggacuggcccgaaaagauugaggaauuucuuaucaagccuugucccuuccugaaaaagaacggcccuagcaaagaggaggauuuucucgucucuaaugacgccuaucugcuggggcgggaaaaggcgcuccgcgagucccaccuggccgaaauugaugaccuuaucgaucuggcugccagcgaggaccccaccccgccugauuccaucaagucuccccaagcuccuuggguguucgccugcagacccgaccggugucccccuacaugcauuuacaucgccggaauggcugaacucggcgcguuuuucagcauucugcaggauaugagaaacaccaucauggccuccaaaacgguggggacagcugaggagaaacuuaaaaagaaaagcucuuucuaucaguccuaccugcgccggacccaaagcaugggcauucagcucgaccagagaaucauccugcuguuuaugacagaauggggaucugacauugucaaucauuuccaccucggcgaugacaugagcccggagcugcgcacccuugcccagucccugaucgaucaaaagguuaaggaaauuucuaaccaggagccccucaaaaucuga

SEQ ID NO: 7330 - RNA, 1290 nt, Artificial Sequence
  derived and/or modified CDS sequence (opt5) from TULV(Tula/Moravia/5302v/95)__Z69991.1__N
augagccagcugaaggagauccaagaagagauuaccagacacgaacagcagaucgugauugcccggcagaaacucaaggacgucgagaaaacaguugaagcugaucccgacgaugugaacaaguccacgcugcaaucucgcagagccgcggugagcgcucuugaggacaaacuggccgauuucaagcggcagcucgccgaccuggucuccucucagaagaugggcgagaaaccuguggauccgaccgggcuugaacccgacgaucaucugaaggagcgcagcucccucagauacggaaauguucuggacgugaacgcuaucgauauugacgaaccuucuggccagacagccgauugguuuagcaucgggcaauauaucaccggauucgcucuggccauuauccucaaagcgcuguacaugcuuuccacacggggccgccagaccauuaaggagaauaaagggacaagaauccgguuuaaggacgacagcucuuaugaggaaauuaacggaauccgcagacccaagcaccuguacgucuccaugccuaccgcccagagcacgaugaaagcugaugagcucacccccggccgguuccgcacaauugugugcggccuguuuccugcccagaucauguauagaaauaucauuucuccgguuaugggggugaucggauucuccuuuuucgucaaggacuggcccgaaaagauugaggaauuucuuaucaagccuugucccuuccugaaaaagagcggcccuucuaaagaggaggauuuucucguguccaacgacgcuuaccugcuggggcgggaaaaggcccuccgcgagagccaucuggcggaaauugaugaccuuaucgaucuggccgcuuccggagaccccaccccgccugauucuaucaagagcccccaagccccuuggguguucgcuugcagacccgaccggugucccccuacaugcauuuauaucgccggcauggccgagcucggggcguuuuucuccauucugcaggauaugagaaauaccaucauggcuagcaaaacggucggaacagccgaagagaaacuuaaaaagaaaucuuccuucuaccagagcuaccugcgccggacccaaucuaugggcauucagcucgaccagagaaucauccugcuguuuaugacagaguggggcagcgacauuguuaaccacuuccaucucggggaugacauggauccggaacugcgcacccuugcucagucccugaucgaccaaaaggugaaggagauuucuaaucaggaaccccucaaaaucuga

SEQ ID NO: 7331 - RNA, 1293 nt, Artificial Sequence
  derived and/or modified CDS sequence (opt5) from TULV__AF017659.1__N
augagccagcugaaggagauccaagaagagauuaccagacacgaacagcagaucgugauugcccggcagaaacucaaggacgcugagaaaacagucgaagccgaucccgacgauguuaacaaguccacgcugcaaucucgcagagcggcugugagcgcccuugaggacaaacuggccgauuucaagcggcagcucgcugaccugguguccucucagaagaugggcgagaaaccugucgauccgaccgggcuugaacccgacgaucaucugaaggagcgcagcucccucagauacggaaaugugcuggacguuaacgccaucgauauugacgaaccuucuggccagacagcugauugguuuagcaucgggcaauauaucauuggauucgcccuggcgaucgugcucaaagcccuguacaugcuuuccacccggggccgccagacaauuaaggagaauaaagggaccagaauccgguuuaaggacgacagcucuuucgaggaaauuaacggaauccgcagacccaagcaccuguaugucuccaugccuacagcucagagcaccaugaaagccgaugagcucacgcccggccgguuucgcaccauugugugcggccuguucccugcucagaucaugcauagaaauaucauuucuccgguuaugggggugaucggauuuuccuucuuugucaaggacuggcccgaaaagauugaggaguuccuuaucaagccuugucccuuucugaaaaagcaaggcgccccugggaaagaagaggauuuccucgugagcaacgacgcguaccugcugggacgggaaaaggcccuccgcgagucucaccuggcugaaauugaugaccuuaucgaucuggccgcuuccggcgaccccacaccgccugauagcaucaagucuccccaggccccuuggguguuugccugcgcucccgacagaugucccccuaccugcauuuaugucgcggggauggccgagcucggagcuuucuucuccauccugcaggauaugcggaauacaauuauggccagcaaaaccguuggcacggccgaagagaaacuuaaaaagaaauccagcuuuuaccaaucuuaucugagacgcacacaguccaugggcauccagcucgaccagcggauuauccugcuguucaugaccgagugggggagcgacaucgugaaccauuuucaccucggagaugacauggauccggaacugagaacacuugcucaaucucugauugaccagaaggugaaggagaucagcaaucaggaaccccucaaaauuuga

SEQ ID NO: 7332 - RNA, 1293 nt, Artificial Sequence
  derived and/or modified CDS sequence (opt5) from TULV(Lodz-1)__AF063892.1__N
augaccgagcugaaggaaauccaggaggaaauuacaagacacgagcaacagaucgugauugcccggcagaaacucaaggacgcugaaaagacggucgaggccgaucccgacgauguuaacaagagcacccugcagucccgcagagcggcugugucugcccuugaggacaaacuggccgauuucaagcggcaacucgcugaccuggugagcucccagaagaugggcgaaaaaccugucgauccgacagggcuugagcccgacgaucaucugaaggaacgcucuagccucagauacggaaaugugcuggacguuaacgccaucgauauugacgagccuuccggccagaccgcugauugguuuucuaucgggcaguauaucaugggauucgcccuggcgauugugcucaaagcccuguacaugcuuagcacacggggccgccaaaccaucaaggagaauaaagggacacgcauucgguuuaaggacgacuccagcuaugaagagaucaacggaauuagaagacccaagcaccuguacgucucuaugccuaccgcucaguccacgaugaaagccgaugaacucacccccggccgguuccgcacaaucgugugcggccuguuuccugcucagauuaugcauagaaauaucaucagcccgguuaugggggugauuggauucuccuuuuucgucaaggacuggcccgauaaaaucgaggaauuucuuauuaagccuugucccuuccugaaaaagcagggcgggccuaacaaagacgaggaguuucucgugucuaaugaugccuaucugcugggacgggaaaaggcgcuccgcgagagccaccuggccgaaaucgacgaucuuauugaccuggcugccucuggcgaucccaccccgccugacuccaucaagagcccccaagcuccuuggguguucgccugcgcccccgauagaugucccccuacaugcaucuacgucgcugggauggcggagcucggagccuuuuucuccauucugcaggacaugcggaacaccaucauggcuucuaaaacgguuggcacagccgaagagaaacuuaaaaagaaaagcuccuucuaucagagcuaccugagacgcacccaaucuaugggcauucagcucgaccagcggaucauucugcuguuuaugauggaguggggguccgauaucgugaaucauuuccaccucggagacgauauggacccggaacugagaacacuugcccagagccugaucgaucaaaaggugaaggagauuucuaaccaggaaccccucaaaaucuga

SEQ ID NO: 7333 - RNA, 1293 nt, Artificial Sequence
  derived and/or modified CDS sequence (opt5) from TULV(Lodz-2)__AF063897.1__N
augaccgagcugaaggaaauccaggaggaaauuacaagacacgagcaacagaucgugauugcccggcagaaacucaaggacgcugaaaagacggucgaggccgaucccgacgauguuaacaagagcacccugcagucccgcugggcggcugugucugcccuugaggacaaacuggccgauuucaagagacaacucgcugaccuggugagcucccagaagaugggcgaaaaaccugucgauccgacagggcuugagcccgacgaucaucugaaggaacggucuagccuccgcuacggaaaugugcuggacguuaacgccaucgauauugacgagccuuccggccagaccgcugauugguuuucuaucgggcaguauaucaugggauucgcccuggcgauugugcucaaagcccuguacaugcuuagcacaagaggccggcaaaccaucaaggagaauaaagggacacgcauuagauuuaaggacgacuccagcuaugaagagaucaacggcauucggcgccccaagcaccuguacgucucuaugccuaccgcucaguccacgaugaaagccgaugaacucacccccggaagauuccggacaaucgugugcggccuguuuccugcucagauuaugcaucgcaauaucaucagcccgguuaugggggugauuggauucuccuuuuucgucaaggacuggcccgauaaaaucgaggaauuucuuauuaagccuugucccuuccugaaaaagcagggcgggccuaacaaagacgaggaguuucucgugucuaaugaugccuaucugcugggaagagaaaaggcgcuccgggagagccaccuggccgaaaucgacgaucuuauugaccuggcugccucuggcgaucccaccccgccugacuccaucaagagcccccaagcuccuuggguguucgccugcgcccccgaucgcugucccccuacaugcaucuacgucgcugggauggcggagcucggagccuuuuucuccauucugcaggacaugagaaacaccaucauggcuucuaaaacgguuggcacagccgaagagaaacuuaaaaagaaaagcuccuucuaucagagcuaccugcggagaacccaaucuaugggcauucagcucgaccagcgcaucauucugcuguuuaugauggaguggggguccgauaucgugaaucauuuccaccucggagacgauauggacccggaacugcggacacuugcccagagccugaucgaucaaaaggugaaggagauuucuaaccaggaaccccucaaaaucuga

SEQ ID NO: 7334 - RNA, 1449 nt, Artificial Sequence
  derived and/or modified CDS sequence (opt5) from CCHFV(IbAr10200)__NC_005302.1/U88410.1__N
auggagaacaagaucgaagugaauaacaaagacgagaugaauagaugguucgaagaguuuaagaaaggcaacgggcuggucgauaccuucacaaauagcuacuccuuuugcgaaucuguucccaaccucgaccgguucguguuucagauggccagcgcuacggaugacgcccaaaaggauuccauuuaugcgucugcucugguggaggccaccaaauucugugccccuaucuacgagugcgcuugggucagcuccacaggaauugugaagaagggccuugaaugguuugagaaaaaugccgggaccaucaagucuugggacgaaagcuauacagagcugaaaguugaugugccgaagauugagcagcucaccggauaccagcaggcugcccugaaauggcgcaaggacaucggcuucagagucaacgcgaauacagccgcucuuuccaacaaggugcuggccgaauauaaaguucccggggagaucgugaugagcgucaaggaaaugcucucugauaugauucggcgcagaaaucugauccugaaccggggaggcgacgagaauccucgcggccccgugucccacgaacacguggauugguguagagaguuugucaaagggaaguacauuauggcuuucaacccucccuggggagacaucaauaaaagcggccggucugggauugcccucguugcgaccggacuggccaaacuugcugagacggaaggcaaagggaucuuugaugaggccaagaagaccguggaagcucugaacggauaucucgacaaacacaaggacgagguggaucgcgccuccgccgacagcaugauuacaaaccugcuuaaacauaucgcuaaggcgcaagaacuguacaaaaauucuuccgcccucagagcucagagcgcccagaucgauaccgccuucuccucuuacuauuggcuguacaaggcuggcgucacaccugagaccuuuccgacggugagccaguuccuguucgagcucggcaagcaaccccgggggacaaagaagaugaaaaaggcccugcuuuccaccccuaugaaauggggaaagaagcuguaugaacucuuugcggacgauagcuuccagcagaaccgcauuuacaugcaccccgcuguucugacagccggcagaaucucugagaugggggugugcuuuggaaccauuccugucgccaaucccgacgaugcugcccagggcuccgggcauaccaaaagcauccuuaaccugcggacaaauacggaaaccaacaauccgugugcuaagacaauugugaaacucuucgagguucaaaagaccggauuuaacauccaggacauggauaucguggccucugaacaucugcugcaccagagccucgucggcaaacaauccccuuuccagaaugcguauaacgugaagggcaaugccacaucugcuaacauuaucuga

SEQ ID NO: 7335 - RNA, 1449 nt, Artificial Sequence
  derived and/or modified CDS sequence (opt5) from CCHFV(Turkey-Kelkit06)__GQ337053.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaagacucugggaccaucaagagcugggaugaaaauuaugccgagcugaaaguggacguuccgaagauugagcagcucgcuaacuaccagcaggccgcgcugaaguggagaaaagauaucggauuccgggugaaugccaacacagcugcccuuuccaauaagguccuggcugaauauaaagugcccggcgagaucguuaugagcgugaaggaaaugcucucugacaugauucgcagacggaaccugauccugaaucgcgggggagaugagaacccuagaggccccgucucccgggaacacguggaguggugucgcgaguuugugaaaggcaaguacauuauggccuucaauccucccuggggagacaucaacaaaagcgggagaucuggcauugcgcucgucgccaccgggcuggcuaaacuugccgaaacagagggaaagggcguuuuugaugaagcuaagaagaccguggaggcccugaacggguaucucgacaaacaucgggacgaaguggauaaggccuccgcugacagcaugaucacgaaucugccuaaacacauugcgaaggcccaagagcuuuacaagaacucuuccgcucugcgcgcccagggagcccagaucgauaccccguucagcuccuuuuacuggcucuauaaagcuggcgucacacccgagaccuucccuacaaucucucaguuccuguuugaacugggcgagcaacccagagggaccaagaaaaugaagaaagcccuccugagcacgccuaugaaguggggaaagaaacuuuacgaacuguucgcggacgauuccuuucagcagaaucggauuuauaugcaucccgcugugcucacagccggccgcaucagcgagauggggguuugcuucggaaccauuccgguggccaacccugacgaugcugcccagggcucugggcacacaaaguccauccugaaucuuagaaccagcaccgaaacaaacaaucccugugcuaaaacgauugucaagcuguuugagauccaagagaccggauucaacauccaggacauggauauuguggccucugaacaucuccugcaccagagcaucguuggcaaacaauccccuuuucagaaugcguacaacgugaagggcaaugccacaucugcuaacauuaucuga

SEQ ID NO: 7336 - RNA, 1449 nt, Artificial Sequence
  derived and/or modified CDS sequence (opt5) from CCHFV(Baghdad 12)__AJ538196.1__N
auggagaacaagaucgaagugaauagcaaagacgagaugaacaagugguucgaagaguuuaaaaagggcaaugggcuggucgauaccuacacaaacuccuauucuuucugcgaaagcguucccaaucucgacagauuuguguuccagauggccggagcuacggaugacgcccaaaaagauuccauuuacgcgucugcucugguggaggccaccaaguuuugugccccuaucuaugagugcgcuugggccagcuccacaggcauugucaagaaagggcuugaaugguucgagaagaacaccggaacaaucaaaucuugggacgaaagcuacaccgagcugaagguggagguuccgaaaauugaacagcucuuuaauuaucagcaggcugcccugaaguggcggaaggauaucggcuuccgcgugaacgcgaauacagccgcucuuuccaacaaaguccuggccgaguacaaggugcccggggaaaucguuaugagcgugaaagagaugcucucugacaugauuagacggcgcaaucugauccugaacagaggaggcgaugaaaauccucggggccccgucucccgcgagcacguggagugguguagagaauuugugaaggggaaauauauuauggcuuucaacccucccuggggagacaucaauaagagcggccggucugggauugcccucgucgcgaccggacuggccaaacuugcugagacggaaggcaaggggguuuuugaugaggccaagaaaaccguggaagcucugaacggauaccucgacaagcauaaagaugagguggacaaggccuccgccgacaacauggucacaaaucugcuuaaacacguggcuaaggcgcaagagcuguacaagaacagcucugcccuccgcgcucagggcgcccagaucgauaccguuuucuccagcuauuacuggcuguauaaagccggcgugacaccugaaaccuuuccgacggucucccaguuccuguucgagcucgggaagcaucccagaggaaccaaaaagaugaaaaaggcucugcuuucuacaccuaugaaguggggcaaaaagcuguacgaacucuuugccgacgauagcuuccaacagaaucggauuuauaugcaccccgcggugcugacagcugggcgcaucuccgagaugggaguuugcuuuggcaccaucccuguggccaaccccgacgaugccgcucuugggagcggacauaccaaaucuauucugaaucucagaacaaacacggaaaccaauaacccgugugcccggacaaucgucaagcuguucgagauucagaaaaccggcuuuaauauccagcacauggacauuguggcuuccgagcaucugcuccaccaaagccuggucggcaagcagucuccuuuccagaacgccuacaaugugaaggggaacgcgacaagcgccaauaucaucuga

SEQ ID NO: 7337 - RNA, 1449 nt, Artificial Sequence
  derived and/or modified CDS sequence (opt5) from CCHFV(SR3)__AJ538198.1__N
auggagaacaagaucgaagugaauagcaaagacgagaugaacaagugguucgaagaguuuaaaaagggcaaugggcuggucgauaccuucacaaacuccuacucuuuuugcgaaagcguucccaaucucgacagauucguguuucagauggccuccgcuacggaugacgcccaaaaagauucuauuuaugcgagcgcucugguggaggccaccaaguucugugccccuaucuacgagugcgcuugggccuccucuacaggaauugucaagaaaggccuugaaugguuugagaagaacgcugggaccaucaaaagcugggacgaauccuauacagagcugaagguggagguuccgaaaauugaacagcucagcaauuaccagcaggccgcgcugaaguggcggaaggauaucggauuccgcgugaacgccaauaccgcugcccuuucuaacaaaguccuggcugaguauaaggugcccggcgaaaucguuauguccgugaaagagaugcucagcgacaugauuagacggcgcaaucugauccugaacagagggggagaugaaaauccucggggccccgucucucgcgagcacguggagugguguagagaauuugugaagggcaaauacauuauggccuucaacccucccuggggagacaucaauaaguccggacggagcggcauugcgcucgucgccacagggcuggcuaaacuugccgagaccgaaggaaagggcguuuuugaugaggcuaagaaaacgguggaagcccugaacggguaucucgacaagcauaaagaugagguggacaaggccucugcugacuccaugaucaccaaccugcuuaaacacauugcgaaggcccaagagcuguacaagaauagcuccgcucuccgcgcccagggagcccagaucgauacagucuucucuagcuacuauuggcuguacaaagcuggcgugaccccugacacauuuccggccguuucccaguuccuguucgaacucggcaagcaacccagagggaccaaaaagaugaaaaaggcgcugcuuagcacgccuaugaagugggggaaaaagcuguaugagcucuuugcugaugacucuuuccagcagaaccggaucuacaugcaucccgccgugcugacagccggccgcauuuccgaaaugggggucugcuuuggaaccaucccuguggcuaaucccgaugacgccgcucuuggcagcgggcacacaaaaucuauucugaaccucagaaccaauaccgagacaaacaauccgugugccaagacgaucguuaaacuguucgaaauucagaagaccggauuuaacauccaagauauggacaucguggcgagcgagcaucugcuccaccagucccuggucggcaagcagucuccuuuccaaaaugccuauaacgugaaaggcaaugcuacaagcgccaacauuaucuga

SEQ ID NO: 7338 - RNA, 1449 nt, Artificial Sequence
  derived and/or modified CDS sequence (opt5) from CCHFV(Gaib)__KX013446.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagaaaggccuugaaugguuugagaagaaugccgggaccaucaaaucuugggacgaaagcuauacagagcugaagguugaggugccgaaaauugaacagcucgcuaacuaccagcaggccgcgcugaaguggcggaaggauaucggauuccgcgucaaugccaacaccgcugcccuuucccacaaagugcuggcugaguauaagguucccggcgaaaucgugaugagcgucaaagagaugcucucugacaugauuagacggcgcaaucugauccugaacagagggggagaugaaaauccucggggccccgugucccgcgagcacguggagugguguagagaauuugucaagggcaaauacauuauggccuucaacccucccuggggagacaucaauaagagcggacggucuggcauugcgcucguugccacagggcuggcuaaacuugccgagaccgaaggaaagggcguguuugaugaggcuaagaaaacgguggaagcccugaacggguaucucgacaagcacaaagaugaggucgacaaggccuccgcugacaacaugaucaccaaucugcuuaaacauauugcgaaggcccaagagcuguacaagaacagcucugcucuccgcgcccagggagcccagaucgauacagcuuucuccagcuacuauuggcuguacaaagccggcgugaccccugaaacauuuccgaccguuucccaguuccuguucgagcucggcaagcaacccagagggacgaaaaagaugaaaaaggcgcugcuuucuacaccuaugaagugggggaaaaagcuguaugaacucuuugcugacgauagcuuccagcagaaucggaucuacaugcaccccgccgugcugaccgccggccgcauuuccgagaugggggucugcuuuggaacaaucccuguggcuaaccccgacgaugccgcucagggcagcgggcauaccaaaucuauucuuaaucugagaaccaacacagaaacgaauaacccgugugccaagaccaucguuaaacucuucgagauucaaaagacaggauuuaauauccaggacauggauaucguggcguccgagcaucugcugcaccagagccucgucggcaagcaaucuccuuuccagaacgccuauaaugugaaaggcaacgcuaccagcgccaauauuaucuga

SEQ ID NO: 7339 - RNA, 1449 nt, Artificial Sequence
  derived and/or modified CDS sequence (opt5) from CCHFV(Hodzha)__KX013449.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagaaaggccuugaaugguuugagaagaaugccgggaccaucaaaucuugggacgaaagcuauacagagcugaagguugaggugccgaaaauugaacagcucgcuaacuaccagcaggccgcgcugaaguggcggaaggauaucggauucugugucaaugccaacaccgcugcccuuucccaaaaagugcugagcgaguauaagguucccggcgaaaucgugaugucugucaaagagaugcucuccgacaugauucgcagacggaaucugauccugaaccgcgggggagaugaaaauccuagaggccccgugagccgggagcacguggaguggugccgcgaauuugucaagggcaaauacauuauggcuuucaacccucccuggggagacaucaauaagucuggaagauccggcauugcccucguugcgacagggcuggccaaacuugcugagaccgaaggaaagggcguguuugaugaggccaagaaaacgguggaagcucugaacggguaucucgacaagcauaaagaugaggucgacaaggccagcgccgacaacaugaccacaaaucugcuuaaacacaucgcuaaggcgcaggagcuguacaagaacucuuccgcccuccgggcucagggagcccagauugauaccgccuucagcuccuacuauuggcuguacaaagcuggcgugacaccugaaaccuuuccgacgguuucucaauuccuguucgagcucggcaagcagccccgcgggaccaaaaagaugaaaaaggcccugcuuagcacaccuaugaagugggggaaaaagcuguaugaacucuuugcggacgauuccuuccagcagaauagaaucuacaugcaucccgcugugcugacaaccggccggaucagcgagaugggggucuguuuuggaaccgugccuguugccgaccccgaugacgccgcucaaggcucugggcacacaaaauccauucuuaaccugcgcacgaauaccgaaacaaacaauccgugcgccaagaccaucgugaaacucuucgagauucagaagacaggauuuaacauccaggauauggacauugucgcuagcgagcaucugcugcaccaaucucucgugggcaagcagagcccuuuccagaaugccuauaacgucaaaggcaaugcgaccuccgccaacaucaucuga

SEQ ID NO: 7340 - RNA, 1449 nt, Artificial Sequence
  derived and/or modified CDS sequence (opt5) from CCHFV(IbAn7620)__KX013452.1__N
auggagaacaagaucgaagugaauaacaaagacgagaugaauagaugguucgaagaguuuaagaaagaaaacggccuggucgauaccuucacaaauagccacuccuuuugcgagucuguucccaaccucgacaaguucguguuucagauggccagcgcuacggaugacgcccaaaaagauuccauuuacgcggcugcccugguggaggccaccaaguucugugcuccuaucuaugaaugcgccugggucucuagcacagggauugugaagaaaggacuugagugguuugaaaagaaugcuggcaccaucaaauccugggacgagucuuacacagagcugaagguugaagugccgaaaauugagcagcucagcaacuaucagcaggccgcgcugaaguggcggaaggauaucggguuccgcgucaaugccaacaccgcuacacuuucccauaaagugcuggccgaauacaagguucccggagagaucgugaugagcgucaaagaaaugcucucugacaugauuagacggcgcaaucugauccugaacagaggcggggaugagaauccucggggacccgugucccgcgagcacguggaaugguguagagaguuugucaagggcaaauauauuauggcuuucaacccucccuggggcgacaucaauaagagcgggcggucuggaauugcccucguugcgaccggccuggccaaacuugcugaagccgaggggaagggaguguuugaugaagcuaagaaaacgguggaggcccugaacggcuaccucgacaagcauaaagaugaggucgacaaguccagcgccgacucuaugaucaccaaccugcuuaaacacauugcuaaggcgcaagaacuguauaaaaauuccagcgcccuccgcgcucagggggcccagaucgauacagccuucuccucuuacuacuggcuguauaaggcuggagugaccccugagacauuuccgaccguuagccaguuccuguucgaacucggcaagcaacccagaggcacgaaaaagaugaaaaaggcccugcuuuccacaccuaugaagugggggaaaaagcuguacgagcucuuugcggacgauagcuuccagcagaaccggaucuauaugcaucccgcugugcugaccgccggacgcauuucugaaaugggcgucugcuuugggacaaucccuguggccaaucccgacgaugcugcccuuggauccggccacaccaaaagcauucugaaccucagaaccucuacagaggcuaauaacccgugugccaagacgaucguuaaacuguucgagauucagaagaagggguuugugaucaaagacauggauaucgucgcgagcgaacaucugcuccaccaaucccuggugggaaagcagucuccuuuccagaaugccuacaacgucaaaggcaaugcuaccagcgccaacauuaucuga

SEQ ID NO: 7341 - RNA, 1449 nt, Artificial Sequence
  derived and/or modified CDS sequence (opt5) from CCHFV(K128_76)__KX013455.1__N
auggagaacaagaucgaagugaauaacaaagacgagaugaauaagugguucgaagaguuuaaaaagggcaacgggcuggucgauaccuucacaaauagcuacuccuuuugcgaaucuguucccagccucgacagauucguguuucagauggccuccgcuacggaugacgcccaaaaagauucuauuuaugcgagcgcucugguggaggccaccaaguucugugccccuaucuacgagugcgcuugggucuccucuacaggaauugugaagaaaggccuugaaugguuugagaagaacgccgggaccaucaaaagcugggacgaauccuauacagagcugaagguugaggugccgaaaauugaacagcucgcuaauuaccagcaggccgcgcugaaguggcggaaggauaucggauuccgcgucaacgccaauaccgcugcccuuagccacaaagugcuggcugaguauaagguucccggcgaaaucgugaugucugucaaagagaugcucuccgacaugauuagacggcgcaaccugauccugaauagagggggagaugaaaacccucggggccccgugagccgcgagcacguggagugguguagagaauuugucaagggcaaauacauuauggccuucaauccucccuggggagacaucaacaagucuggacgguccggcauugcgcucguugccacagggcuggcuaaacuugccgagaccgaaggaaagggcguguuugaugaggcuaagaaaacgguggaagcccugaauggguaucucgacaagcacaaagaugaggucgacaaggccagcgcugacaacaugaucaccaaccugcuuaaacauauugcgaaggcccaagagcuguacaaaaauucuuccgcucuccgcgcccagggagcccagaucgauacagcuuucagcuccuacuauuggcuguacaaggccggcgugaccccugaaacauuuccgaccguuucucaguuccuguucgagcucggcaagcaacccagagggacgaaaaagaugaaaaaggcgcugcuuagcacaccuaugaagugggggaaaaagcuguaugaacucuuugcugacgauuccuuccagcagaaccggaucuacaugcaccccgccgugcugaccgccggccgcauuagcgagaugggggucugcuuuggaacaaucccuguggcuaaucccgacgaugccgcucagggcucugggcauaccaaauccauucuuaaccugagaaccaauacagaaacgaacaauccgugugccaagaccaucguuaaacucuucgagauucaaaagacaggauuuaacauccaggacauggauaucguggcgagcgagcaucugcugcaccagucucucgucggcaagcaaagcccuuuccagaaugccuauaacgugaaaggcaaugcuaccuccgccaacauuaucuga

SEQ ID NO: 7342 - RNA, 1449 nt, Artificial Sequence
  derived and/or modified CDS sequence (opt5) from CCHFV(K168_125)__KX013461.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagaaaggccuugaaugguuugagaagaaugccgggaccaucaaaucuugggacgaaagcuauacagagcugaagguugaggugccgaaaauugaacagcucgcuaacuaccagcaggccgcgcugaaguggcggaaggauaucggauuccgcgucaaugccaacaccgcugcccuuucccacaaagugcuggcugaguauaagguucccggcgacaucgugaugagcgucaaagaaaugcucucugauaugauuagacggcgcaaucugauccugaacagagggggagacgagaauccucggggccccgugucccgcgaacacguggagugguguagagaguuugucaagggcaaauacauuauggccuucaacccucccuggggagauaucaauaagagcggacggucuggcauugcgcucguugccacagggcuggcuaaacuugccgaaaccgagggaaagggcguguuugacgaagcuaagaaaacgguggaggcccugaacggguaucucgauaagcacaaagacgaagucgacaaggccuccgcugauaacaugaucaccaaucugcuuaaacauauugcgaaggcccaagagcuguacaagaacagcucugcucuccgcgcccagggagcccagaucgacacagcuuucuccagcuacuauuggcuguacaaagccggcgugaccuccgagacauuuccuaccguuucucaguuccuguucgaacucggcaagcaaccgagagggacgaaaaagaugaaaaaggcgcugcuuagcacacccaugaagugggggaaaaagcuguaugagcucuuugcugaugacuccuuccagcagaaucggaucuacaugcacccugccgugcugaccgccggccgcauuagcgaaaugggggucugcuuuggaacaauccccguggcuaacccugaugacgccgcucagggcucugggcauaccaaauccauucuuaaucugagaaccaacacagagacgaauaaccccugugccaagaccaucguuaaacucuucgaaauucaaaagacaggauuuaauauccaggauauggacaucguggcgagcgagcaucugcugcaccagucucucgucggcaagcaaagcccguuccagaacgccuauaaugugaaaggcaacgcuaccuccgccaauauuaucuga

SEQ ID NO: 7343 - RNA, 1449 nt, Artificial Sequence
  derived and/or modified CDS sequence (opt5) from CCHFV(K168_40)__KX013458.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagaaaggccuugaaugguuugagaagaaugccgggaccaucaaaucuugggacgaaagcuauacagagcugaagguugaggugccgaaaauugaacagcucgcuaacuaccagcaggccgcgcugaaguggcggaaggauaucggauuccgcgucaaugccaacaccgcugcccuuucccacaaagugcuggcugaguauaagguucccggcgacaucgugaugagcgucaaagaaaugcucucugauaugauuagacggcgcaaucugauccugaacagagggggagacgagaauccucggggccccgugucccgcgaacauguggagugguguagagaguuugucaagggcaacuacauuauggccuucaauccucccuggggagauaucaacaaaagcgggcggucuggcauugcgcucguugccacagggcuggcuaagcuggccgaaaccgagggaaaaggcguguuugacgaagcuaagaagacgguggaggcccugaacggguaucucgauaaacacaaggacgaagucgacaaagccuccgcugauaauaugaucaccaaccugcuuaagcauauugcgaaagcccaagagcuguacaagaauagcucugcucuccgcgcccagggagcccagaucgacacagcuuucuccagcuacuauuggcuguacaaggccggcgugaccuccgagacauuuccuaccguuucucaguuccuguucgaacucggcaaacaaccgagagggacgaagaaaaugaagaaagcgcugcuuagcacacccaugaaguggggaaagaaacuguaugagcucuuugcugaugacuccuuccagcagaaccggaucuacaugcacccugccgugcugaccgccggccgcauuagcgaaaugggggucugcuuuggaacaauccccguggcuaauccugaugacgccgcucagggcucugggcauaccaaguccauucuuaaccugagaaccaauacagagacgaacaaucccugugccaaaaccaucguuaaacucuucgaaauucaaaagacaggauuuaacauccaggauauggacaucguggcgagcgagcaccuucugcaccagucucucgucggcaagcaaagcccguuccagaaugccuauaacgugaagggcaaugcuaccuccgccaacauuaucuga

SEQ ID NO: 7344 - RNA, 1449 nt, Artificial Sequence
  derived and/or modified CDS sequence (opt5) from CCHFV(K323_27)__KX013473.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaaaauucugggaccaucaagagcugggacgaaaacuaugccgagcugaaaguggauguuccgaagauugagcagcucgcuaauuaccagcaggccgcgcugaaguggagaaaagacaucggauuccgggugaacgccaauacagcugcccuuuccaacaagguccuggcugaauauaaagugcccggcgagaucguuaugagcgugaaggaaaugcucucugauaugauucgcagacggaaucugauccugaaccgcgggggagacgagaauccuagaggccccgucucccgggaacacguggaguggugucgcgaguuugugaaaggcaaguacauuauggccuucaacccucccuggggagauaucaacaaaagcggaagaucuggcauugcgcucgucgccaccgggcuggcuaagcucgccgaaacagagggaaagggcguuuuugacgaagcuaaaaagaccguggaggcccugaauggguaucucgauaaacaucgggacgaaguggacaaggccuccgcugauagcaugaucacgaaccugcuuaaacacauugcgaaggcccaagagcuguacaaaaauucuuccgcucuccgcgcccagggagcccagaucgacaccccuuucagcuccuuuuacuggcuguauaaggcuggcgucacaccggagaccuuccccacaaucucucaguuccuguuugaacucggcaagcaaccuagagggaccaaaaagaugaaaaaggcccugcuuagcacgcccaugaagugggggaaaaagcuguacgagcuuuucgcggaugacuccuuucagcagaaccggauuuauaugcauccugcugugcugacagccggccgcaucagcgaaauggggguuugcuucggaaccauucccguggccaauccggaugacgcugcccagggcucugggcacacaaaauccauccuuaaccugagaaccagcaccgagacaaauaacccuugugcuaagacgauugucaaacucuuugaaauccaaaagaccggauucaauauccaggauauggacauuguggccucugagcaucugcugcaccagagccucguuggcaagcaaucccccuuucagaacgcguucaaugugaaaggcaacgccacaucugcuaauaucauuuga

SEQ ID NO: 7345 - RNA, 1449 nt, Artificial Sequence
  derived and/or modified CDS sequence (opt5) from CCHFV(Min)__KX013482.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaaaauucugggaccaucaagagcugggacgaaaacuaugccgagcugaaaguggauguuccgaagauugagcagcucgcuaauuaccagcaggccgcgcugaaguggagaaaagacaucggauuccgggugaacgccaauacagcugcccuuuccaacaagguccuggcugaauauaaagugcccggcgagaucguuaugagcgugaaggaaaugcucucugauaugauucgcagacggaaucugauccugaaccgcgggggagacgagaauccuagaggccccgucucccgggaacacguggaguggugucgcgaguuugugaaaggcaaguacauuauggccuucaacccucccuggggagauaucaacaaacucggaagaagcggcauugcgcuggucgccaccgggcuugcuaagcuggccgaaacagagggaaagggcguuuuugacgaagcuaaaaagaccguggaggcccucaauggguaucuggauaaacaucgggacgaaguggacaaggccucugcugauuccaugaucacgaaccuucugaaacacauugcgaaggcccaagagcucuacaagaauagcucugcucugcgcgcccagggagcccagaucgacaccccuuucuccagcuuuuacuggcuguauaaagcuggcgucacaccggagaccuuccccacaaucucccaguuccucuuugaacugggcaagcaaccuagagggaccaaaaagaugaaaaaggcccuucugucuacgcccaugaagugggggaaaaagcucuacgagcuguucgcggaugacagcuuucagcagaaccggauuuauaugcauccugcugugcuuacagccggccgcaucuccgaaauggggguuugcuucggaaccauucccguggccaauccggaugacgcugcccagggcagcgggcacacaaaaucuauccugaaccucagaaccuccaccgagacaaauaacccuugugcuaagacgauugucaaacuguuugaaauccaaaagaccggauucaauauccaggauauggacauuguggccagcgagcaucugcuccaccagucucugguuggcaagcaaagccccuuucagaacgcguacaaugugaaaggcaacgccacauccgcuaauaucauuuga

SEQ ID NO: 7346 - RNA, 1449 nt, Artificial Sequence
  derived and/or modified CDS sequence (opt5) from CCHFV(Saf)__KX013488.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaaaauucugggaccaucaagagcugggacgaaaacuaugccgagcugaaaguggauguuccgaagauugagcagcucgcuaauuaccagcaggccgcgcugaaguggagaaaagacaucggauuccgggugaacgccaauacagcugcccuuuccaacaagguccuggcugaauauaaagugcccggcgagaucguuaugagcgugaaggaaaugcucucugauaugauucgcagacggaaucugauccugaaccgcgggggagacgagaauccuagaggccccgucucccgggaacacguggaguggugucgcgaguuugugaaaggcaaguacauuauggccuucaacccucccuggggagauaucaacaaaagcggaagaucuggcauugcgcucgucgccaccgggcuggcuaagcucgccgaaacagagggaaagggcguuuuugacgaagcuaaaaagaccguggaggcccugaauggguaucucgauaaacaucgggacgaaguggacaaggccuccgcugauagcaugaucacgaaccugcuuaaacacauugcgaaggcccaagagcuguacaaaaauucuuccgcucuccgcgcccagggagcccagaucgacaccccuuucagcuccuuuuacuggcuguauaaagcuggcgucacaccggagaccuuccccacaaucucucaguuccuguuugaacucggcaagcaaccuagagggaccaaaaagaugaaaaaggcccugcuuagcacgcccaugaagugggggaaaaagcuguacgagcuuuucgcggaugacuccuuucagcagaaccggauuuauaugcauccugcugugcugacagccggccgcaucagcgaaauggggguuugcuucggaaccauucccguggccgauccggacgaugcugcccagggcucugggcacacaaaauccauccuuaaucugagaaccagcaccgagacaaacaauccuugugcucggacgauugucaagcucuuugaaauccaaaagaccggauucaacauccaggacauggauauuguggccucugagcaucugcugcaccagagccucguuggcaagcaaucccccuuucagaaugcguacaacgugaagggcaaugccacaucugcuaacaucauuuga

SEQ ID NO: 7347 - RNA, 1449 nt, Artificial Sequence
  derived and/or modified CDS sequence (opt5) from CCHFV(UCCR4459)__KY484031.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagaaaggccuugaaugguuugagaagaaugccgggaccaucaaaucuugggacgaaagcuauacagagcugaagguugaggugccgaaaauugaacagcucgcuggauaccagcaggccgcgcugaaguggcggaaggauaucggcuuccgcgucaacgccaauaccgcugcccuuucccacaaagugcuggcugaguauaagguucccggggaaaucgugaugagcgucaaagagaugcucucugacaugauuagacggcgcaaccugauccugaauagaggaggcgaugaaaacccucggggccccgugucccgcgagcacguggagugguguagagaauuugucaaggggaaauacauuauggccuucaauccucccuggggagacaucaacaagcucggccggagcgggauugcgcugguugccacaggacuugcuaaacuggccgagaccgaaggcaaggggguguuugaugaggcuaagaaaacgguggaagcccucaauggauaucuggacaagcacaaagaugaggucgacaaggccucugcugacaacaugaucaccaaccuucugaaacauauugcgaaggcccaagagcucuacaaaaauuccagcgcucugcgcgcccagggcgcccagaucgauacagcuuucucuuccuacuauuggcuguacaaggccggcgugaccccugaaacauuuccgaccguuagccaguuccucuucgagcuggggaagcaacccagaggaacgaaaaagaugaaaaaggcgcuucuguccacaccuaugaaguggggcaaaaagcucuaugaacuguuugcugacgauucuuuccagcagaaccggaucuacaugcaccccgccgugcuuaccgccgggcgcauuagcgagaugggagucugcuuuggcacaaucccuguggcuaaucccgacgaugccgcucagggguccggacauaccaaaagcauucugaaccucagaaccaauacagaaacgaacaauccgugugccaagaccaucguuaaacuguucgagauucaaaagacaggcuuuaacauccaggacauggauaucguggcgucugagcaucugcuccaccagucccuggucggcaagcaaagcccuuuccagaaugccuauaacgugaaagggaaugcuaccucugccaacauuaucuga

SEQ ID NO: 7348 - RNA, 1449 nt, Artificial Sequence
  derived and/or modified CDS sequence (opt5) from CCHFV(YL16070)__KY354080.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagaaaggccuugaaugguuugagaagaaugccgggaccaucaaaucuugggacgaaagcuauacagagcugaagguugaggugccgaaaauugaacagcucgcugauuaccagcaggccgcgcugaaguggcggaaggacaucggauuccgcgucaacgccaauaccacagcucuuucccacaaagugcuggccgaguauaagguucccggcgaaaucgugaugagcgucaaagagaugcucucugauaugauuagacggcgcaaccugauccugaauagagggggagacgaaaacccucggggccccgugucccgcgagcacguggagugguguagagaauuugucaagggcaaauacauuauggcuuucaauccucccuggggagauaucaacaagagcgggcggucuggcauugcccucguugcgaccgggcuggccaaacuugcugagacggaaggaaagggcguguuugacgaggccaagaaaaccguggaagcucugaauggguaucucaacaagcacaaagaugaggucgacaaggccuccgccgacagcaugaucacaaaccugcuuaaacauauugcuaaggcgcaagagcuguacaaaaauucuuccgcccuccgcgcucagggagcccagaucgauaccgccuucagcuccuacuauuggcuguacaaagcuggcgugacaccugaaaccuuuccgacgguuucucaguuccuguucgagcucggcaagcaacccagagggacaaagaagaugaaaaaggcccugcuuagcaccccucugaaguggggaaaacggcucuaugaacuguuugcggacgauuccuuccagcagaaccgcaucuacaugcaccccgcugugcuuacagccggcagaauuagcgagaugggggucugcuuuggaaccaucccuguggccaaucccgacgaugcugcccagggcucugggcauaccaaguccauucugaaccuccggacaaauacggaaaccaacaauccgugugcuaaaacaaucguuaagcuguucgagauucagaaaaccggauuuaacauccaagacauggauaucguggccagcgagcaucugcuccaccagucucuggucggcaagcaaagcccuuuccagaaugcguauaacgugaagggcaaugccacauccgcuaacauuaucuga

SEQ ID NO: 7349 - RNA, 1449 nt, Artificial Sequence
  derived and/or modified CDS sequence (opt5) from CCHFV(66019)__AJ010648.1__N
auggagaacaagaucgaagugaauaacaaggacgagaugaauagaugguucgaagaguuuaagaaaggcaacgggcuggucgauaccuucacaaauagcuacuccuuuugcgaaucuguucccaaccucgaccgguucguguuucagauggccagcgcuacggaugacgcccaaaaggauuccauuuaugcgucugcucugguggaggccaccaaauucugugccccuaucuacgagugcgcuugggucagcuccacaggaauugugaagaagggccuugaaugguuugagaaaaaugccgggaccaucaagucuugggacgaaagcuauacagagcugaaaguugaggugccgaagauugaacagcucgcuuccuaccagcaggccgcgcugaaauggcgcaaggauaucggauucagagucaacgccaauaccgcugcccuuagccacaaggugcuggcugaguauaaaguucccggcgaaaucgugaugucugucaaggagaugcucuccgacaugauucggcgcagaaaccugauccugaaucgcgggggagaugaaaacccucggggccccgugagcagagagcauguggaguggugucgggaauuugucaaaggcaaguacauuauggccuucaauccucccuggggagacaucaacaaaucugggcgcuccggcauugcgcucguugccacagggcuggcuaagcuggccgagaccgaaggaaaaggcguguuugaugaggcuaagaagacgguggaagcccugaauggguaucucgacaaacacaaggaugaggucgacaaagccagcgcugacaacaugaccacaaaccugcuuaagcauaucgcgaaagcccaagagcuguacaaaaauucuuccgcucucagagcccagggagcccagauugauaccgcuuucagcuccuacuauuggcuguacaaggccggcgugacaccugaaaccuuuccgacgguuucucaguuccuguucgagcucggcaaacaaccccgggggacaaagaaaaugaagaaagcgcugcuuagcaccccuaugaaguggggaaagaaacuguaugaacucuuugcugacgauuccuuccagcagaaccgcaucuacaugcaccccgccgugcugacagccggcagaaucagcgagaugggggucugcuuuggaaccauuccuguggcugaccccgaugacgccgcucagggcucugggcauaccaaguccauccuuaaucugcggacaaacacggaaaccaauaacccgugugccaaaacaauuguuaaacucuucgagauccaaaagaccggauuuaauauucaggauauggacaucguggcgagcgagcaccuucugcaccagucucucgucggcaagcaaagcccuuuccagaacgccuauaaugugaagggcaacgcuacauccgccaauaucauuuga

SEQ ID NO: 7350 - RNA, 1449 nt, Artificial Sequence
  derived and/or modified CDS sequence (opt5) from CCHFV(8402)__AJ010649.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgagagauucguguuucagauggccagcgcuacggacgaugcccaaaaagacuccauuuaugcgucugcucugguggaggccaccaaguucugugccccuaucuacgaaugcgcuugggucagcuccacaggaauugugaagaaaggccuugagugguuugaaaagaaugccgggaccaucaaaucuugggaugagagcuauacagagcugaagguugaagugccgaaaauugagcagcucgcuaacuaccagcaggccgcgcugaaguggcggaaggacaucggauuccgcgucaaugccaacaccgcugcccuuucccacaaagugcuggcugaauauaagguucccggcgagaucgugaugagcgucaaagaaaugcucucugauaugauuagacggcgcaaucugauccugaacagagggggagacgagaauccucggggccccgugucccgcgagcauguggaaugguguagagaguuugucaagggcaaauacauuauggccuucaacccucccuggggagauaucaauaagagcgggcggucuggcauugcgcucguugccacagggcuggcuaaacuugccgaaaccgagggaaagggcguguuugacgaagcuaagaaaacgguggaggcccugaacggguaucucgauaagcacaaagacgaggucgauaaggccuccgcugacaacaugaucaccaaucuguucaaacauauugcgaaggcccaagaacuuuacaagaaccugagcgcucucggagcccagggcgcccagaucgacacagcuuuuucuuccuacuauuggcuguacaaagccggcgugaccccugagacauucccgaccguuagccaguuccuguuugaacucgggaagcaaccccgcggaacgaaaaagaugaaaaaggcgcugcuuuccacaccuaugaaguggggcaaaaagcuguaugagcuguucgcugaugacucuuuucagcagaauagaaucuacaugcaccccgccgugcugaccgccgggcggauuagcgaaaugggagucugcuucggcacaaucccuguggcuaaccccgaugacgccgcucagggguccggacauaccaaaagcauucuuaaucugcgcaccaacacagagacgaauaacccgugugccaagaccaucguuaaacucuuugagauucaaaagacaggcuucaauauccaggauauggacaucguggcgucugaacaccuccugcaccagucccucgucggcaagcaaagcccuuuucagaacgccuauaaugugaaagggaacgcuaccucugccaauauuaucuga

SEQ ID NO: 7351 - RNA, 1449 nt, Artificial Sequence
  derived and/or modified CDS sequence (opt5) from CCHFV(Bul/HU517)__AY277676.2__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaaaauucuggggccaucaagagcugggacgaaaacuauguggagcugaaaguugaugugccgaagauugagcagcucgcuaauuaccagcaggccgcgcugaaguggagaaaagacaucggauuccgggucaacgccaauaccgcugcccuuuccaacaaggugcuggcugaauauaaaguucccggcgagaucgugaugagcgucaaggaaaugcucucugauaugauucgcagacggaaucugauccugaaccgcggguccgacgagaauccuagaggacccgugagccacgaacacguggaguggugucgggaguuugucaaaggcaaguacauuauggccuucaacccucccuggggcgauaucaacaaaucugggcgcuccggaauugcgcucguugccacaggccuggcuaagcucgccgaaaccgaggggaagggaguguuugacgaagcuaaaaagacaguggaggcccugaauggcuaucucgauaaacacagagacgaagucgacaaggccagcgcugauucuaugaucaccaaccugcuuaaacauauugcgaaggcccaagagcuguacaaaaauuccagcgcucuccgggcccagggggcccagaucgacacgccuuucuccucuuuuuacuggcuguauaaagcuggagugaccccggagacauuccccaccaucagccaguuccuguuugaacucggcaagcaaccucgcggcacaaagaagaugaaaaaggcccugcuuuccacccccaugaagugggggaaaaagcuguacgagcuuuucgcggaugacagcuuucagcagaacagaauuuauaugcacccugcuguucugacggccggacggaucucugaaaugggcgugugcuucgggacaauucccgucgccaauccggaugacgcugcccagggauccggccauaccaaaagcauccuuaaccugcgcacaucuaccgagaccaauaacccuugugcuaagacaauugugaaacucuuugaaauccaaaagacgggguucaauauccaggauauggacauuguugccagcgagcaucugcugcaccagucccucgugggaaagcaaucucccuuucagaacgcguacaaugucaaaggcaacgccaccagcgcuaauaucauuuga

SEQ ID NO: 7352 - RNA, 1449 nt, Artificial Sequence
  derived and/or modified CDS sequence (opt5) from CCHFV(V46/13)__KR011837.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaaaauucugggaccaucaagagcugggacgaaaacuaugccgagcugaaaguggauguuccgaagauugagcagcucgcuaauuaccagcaggccgcgcugaaguggagaaaagacaucggauuccgggugaacgccaauacagcugcccuuuccaacaagguccuggcugaauauaaagugcccggcgagaucguuaugagcgugaaggaaaugcucucugauaugauucgcagacggaaucugauccugaaccgcggguccgacgagaauccuagaggacccgucagccgggaacacguggaguggugucgcgaguuugugaaaggcaaguacauuauggccuucaacccucccuggggcgauaucaacaaaucugggagauccggaauugcgcucgucgccaccggccuggcuaagcucgccgaaacagaggggaagggaguuuuugacgaagcuaaaaaggccguggaggcccugaauggcuaucucgauaaacaucgggacgaaguggucaaggcuagcgcggacucuaugaucaccaaccugcuuaaacacauugccaaggcucaagagcuguacaaaaauuccagcgcccuccgcgcccagggggcucagaucgauacgccuuucuccucuuuuuacuggcuguauaaagccggagugaccccggagacauuccccaccaucagccaguuccuguuugaacucggcaagcaaccuagaggcacaaagaagaugaaaaaggcgcugcuuuccacccccaugaagugggggaaaaagcuguacgagcuuuucgcugacgauagcuuucagcagaaccggauuuauaugcauccugccguucugacggccggacgcaucucugaaaugggcgugugcuucgggacaauucccgucgcuaauccggacgaugccgcucagggauccggccacaccaaaagcauccuuaaccugagaacaucuaccgagaccaauaacccuugugccaagacaauugugaaacucuuugaaauccaaaagacgggguucaauauccaggacauggauauuguugcgagcgagcaucugcugcaccagucccucgugggaaagcaaucucccuuucagaacgccuacaaugucaaaggcaacgcuaccagcgccaauaucauuuga

SEQ ID NO: 7353 - RNA, 1449 nt, Artificial Sequence
  derived and/or modified CDS sequence (opt5) from CCHFV(1231-CR/TI-2015)__KU161587.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaaaauucugggaccaucaagagcugggacgaaaacuaugccgagcugaaaguggauguuccgaagauugagcagcucgcuaauuaccagcaggccgcgcugaaguggagaaaagacaucggauuccgggugaacgccaauacagcugcccuuuccaacaagguccuggcugaauauaaagugcccggcgagaucguuaugagcgugaaggaaaugcucucugauaugauucgcagacggaaucugauccugaaccgcgggggagacgagaauccuagaggccccgucucccgggaacacguggaguggugucgcgaguuugugaaaggcaaguacauuauggccuucaacccucccuggggagauaucaacaaaagcggaagaucuggcauugcgcucgucgccaccgggcuggcuaagcucgccgaaacagagggaaagggcguuuuugacgaagcuaaaaagaccguggaggcccugaauggguaucucgauaaacaucgggacgaaguggacaaggccuccgcugauagcaugaucacgaaccugcuuaaacacauugcgaaggcccaagagcuguacaaaaauucuuccgcucuccgcgcccagggagcccagaucgacaccccuuucagcuccuuuuacuggcuguauaaggcuggcgucacaccggagaccuuccccacaaucucucaguuccuguuugaacucggcaagcaaccuagagggaccaaaaagaugaaaaaggcccugcuuagcacgcccaugaagugggggaaaaagcuguacgagcuuuucgcggaugacuccuuucagcagaaccggauuuauaugcauccugcugugcugacagccggccgcaucagcgaaauggggguuugcuucggaaccauucccguggccaauccggaugacgcugcccagggcucugggcacacaaaauccauccuuaaccugagaaccagcaccgagacaaauaacccuugugcuaagacgauugucaaacucuuugaaauccaaaagaccggauucaauauccaggauauggacauuguggccucugagcaucugcugcaccagagccucguuggcaagcaaucccccuuucagaacgcguacaaugugaaaggcaacgccacaucugcuaauaucauuuga

SEQ ID NO: 7354 - RNA, 1449 nt, Artificial Sequence
  derived and/or modified CDS sequence (opt5) from CCHFV(AP92)__U04958.1__N
auggagaacaagaucgaagugaauagcaaagacgaucugaacaagugguucgaggaauuuaaaaagggcaaugggcucgucgacaccuucacaaacuccuacucuuuuugcgagaauguucccaaccuggauagauucguguaucagauggccagcgcuacggacgaugcccaaaaagacuccauuuacgcgucugcucuuguggaagccaccaaguauugugccccuaucuacgagugcgcuugggucagcuccacaggaauugugaagaaaggccuggagugguuugaaaagaauaccucuacaaucaaaagcugggaugaguccuauaccgaacucaagguugacauuccgaaaaucgagcagcugagcucuuaccagcaggccgcucuuaaguggcggaaggauaucggguuccgcauuaacgccaauacaaccgcgcuguccaacaaagugcucgccgaguauaagguccccggagaaauccuggugccuguuaaagagaugcugagcgacaugauuagacggcgcaauaucauucucaacagaggcucugaugaaaauccccgggggccugugucccacgagcauaucgaauggugucgcgaguuuauuaagggaaaauacaucauggcuuucaaucccccuuggggcgacaucaacaagagcggcagaucugggauugcccuggucgcuacgggacuugccaaacuggcggagaccgaaggcaaggggguguuugaggaagccaagaaaacaguggaggcucucaaggauuaccuggacaaacaccgggacgaagucgauaagaccuccgccgacaacaugguuacaagccuucugaaacauaucgcuaaggcccaagagcucuauaagaacuccucugcccugcgcgcucagggagcgcagauugauaccccguucagcuccuuuuacuggcuguauaaagccggcgugacgcccgagacauucccuaccgugagccaguuucucuucgaacuggggaagcaacccagaggaaccaaaaagaugaaaaaggcucuccugucuacaccuaugaaguggggcaaaaagcacuacgagcuuuucgccgacgauuccuuucagcagaaucggaucuauaugcaucccgccguccugaccgcuggccgcauuagcgaaaugggggugugcuucggaacaaucccgguugccaacccugacgaugcggcucagggcucugggcacacgaaaagcauccuuaaucugagaaccaacacagaguccaauaaccccugugcccggaccauugugaagcucuuugaaauccagaaaacaggauucgacauuaaggauauggacaucgucgccucugagcaucugcugcaccaaagccucgugggcaagcaguccccuuuucaaaaugcuuacaacguuaaagggaaugccaccagcgcuaacauuaucuga

SEQ ID NO: 7355 - RNA, 1449 nt, Artificial Sequence
  derived and/or modified CDS sequence (opt5) from CCHFV(C68031)__M86625.1__N
auggagaacaagaucgaagugaauaacaaagacgagaugaauaagugguucgaagaguuuaaaaagggcaacgggcuggucgauaccuucacaaaucccuacagcuuuugcgaauccguuccuaaccucgagagauucguguuucagauggccucugcuacggacgaugcccaaaaagacagcauuuaugcguccgcucugguggaggccaccaaguucugugccccgaucuacgaaugcgcuugggucucuagcacaggaauugugaagaaaggccuugagugguuugaaaagaaugccgggaccaucaaauccugggaugagucuuauauugagcugaagguugaagugcccaaaaucgagcagcucgcuaacuaccagcaggccgcgcugaaguggcggaaggacaucggauuccgcgucaaugccaacacagcugcccuuagccacaaagugcuggcugaauauaagguuccuggcgagauugugauguccgucaaagaaaugcucagcgauaugaucagacggcgcaaucugauucugaacagagggggagacgagaauccccggggcccugugucucgcgagcacguggaaugguguagagaguuugucaagggcaaauacaucauggccuucaaucccccuuggggagauauuaacaaguccggacggagcggcaucgcgcucguugccaccgggcuggcuaaacuugccgaaacagagggaaagggcguguuugacgaagcuaagaaaaccguggaggcccugaacggguaucucgauaagcacaaagacgaggucgauaaggccucugcugacaacaugauuacgaaucugcuuaaacauaucgcgaaggcccaagaacuguacaagaacuccagcgcucuccgcgcccagggagcccagaucgacaccgcuuucucuuccuacuauuggcuguacaaagccggcgugacaccggagaccuuucccacaguuagccaguuccuguucgaacucggcaagcaaccuagagggaccaaaaagaugaaaaaggcgcugcuuuccacgcccaugaagugggggaaaaagcuguaugagcucuuugcugaugacucuuuccagcagaaucggauuuacaugcacccugccgugcugacagccggccgcaucagcgaaaugggggucugcuuuggaaccauucccguggcuaacccggaugacgccgcucagggcuccgggcauacaaaaagcauccuuaaucugagaaccaacaccgagacaaauaacccuugugccaagacgauuguuaaacucuucgagauccaaaagaccggauuuaauauccaggauauggacauuguggcgucugaacaucugcugcaccagucccucgucggcaagcaaagccccuuccagaacgccuauaaugugaaaggcaacgcuacaucugccaauaucauuuga

SEQ ID NO: 7356 - RNA, 1449 nt, Artificial Sequence
  derived and/or modified CDS sequence (opt5) from CCHFV(1-CR/HU-2015)__KU161586.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuaucagauggccagcgcuacggaugacgcccaaaaggauuccauuuacgcgucugcucugguggaggccaccaaguuuugugccccuaucuaugagugcgcuugggugagcuccacaggaauugucaaaaagggccuugaaugguucgagaaaaauucugggaccaucaagagcugggacgaaaacuacgccgagcugaaaguggauguuccgaagauugagcagcucgcuaauuaucagcaggccgcgcugaaguggagaaaagacaucggauuucgggugaacgccaauacagcugcccuuuccaacaagguccuggcugaauacaaagugcccggcgagaucguuaugagcgugaaggaaaugcucucugauaugauucgcagacggaaucugauccugaaccgcgggggagacgagaauccuagaggccccgucucccgggaacacguggaguggugucgcgaguucgugaaaggcaaguauauuauggccuuuaacccucccuggggagauaucaacaaaagcggaagaucuggcauugcgcucgucgccaccgggcuggcuaaacuugccgaaacagagggaaagggcguuuucgacgaagcuaagaagaccguggaggcccugaauggguaccucgauaaacaucgggacgaaguggacaaggccuccgcugauagcaugacgaccaaccugcuuaaacacaucgcgaaggcccaagagcuguacaaaaauucuuccgcucuccgcgcccagggagcccagauugacacaccuuuuagcuccuucuauuggcuguacaaggcuggcgucaccccggagacauuucccaccaucucucaguuccuguucgaacucggcaagcaaccuagagggacgaaaaagaugaaaaaggcccugcuuagcacacccaugaagugggggaaaaagcuguaugagcucuuugcggaugacuccuuccagcagaaccggaucuacaugcauccugcugugcugaccgccggccgcauuagcgaaauggggguuugcuuuggaacaauccccguggccaauccggaugacgcugcccagggcucugggcacaccaaauccauucuuaaccugagaaccagcacagagacgaauaacccuugugcuaagaccaucgucaaacucuucgaaauucaaaagacaggauuuaauauccaggauauggacaucguggccucugagcaucugcugcaccagagccucguuggcaagcaaucccccuuccagaacgcguauaaugugaaaggcaacgccaccucugcuaauauuaucuga

SEQ ID NO: 7357 - RNA, 1449 nt, Artificial Sequence
  derived and/or modified CDS sequence (opt5) from CCHFV(36-ST-2014)__KR814838.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaaaauaccgggacaaucaagucuugggacgauaacuaugccgaacugaaaguggacguuccgaagauugagcagcucgcuaauuaccagcaggccgcgcugaaguggagaaaagauaucggauuccgggugaacgccaauaccgcugcccuuagcaacaagguccuggcugaguauaaagugcccggcgaaaucguuauguccgugaaggagaugcucagcgacaugauucgcagacggaaucugauccugaaccgcgggggagauggcaauccuagaggccccgucucucacgaacauguggaguggugucgggaauuugugaaagggaaguacauuauggccuucaacccucccuggggagacaucaacaaauccggccgcagcgggauugcgcucgucgccacaggacuggcuaaacuugccgagaccgagggcaaggggguuuuugaugaagcuaaaagaacgguggaggcccugaauggauaucucgacaagcaccgggacgaaguggauaaagccucugcugacuccaugaucaccaaccugcuuaagcauauugcgaaagcccaagagcuguacaagaauagcucugcucuccgcgcccagggcgcccagaucgauacaccuuucuccagcuuuuacuggcuguauaaggcuggcgucaccccggaaacauuccccaccaucucccaguuccuguuugagcucgggaaacaaccuagaggaacgaagaaaaugaagaaagcccugcuuucuacacccaugaaguggggcaagaaacuguacgagcuguucgcggacgauagcuuucagcagaaccggauuuauaugcacccugcugugcugaccgccgggcgcaucuccgaaaugggaguuugcuucggcacaauucccguggccaauccggacgaugcugcccaggggagcggacauaccaagucuauccuuaaccugagaaccuccacagagacgaauaacccuugugcuaaaaccauugucaagcucuuugaaauccaaaagacaggcuucaauauccaggacauggauauuguggccagcgagcaccuccugcaccagucucucguuggcaagcaaagccccuuucagaacgcguacaaugugaaggggaacgccaccuccgcuaauaucauuuga

SEQ ID NO: 7358 - RNA, 1449 nt, Artificial Sequence
  derived and/or modified CDS sequence (opt5) from CCHFV(37-ST-2009)__KR814835.1__N
auggagaacaagaucguggucaauagcaaagacgaaaugaacaagugguucgaggaauuuaaaaagguuaauggccugguggauaccuucacaaacuccuacucuuuuugcgagaaugugcccaaccucgacaaauucgucuuucagauggccagcgcuacggaugacgcccaaaaggauuccauuuaugcgucugcucugguggaagccaccaaguucugugccccuaucuacgagugcgcuuggguuagcuccacagggauugugaaaaagggacuugagugguuugaaaagaaugccggcaccaucaagucuugggacgagagcuauacagaacugaaagucgaugugccgaagauugagcagcucgcuuccuaccagcaggccgcgcugaaguggagaaaagacaucggguuccggguuaacgccaauaccgcugcccuuagcucuaaggugcuguccgaguauaaaguccccggagaaguggugaugccugucaaggagaugcucagcgauaugauccgcagacggaaccugauucugaaucgcggcucugacgaaaaccccagagggccuguuucccgggagcacguggaauggugucgcgaguuugugaaaggaaaguacaucauggcuuucaaucccccuuggggcgauauuaacaaaagcggcagaucugggaucgcccucgucgcgacaggacuggccaaacuugcugagaccgaaggcaaggggauuuuugaggaagcccggaaaacgguggacgcucugaaggauuaucucgaccgccauaaagaggaaguugacaagaccaaugccgauaacauggugacaaaccuguucaaacacaucgccaaggcucaagagcuuuacaaaaauuccagcgcgcugagagcccagggagcucagauugacaccccguuuuccucuuucuacuggcucuauaaggccggcgucacacccgagaccuucccuacggugagccaguuucuguucgaacuggggaagcaaccccggggaacacgcaaaaugaagaaagcccuccuguccaccccuaugaaguggggcaagaaacuuuacgagcuguuugcugaugacagcuuccagcagaacagaaucuauaugcaucccgccguucucacagcgggccgggugucugaaaugggggucugcuuuggaaccaucccgguggauaauccugacgaugcugcccagggcuccgggcacaccaagagcauucugaaccuucgcacaucugccgagacgaauaaccccugugcuagaaccaucgucaaacuguucgaaauucaaaaggccggauuuaauauccaggagauggacauuguggcuagcgagcaucuccugcaccagucccugguuggcaaacaaucuccuuuccagaacgccuacaaugugaaggggaacgcgacaagcgccaauaucaucuga

SEQ ID NO: 7359 - RNA, 1449 nt, Artificial Sequence
  derived and/or modified CDS sequence (opt5) from CCHFV(59-TK-2012)__KR814833.1__N
auggagaacaagaucguggucaauagcaaagacgaaaugaacaagugguucgaggaauuuaaaaagguuaauggccugguggauaccuucacaaacuccuacucuuuuugcgagaaugugcccaaccucgacaaauucgucuuucagauggccagcgcuacggaugacgcccaaaaggauuccauuuaugcgucugcucugguggaagccaccaaguucugugccccuaucuacgagugcgcuuggguuagcuccacagggauugugaaaaagggacuugagugguuugaaaagaauaccggcacaaucaagucuugggacgagagcuauaccgaacugaaagucgaugugccgaagauugagcagcucgccuccuaccagcaggcugcccugaaguggagaaaagacaucggguuccggguuaacgcgaauacagccgcucuuagcucuaaggugcuguccgaguauaaaguccccggagaaaucgugaugccugugaaggagaugcucagcgauaugauucgcagacggaaccugauccugaaucgcggcucugacgaaaaccccagagggccugucucccgggagcacguugaauggugucgcgaguuugugaaaggaaaguacauuauggccuucaaucccccuuggggcgauaucaacaaaagcggcagaucugggauugcucucguggccaccggacuggcgaaacuugccgagacggaaggcaaggggaucuuugaggaagcucggaaaaccgucgacgcccugaaggauuaucucgaccgccauaaagaggaaguggacaagacaaaugcugauaacaugguuaccaaccuguucaaacacauugccaaggcccaagagcuuuacaaaaauuccagcgcucugagagcgcagggagcccagaucgacacaccguuuuccucuuucuacuggcucuauaaggcuggcgugacccccgagacguucccuacagucagccaguuucuguucgaacuggggaagcaaccccggggaacccgcaaaaugaagaaagcccuccuguccacaccuaugaaguggggcaagaaacuuuacgagcuguuugccgaugacagcuuccagcagaacagaaucuauaugcaucccgcugugcucaccgccggccggauuucugaaauggggguuugcuuuggaaccaucccgguggauaauccugacgaugcggcucagggcuccgggcacacaaagagcauucugaaccuucgcacgucugccgagaccaauaaccccugugccaaaacaaucgucaagcuguucgaaauucaaaaagcuggauuuaauauccaggagauggacaucguggccagcgagcaucuccugcaccagucccuggucggcaagcaaucuccuuuccagaacgcuuacaaugugaaggggaacgccaccagcgcgaauauuaucuga

SEQ ID NO: 7360 - RNA, 1449 nt, Artificial Sequence
  derived and/or modified CDS sequence (opt5) from CCHFV(73-ST-2013)__KR814836.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccagcgcuacggaugacgcccaaaaggauuccauuuaugcgucugcucugguggaggccaccaaguucugugccccuaucuacgagugcgcuugggucagcuccacaggaauugugaaaaagggccuugaaugguuugagaaaaaugccgggaccaucaagucuugggacgaaagcuauacagagcugaaaguugaugugccgaagauugagcagcucgcuaacuaccagcaggccgcgcugaaguggagaaaagacaucggauuccgggucaaugccaacaccgcugcccuuuccaauaaggugcuggcugaauauaaaguucccggcgagaucgugaugagcgucaaggaaaugcucucugauaugauucgcagacggaaccaaauccugaaucgcgggggagacgagaacccuagaggccccgugucccgggaacacguggauuggugucgcgaguuugucaaaggcaaguacauuauggccuucaauccucccuggggagacaucaacaaaagcgggagaucuggcauugcgcugguugccacagggcucgcuaagcuggccgagaccgaaggaaagggcguguuugaugaggcuaaaaagacgguggaagcccuuaacggguaucuggacaaacauaaggacgaggucgaucgggccuccgcugacagcaugaucaccaaucuccugaaacacauugcgaaggcccaggaacuuuacaagaacucuuccgcucugcgcgcccagggagcccagaucgauacagcuuucagcuccuacuauuggcucuacaaagccggcgugaccccugagacauuuccgaccguuucucaauuccuguucgagcugggcaagcagcccagagggacgaaaaagaugaaaaaggcgcuccugagcacaccuaugaaguggggaaagaaacuuuaugaacuguuugcugacgauuccuuccagcagaaucggaucuacaugcaucccgccgugcucaccgccggccgcauuagcgagaugggggucugcuuuggaacaaucccuguggcuaaccccgacgaugccgcucaaggcucugggcacaccaaauccauucugaaucuuagaaccaacacagaaacgaauaacccgugugcccggaccaucguuaagcuguucgagauucagaaaacaggauuuaauauccaggacauggauaucguggcgagcgaacaucuccugcaccaaucucuggucggcaagcagagcccuuuccagaacgccuauaaugugaagggcaacgcuaccuccgccaauauuaucuga

SEQ ID NO: 7361 - RNA, 1449 nt, Artificial Sequence
  derived and/or modified CDS sequence (opt5) from CCHFV(75-ST-2010)__KR814845.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaaaauucugggaccaucaagagcugggacgaaaacuaugccgagcugaaaguggauguuccgaagauugagcagcucgcuaauuaccagcaggccgcgcugaaguggagaaaagacaucggauuccgggugaacgccaauacagcugcccuuuccaacaagguccuggcugaauauaaagugcccggcgagaucguuaugagcgugaaggaaaugcucucugauaugauucgcagacggaaucugauccugaaccgcggguccgacgagaauccuagaggacccgucagccgggaacacguggaguggugucgcgaguuugugaaaggcaaguacauuauggccuucaacccucccuggggcgauaucaacaaaucugggagauccggaauugcgcucgucgccaccggccuggcuaagcucgccgaaacagaggggaagggaguuuuugacgaagcuaaaaagaccguggaggcccugaauggcuaucucgauaaacaucgggacgaaguggacaaggccagcgcugauucuaugaucacgaaccugcuuaaacacauugcgaaggcccaagagcuguacaaaaauuccagcgcucuccgcgcccagggggcccagaucgacaccccuuucuccucuuuuuacuggcuguauaaggcuggagucacaccggagaccuuccccacaaucagccaguuccuguuugaacucggcaagcaaccuagaggcaccaaaaagaugaaaaaggcccugcuuuccacgcccaugaagugggggaaaaagcuguacgagcuuuucgcggaugacagcuuucagcagaaccggauuuauaugcauccugcugugcugacagccggacgcaucucugaaaugggcguuugcuucgggaccauucccguggccaauccggaugacgcugcccagggauccggccacacaaaaagcauccuuaaccugagaaccucuaccgagacaaauaacccuugugcuaagacgauugucaaacucuuugaaauccaaaagaccggguucaauauccaggauauggacauuguggccagcgagcaucugcugcaccagucccucguuggaaagcaaucucccuuucagaacgcguacaaugugaaaggcaacgccacaagcgcuaauaucauuuga

SEQ ID NO: 7362 - RNA, 1449 nt, Artificial Sequence
  derived and/or modified CDS sequence (opt5) from CCHFV(CHH)__KU707898.1__N
auggagaacaagaucgaagugaauagcaaagacgagaugaacaagugguucgaagaguuuaaaaagggcaaugggcuggucgauaccuucacaaacuccuacucuuuuugcgaaagcguucccaaucucgacagauucguguuucagauggccuccgcuacggaugacgcccaaaaagauucuauuuaugcgagcgcucugguggaggccaccaaguucugugccccuaucuacgagugcgcuugggccuccucuacaggaauugucaagaaaggccuugaaugguuugagaagaacgcugggaccaucaaaagcugggacgaauccuauacagagcugaagguggagguuccgaaaauugaacagcucagcaauuaccagcaggccgcgcugaaguggcggaaggauaucggauuccgcgugaacgccaauaccgcugcccuuucuaacaaaguccuggcugaguauaaggugcccggcgaaaucguuauguccgugaaagagaugcucagcgacaugauuagacggcgcaaucugauccugaacagagggggagaugaaaauccucggggccccgucucucgcgagcacguggagugguguagagaauuugugaagggcaaauacauuauggccuucaacccucccuggggagacaucaauaaguccggacggagcggcauugcgcucgucgccacagggcuggcuaaacuugccgagaccgaaggaaagggcguuuuugaugaggcuaagaaaacgguggaagcccugaacggguaucucgacaagcauaaagaugagguggacaaggccucugcugacuccaugaucaccaaccugcuuaaacacauugcgaaggcccaagagcuguacaagaauagcuccgcucuccgcgcccagggagcccagaucgauacagucuucucuagcuacuauuggcuguacaaagcuggcgugaccccugacacauuuccgaccguuucccaguuccuguucgaacucggcaagcaacccagagggacgaaaaagaugaaaaaggcccugcuuagcacaccuaugaagugggggaaaaagcuguaugagcucuuugcggaugacucuuuccagcagaaccggaucuacaugcaucccgcugugcugaccgccggccgcauuuccgaaaugggggucugcuuuggaacaaucccuguggccaaucccgaugacgcugcccuuggcagcgggcacaccaaaucuauucugaaccucagaaccaauacagagacgaacaauccgugugcuaagaccaucguuaaacuguucgaaauucagaagacaggauuuaacauccaagauauggacaucguggccagcgagcaucugcuccaccagucccuggucggcaagcagucuccuuuccaaaaugcguauaacgugaaaggcaaugccaccagcgcuaacauuaucuga

SEQ ID NO: 7363 - RNA, 1449 nt, Artificial Sequence
  derived and/or modified CDS sequence (opt5) from CCHFV(CJH)__KU707899.1__N
auggagaacaagaucgaagugaaaaauaagcacgagaaaaacaagugguucgaagaguuuaaaaagggcaaugggcuggucgacaccuucacaaacagcuacuccuuuugcgaaaauguucccaaccucgauagauucguguuucagauggccggagcuacggacgaugcccaaaaggacucuauuuaugcgagcgcucugguggaggccaccaaauucugugccccuaucuacgagugcgcuugggccuccucuacaggcauugucaagaaagggcuugaaugguuugagaagaaugcuggaaccaucaaaagcugggaugaauccuauacagagcugaagguggagguuccgaagauugaacagcucucuaacuaccagcaggccgcgcugaaauggcggaaggacaucggcuuccgcgggaaugccaacaccgcugcccuuagcaauaaagugcuggcugaguauaagguccccggagaaaucgugauguccguuaaagagaugcucagcgauaugauuagacggcgcaaccugauccugaauagaggcggcgacgaaaacccucgggggcccgugucucgcgagcaugucgagugguguagagaauuugugaagggaaaauacauuauggccuucaauccucccuggggcgauaucaacaaguccgggcggagcggaauugcgcucguggccacaggccuggcuaagcuggccgagaccgaagggaaaggagucuuugacgaggcuaagaaaacgguugaagcccugaacggcuaucucgauaagcacaaagacgagguggauaaggccucugcugacuccaugaucaccaaucugcuuaagcauauugcgaaagcccaagagcuguacaagaacagcucugcucuccgcgcccagggcgcccagaucgacacaguguucuccagcuacuauuggcuguacaaagcuggggucaccccugaaacauuuccgaccgugucccaguuccuguucgagcucggaaagcaacccagaggcacgaaaaagaugaagaaagcccugcuuucuacaccuaugaagugggggaaaaagcuguaugaacucuuugcggaugacagcuuccagcagaaucggaucuacaugcaccccgcuguucugaccgccggacgcauuuccgagaugggcgugugcuuugggacaaucccugucgccaaccccgaugacgcugcccuuggaagcggccauaccaaaucuauucugaaucucagaaccaacacagaaacgaauaacccgugugcuaagaccaucgugaagcuguucgagauucagaaaacaggcuuuaauauccaagauauggacaucguugccuccgagcaccuucuccaccagagccugguggggaagcagucuccuuuccaaaacgcguauaaugucaaaggaaacgccaccagcgcuaauauuaucuga

SEQ ID NO: 7364 - RNA, 1449 nt, Artificial Sequence
  derived and/or modified CDS sequence (opt5) from CCHFV(CLT/TI05146)__DQ227496.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagaaaggccuugaaugguuugagaagaaugccgggaccaucaaaucuugggacgaaagcuauacagagcugaagguugaggugccgaaaauugaacagcucgcugauuaccagcaggccgcgcugaaguggcggaaggacaucggauuccgcgucaacgccaauaccacagcucuuucccacaaagugcuggccgaguauaagguucccggcgaaaucgugaugagcgucaaagagaugcucucugauaugauuagacggcgcaaccugauccugaauagagggggagacgaaaacccucggggccccgugucccgcgagcacguggagugguguagagaauuugucaagggcaaauacauuauggcuuucaauccucccuggggagauaucaacaagagcggacggucuggcauugcccucguugcgaccgggcuggccaaacuugcugagacggaaggaaagggcguguuugacgaggccaagaaaaccguggaagcucugaauggguaucucaacaagcacaaagaugaggucgacaaggccuccgccgacagcaugaucacaaaccugcuuaaacauauugcuaaggcgcaagagcuguacaaaaauucuuccgcccuccgcgcucagggagcccagaucgauaccgccuucagcuccuacuauuggcuguacaaagcuggcgugacaccugaaaccuuuccgacgguuucucaguuccuguucgagcucggcaagcaacccagagggacaaagaagaugaaaaaggcccugcuuagcaccccucugaagugggggaaaaagcucuaugaacuguuugcggacgauuccuuccagcagaaccggaucuacaugcaccccgcugugcuuacagccggccgcauuagcgagaugggggucugcuuuggaaccaucccuguggccaaucccgacgaugcugcccagggcucugggcauaccaaauccauucugaaccucagaacaaauacggaaaccaacaauccgugugcuaagacaaucguuaaacuguucgagauucaaaagaccggauuuaacauccaggacauggauaucguggccagcgagcaucugcuccaccagucucuggucggcaagcaaagcccuuuccagaaugcguauaacgugaaaggcaaugccacauccgcuaacauuaucuga

SEQ ID NO: 7365 - RNA, 1449 nt, Artificial Sequence
  derived and/or modified CDS sequence (opt5) from CCHFV(CYT/TI05099)__DQ227495.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagaaaggccuugaaugguuugagaagaaugccgggaccaucaaaucuugggacgaaagcuauacagagcugaagguugaggugccgaaaauugaacagcucgcugauuaccagcaggccgcgcugaaguggcggaaggacaucggauuccgcgucaacgccaauaccacagcucuuucccacaaagugcuggccgaguauaagguucccggcgaaaucgugaugagcgucaaagagaugcucucugauaugauuagacggcgcaaccugauccugaauagagggggagacgaaaacccucggggccccgugucccgcgagcacguggagugguguagagaauuugucaagggcaaauacauuauggcuuucaauccucccuggggagauaucaacaagagcggacggucuggcauugcccucguugcgaccgggcuggccaaacuugcugagacggaaggaaagggcguguuugacgaggccaagaaaaccguggaagcucugaauggguaucucaacaagcacaaagaugaggucgacaaggccuccgccgacagcaugaucacaaaccugcuuaaacauauugcuaaggcgcaagagcuguacaaaaauucuuccgcccuccgcgcucagggagcccagaucgauaccgccuucagcuccuacuauuggcuguacaaagcuggcgugacaccugaaaccuuuccgacgguuucucaguuccuguucgagcucggcaagcaacccagagggacaaagaagaugaaaaaggcccugcuuagcaccccucugaagugggggaaaaagcucuaugaacuguuugcggacgauuccuuccagcagaaccggaucuacaugcaccccgcugugcuuacagccggccgcauuagcgagaugggggucugcuuuggaaccaucccuguggccaaucccgacgaugcugcccagggcucugggcauaccaaauccauuccgaaccugagaacaaauacggaaaccaacaauccuugugcuaagacaaucguuaaacucuucgagauucaaaagaccggauuuaacauccaggacauggauaucguggccagcgagcaucugcugcaccagucucucgucggcaagcaaagccccuuccagaaugcguauaacgugaaaggcaaugccacauccgcuaacauuaucuga

SEQ ID NO: 7366 - RNA, 1449 nt, Artificial Sequence
  derived and/or modified CDS sequence (opt5) from CCHFV(Dubai 616)__JN108025.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccggagcuacggaugacgcccaaaaagauagcauuuaugcguccgcucugguggaggccaccaaguucugugccccuaucuacgagugcgcuugggucucuagcacaggcauugugaagaaagggcuugaaugguuugagaagaaugccggaaccaucaaauccugggacgaaucuuauacagagcugaagguugaggugccgaaaauugaacagcucgcuaacuaccagcaggccgcgcugaaguggcggaaggauaucggcuuccgcgucaaugccaacaccgcugcccuuagccacaaagugcuggcugaguauaagguucccggggaaaucgugauguccgucaaagagaugcucagcgacaugauuagacggcgcaaucugauccugaacagaggaggcgaugaaaauccucggggccccgugucucgcgagcacguggagugguguagagaauuugucaaggggaaauacauuauggccuucaacccucccuggggagacaucaauaaguccggccggagcgggauugcgcucguugccacaggacuggcuaaacuugccgagaccgaaggcaaggggguguuugaugaggcuaagaaaacgguggaagcccugaacggauaucucgacaagcacaaagaugaggucgacaaggccucugcugacaacaugaucaccaaucugcuuaaacauauugcgaaggcccaagagcuguacaagaacuccagcgcucuccgcgcccagggcgcccagaucgauacagcuuucucuuccuacuauuggcuguacaaagccggcgugaccccugaaacauuuccgaccguuagccaguuccuguucgagcucgggaagcaacccagaggaacgaaaaagaugaaaaaggcgcugcuuuccacaccuaugaaguggggcaaaaagcuguaugaacucuuugcugacgauucuuuccagcagaaucggaucuacaugcaccccgccgugcugaccgccgggcgcauuagcgagaugggagucugcuuuggcacaaucccuguggcuaaccccgacgaugccgcucagggguccggacauaccaaaagcauucuuaaucugagaaccaacacagaaacgaauaacccgugugccaagaccaucguuaaacucuucgagauucaaaagacaggcuuuaauauccaggacauggauaucguggcgucugagcaucugcugcaccagucccucgucggcaagcaaagcccuuuccagaacgccuauaaugugaaagggaacgcuaccucugccaauauuaucuga

SEQ ID NO: 7367 - RNA, 1449 nt, Artificial Sequence
  derived and/or modified CDS sequence (opt5) from CCHFV(GRH)__KU707900.1__N
auggagaacaagaucgaagugaauagcaaagacgagaugaacaagugguucgaagaguuuaaaaagggcaaugggcuggucgauaccuucacaaacuccuacucuuuuugcgaaagcguucccaaucucgacagauucguguuucagauggccuccgcuacggaugacgcccaaaaagauucuauuuaugcgagcgcucugguggaggccaccaaguucugugccccuaucuacgagugcgcuugggccuccucuacaggaauugucaagaaaggccuugaaugguuugagaagaacgcugggaccaucaaaagcugggacgaauccuauacagagcugaagguggagguuccgaaaauugaacagcucagcaauuaccagcaggccgcgcugaaguggcggaaggauaucggauuccgcgugaacgccaauaccgcugcccuuucuaacaaaguccuggcugaguauaaggugcccggcgaaaucguuauguccgugaaagagaugcucagcgacaugauuagacggcgcaaucugauccugaacagagggggagaugaaaauccucggggccccgucucucgcgagcacguggagugguguagagaauuugugaagggcauguacauuauggccuucaacccucccuggggagacaucaauaaauccgggcggagcggcauugcgcucgucgccacagggcuggcuaaacuugccgagaccgaaggaaagggcguuuuugaugaggcuaagaagacgguggaagcccugaacggguaucucgacaaacauaaggaugagguggacaaagccucugcugacuccaugaucaccaaccugcuuaagcacauugcgaaagcccaagagcuguacaagaauagcuccgcucuccgcgcccagggagcccagaucgauacagucuucucuagcuacuauuggcuguacaaggcuggcgugaccccugacacauuuccgaccguuucccaguuccuguucgaacucggcaaacaacccagagggacgaagaaaaugaagaaagcccugcuuagcacaccuaugaaguggggaaagaaacuguaugagcucuuugcggaugacucuuuccagcagaaccggaucuacaugcaucccgcugugcugaccgccggccgcauuuccgaaaugggggucugcuuuggaacaaucccuguggccaaucccgaugacgcugcccuuggcagcgggcacaccaagucuauucugaaccucagaaccaauacagagacgaacaauccgugugcuaaaaccaucguuaagcuguucgaaauucagaaaacaggauuuaacauccaagauauggacaucguggccagcgagcaucugcuccaccagucccuggucggcaagcagucuccuuuccaaaaugcguauaacgugaagggcaaugccaccagcgcuaacauuaucuga

SEQ ID NO: 7368 - RNA, 1449 nt, Artificial Sequence
  derived and/or modified CDS sequence (opt5) from CCHFV(Iran-Gilan69)__KJ027521.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaaaauucugggaccaucaagagcugggacgaaaacuaugccgagcugaaaguggauguuccgaagauugagcagcucgcuuccuaccagcaggccgcgcugaaguggagaaaagacaucggauuccgggugaaugccaacacagcugcccuuagcaauaagguccuggcugaauauaaagugcccggcgagaucguuaugucugugaaggaaaugcucuccgauaugauucgcagacggaaccugauccugaaucgcgggggagacgagaacccuagaggccccgucagccgggaacacguggaguggugucgcgaguuugugaaaggcaaguacauuauggccuucaauccucccuggggagauaucaacaaaucuggaagauccggcauugcgcucgucgccaccgggcuggcuaagcucgccgaaacagagggaaagggcguuuuugacgaagcuaaaaagaccguggaggcccugaacggguaucucgauaaacaucgggacgaaguggacaaggccagcgcugauucuaugaucacgaaucugcuuaaacacauugcgaaggcccaagagcuguacaagaacuccagcgcucuccgcgcccagggagcccagaucgacaccccuuucuccucuuuuuacuggcuguauaaagcuggcgucacaccggagaccuuccccacaaucagccaguuccuguuugaacucggcaagcaaccuagagggaccaaaaagaugaaaaaggcccugcuuuccacgcccaugaagugggggaaaaagcuguacgagcuuuucgcggaugacagcuuucagcagaaucggauuuauaugcauccugcugugcugacagccggccgcaucucugaaauggggguuugcuucggaaccauucccguggccaacccggaugacgcugcccagggcuccgggcacacaaaaagcauccuuaaucugagaaccucuaccgagacaaacaauccuugugcuaagacgauugucaaacucuuugaaauccaaaagaccggauucaacauccaggauauggacauuguggccagcgagcaucugcugcaccagucccucguuggcaagcaaucucccuuucagaaugcguacaacgugaaaggcaaugccacaagcgcuaacaucauuuga

SEQ ID NO: 7369 - RNA, 1449 nt, Artificial Sequence
  derived and/or modified CDS sequence (opt5) from CCHFV(Iran-Isfahan78)__KJ027522.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaaaauucugggaccaucaagagcugggacgaaaacuaugccgagcugaaaguggauguuccgaagauugagcagcucgcuaauuaccagcaggccgcgcugaaguggagaaaagacaucggauuccgggugaacgccaauacagcugcccuuuccaacaagguccuggcugaauauaaagugcccggcgagaucguuaugagcgugaaggaaaugcucucugauaugauucgcagacggaaucugauccugaaccgcgggggagacgagaauccuagaggccccgucucccgggaacacguggaguggugucgcgaguuugugaaaggcaaguacauuauggccuucaacccucccuggggagauaucaacaaaagcggaagaucuggcauugcgcucgucgccaccgggcuggcuaagcucgccgaaacagagggaaagggcguuuuugacgaagcuaaaaagaccguggaggcccugaauggguaucucgauaaacaucgggacgaaguggacaaggccuccgcugauagcaugaucacgaaccugcuuaaacacauugcgaaggcccaagagcuguacaaaaauucuuccgcucuccgcgcccagggagcccagaucgacaccccuuucagcuccuuuuacuggcuguauaaggcuggcgucacaccggagaccuuccccacagugucucaguuccuguuugaacucggcaagcaaccuagagggaccaaaaagaugaaaaaggcccugcuuagcacgcccaugaagugggggaaaaagcuguacgagcuuuucgcggaugacuccuuucagcagaaccggaucuauaugcauccugcuguucugacagccggccgcauuagcgaaaugggggugugcuucggaaccauccccgucgccaauccggaugacgcugcccagggcucugggcacacaaaauccauucuuaaccugagaaccagcaccgagacaaauaacccuugugcuaagacgaucgugaaacucuuugaaauucaaaagaccggauucaauauccaggauauggacaucguugccucugagcaucugcugcaccagagccucgugggcaagcaaucccccuuucagaacgcguacaaugucaaaggcaacgccacaucugcuaauauuaucuga

SEQ ID NO: 7370 - RNA, 1449 nt, Artificial Sequence
  derived and/or modified CDS sequence (opt5) from CCHFV(Iran-KhRazavi72)__KJ485700.1__N
auggagaacaagaucgaagugaaaaauaagcacgagaaaaacaagugguucgaagaguuuaaaaagggcaaugggcuggucgacaccuuccccaacagcuacuccuuuugcgaaaauguuccuaaccucgauagauucguguuucagauggccggagcuacagacgaugcccaaaaggacucuauuuaugcgagcgcucugguggaggccacgaaauucugugccccgaucuacgagugcgcuugggccuccucuaccggcauugucaagaaagggcuugaaugguuugagaagaaugcuggaacaaucaaaagcugggaugaauccuauaccgagcugaagguggagguucccaagauugaacagcucucuaacuaccagcaggccgcgcugaaauggcggaaggacaucggcuuccgcgggaaugccaacacagcugcccuuagcaauaaagugcuggcugaguauaaggucccuggagaaaucgugauguccguuaaagagaugcucagcgauaugauuagacggcgcaaccugauccugaauagaggcggcgacgaaaacccccgggggccugugucucgcgagcaugucgagugguguagagaauuuauuaagggaaaauacaucauggccuucaaucccccuuggggcgauauuaacaaguccgggcggagcggaaucgcgcucguggccaccggccuggcuaagcuggccgagacagaagggaaaggaguguuugacgaggcuaagaaaaccgucgaagcccugaacggcuaucucgauaagcacaaagacgagguugauaaggccucugcugacuccaugauuacgaaucugcuuaagcauaucgcgaaagcccaagagcuguacaagaacagcucugcucuccgcgcccagggcgcccagaucgacaccguguucuccagcuacuauuggcuguacaaagcuggggugacaccggaaaccuuucccacagucucccaguuccuguucgagcucggaaagcaaccuagaggcaccaaaaagaugaagaaagcccugcuuucuacgcccaugaagugggggaaaaagcuguaugaacucuuugcggaugacagcuuccagcagaaucggauuuacaugcacccugcugugcugacagccggacgcaucuccgagaugggcguuugcuuugggaccauucccguggccaacccggaugacgcugcccuuggaagcggccauacaaaaucuauccugaaucucagaaccaacaccgaaacaaauaacccuugugcuaagacgauugucaagcuguucgagauccagaaaaccggcuuuaauauccaagauauggacauuguggccuccgagcaccuucuccaccagagccugguugggaagcagucucccuuccaaaacgcguauaaugugaaaggaaacgccacaagcgcuaauaucauuuga

SEQ ID NO: 7371 - RNA, 1449 nt, Artificial Sequence
  derived and/or modified CDS sequence (opt5) from CCHFV(Iran-Zahedan19)__KJ676542.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccggagcuacggaugacgcccaaaaagauagcauuuaugcguccgcucugguggaggccaccaaguucugugccccuaucuacgagugcgcuugggucucuagcacaggcauugugaagaaagggcuugaaugguuugagaagaaugccggaaccaucaaauccugggacgaaucuuauacagagcugaagguugaggugccgaaaauugaacagcucgcuaacuaccagcaggccgcgcugaaguggcggaaggauaucggcuuccgcgucaaugccaacaccgcugcccuuagccacaaagugcuggcugaguauaagguucccggggaaaucgugauguccgucaaagagaugcucagcgacaugauuagacggcgcaaucugauccugaacagaggaggcgaugaaaauccucggggccccgugucucgcgagcacguggagugguguagagaauuugucaaggggaaauacauuauggccuucaacccucccuggggagacaucaauaaguccggccggagcgggauugcgcucaucgccacaggacuggcuaaacuugccgagaccgaaggcaaggggguuuuugaugaggcuaagaaaacgguggaagcccugaacggauaucucgacaagcacaaagaugagguggacaaggccucugcugacaacaugauuaccaaucugcuuaaacauaucgcgaaggcccaagagcuguacaagaacuccagcgcucuccgcgcccagggcgcccagaucgauacagcuuucucuuccuacuauuggcuguacaaagccggcgucaccccugaaacauuuccgaccgugagccaguuccuguucgagcucgggaagcaacccagaggaacgaaaaagaugaaaaaggcgcugcuuuccacaccuaugcgguggggcaagaaacuguaugaacucuuugcugacgauucuuuccagcagaaucgcauuuacaugcaccccgccguucugaccgccgggagaaucagcgagaugggagugugcuuuggcacaauuccugucgcuaaccccgacgaugccgcucagggguccggacauaccaagagcauccuuaaucugcggaccaacacagaaacgaauaacccgugugccaaaaccauugugaaacucuucgagauccaaaagacaggcuuuaauauccaggacauggauauuguugcgucugagcaucugcugcaccagucccucgugggcaagcaaagcccuuuccagaacgccuauaaugucaaggggaacgcuaccucugccaauaucauuuga

SEQ ID NO: 7372 - RNA, 1449 nt, Artificial Sequence
  derived and/or modified CDS sequence (opt5) from CCHFV(NIV 112143)__JN572089.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagaaaggccuugaaugguuugagaagaaugccgggaccaucaaaucuugggacgaaagcuauacagagcugaagguugaggugccgaaaauugaacagcucgcuaacuaccagcaggccgcgcugaaguggcggaaggauaucggauuccgcgucaaugccaacaccgcugcccuuucccacaaagugcuggcugaguauaagguucccggcgaaaucgugaugagcgucaaagagaugcucucugacaugauuagacggcgcaaucugauccugaacagagggggagaugaaaauccucggggccccgugucccgcgagcacguggagugguguagagaauuugucaagggcaaauacauuauggccuucaacccucccuggggagacaucaauaagagcgggcggucuggcauugcgcucaucgccacagggcuggcuaaacuugccgagaccgaaggaaagggcguuuuugaugaggcuaagaaaacgguggaagcccugaacggguaucucgacaagcacaaagaugagguggacaaggccuccgcugacaacaugauuaccaaucugcuuaaacauaucgcgaaggcccaagagcuguacaagaacagcucugcucuccgcgcccagggagcccagaucgauacagcuuucuccagcuacuauuggcuguacaaagccggcgucaccccugaaacauuuccgaccgugucccaguuccuguucgagcucggcaagcaacccagagggacgaaaaagaugaaaaaggcgcugcuuucuacaccuaugcgguggggaaagaaacuguaugaacucuuugcugacgauagcuuccagcagaaucgcauuuacaugcaccccgccguucugaccgccggcagaaucuccgagaugggggugugcuuuggaacaauuccugucgcuaaccccgacgaugccgcucagggcagcgggcauaccaagucuauccuuaaucugcggaccaacacagaaacgaauaacccgugugccaaaaccauugugaaacucuucgagauccaaaagacaggauuuaauauccaggacauggauauuguugcguccgagcaucugcugcaccagagccucgugggcaagcaaucuccuuuccagaacgccuauaaugucaagggcaacgcuaccagcgccaauaucauuuga

SEQ ID NO: 7373 - RNA, 1449 nt, Artificial Sequence
  derived and/or modified CDS sequence (opt5) from CCHFV(NIVA 118595)__JN572088.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagaaaggccuugaaugguuugagaagaaugccgggaccaucaaaucuugggacgaaagcuauacagagcugaagguugaggugccgaaaauugaacagcucgcuaacuaccagcaggccgcgcugaaguggcggaaggauaucggauuccgcgucaaugccaacaccgcugcccuuucccacaaagugcuggcugaguauaagguucccggcgaaaucgugaugagcgucaaagagaugcucucugacaugauuagacggcgcaaucugauccugaacagagggggagaugaaaauccucggggccccgugucccgcgagcacguggagugguguagagaauuugucaagggcaaauacauuauggccuucaacccucccuggggagacaucaauaagagcgggcggucuggcauugcgcucguugccacagggcuggcuaaacuugccgagaccgaaggaaagggcguguuugaugaggcuaagaaaacgguggaagcccugaacggguaucucgacaagcacaaagaugaggucgacaaggccuccgcugacaacaugaucaccaaucugcuuaaacauauugcgaaggcccaagagcuguacaagaacagcucugcucuccgcgcccagggagcccagaucgauacagcuuucuccagcuacuauuggcuguacaaagccggcgugaccccugaaacauuuccgaccguuucccaguuccuguucgagcucggcaagcaacccagagggacgaaaaagaugaaaaaggcgcugcuuucuacaccuaugcgguggggaaagaaacuguaugaacucuuugcugacgauagcuuccagcagaaucgcaucuacaugcaccccgccgugcugaccgccggcagaauuuccgagaugggggucugcuuuggaacaaucccuguggcuaaccccgacgaugccgcucagggcagcgggcauaccaagucuauucuuaaucugcggaccaacacagaaacgaauaacccgugugccaaaaccaucguuaaacucuucgagauucaaaagacaggauuuaauauccaggacauggauaucguggcguccgagcaucugcugcaccagagccucgucggcaagcaaucuccuuuccagaacgccuauaaugugaagggcaacgcuaccagcgccaauauuaucuga

SEQ ID NO: 7374 - RNA, 1449 nt, Artificial Sequence
  derived and/or modified CDS sequence (opt5) from CCHFV(SPU 130/89)__KJ682821.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccagcgcuacggaugacgcccaaaaggauuccauuuaugcgucugcucugguggaggccaccaaguucugugccccuaucuacgagugcgcuugggucagcuccacaggaauugugaaaagaggccuugaaugguuugagaagaaugccgggaccaucaaaucuugggacgaaagcuauacagagcugaagguugaugugccgaaaauugagcagcucgcuaacuaccagcaggccgcgcugaaguggcggaaggacaucggauuccgcgucaaugccaacaccgcugcccuuuccaauaaagugcuggcugaauauaagguucccggcgagaucgugaugagcgucaaagaaaugcucucugauaugauuagacggcgcaaccaaauccugaauagagggggagacgagaacccucggggccccgugucccgcgaacacguggauugguguagagaguuugucaagggcaaauacauuauggccuucaauccucccuggggagacaucaacaagagcgggcggucuggcauugcgcugguugccacagggcucgcuaaacuggccgagaccgaaggaaagggcguguuugaugaggcuaagaaaacgguggaagcccuuaacggguaucuggacaagcauaaagacgaggucgaucgcgccuccgcugacagcaugaucaccaaucuccugaagcacauugcgaaagcccaggaacuuuacaagaacucuuccgcucugagagcccagggagcccagaucgauacagcuuucagcuccuacuauuggcucuacaaggccggcgugaccccugagacauuuccgaccguuucucaauuccuguucgagcugggcaaacagccccgggggacgaagaaaaugaagaaagcgcuccugagcacaccuaugaaguggggaaagaaacuuuaugaacuguuugcugacgauuccuuccagcagaaucgcaucuacaugcaucccgccgugcucaccgccggcagaauuagcgagaugggggucugcuuuggaacaaucccuguggcuaaccccgacgaugccgcucaaggcucugggcacaccaaguccauucugaaucuucggaccaacacagaaacgaauaacccgugugcccgcaccaucguuaaacuguucgagauucagaagacaggauuuaauauccaggacauggauaucguggcgagcgaacaucuccugcaccaaucucuggucggcaaacagagcccuuuccagaacgccuauaaugugaagggcaacgcuaccuccgccaauauugucuga

SEQ ID NO: 7375 - RNA, 1449 nt, Artificial Sequence
  derived and/or modified CDS sequence (opt5) from CCHFV(SPU 18/88)__KJ682818.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccagcgcuacggaugacgcccaaaaggauuccauuuaugcgucugcucugguggaggccaccaaguucugugccccuaucuacgagugcgcuugggucagcuccacaggaauugugaaaagaggccuugaaugguuugagaagaaugccgggaccaucaaaucuugggacgaaagcuauacagagcugaagguugaugugccgaaaauugagcagcucgcuaacuaccagcaggccgcgcugaaguggcggaaggacaucggauuccgcgucaaugccaacaccgcugcccuuuccaauaaagugcuggcugaauauaagguucccggcgagaucgugaugagcgucaaagaaaugcucucugauaugauuagacggcgcaaccaaauccugaauagagggggagacgagaacccucggggccccgugucccgcgaacacguggauugguguagagaguuugucaagggcaaauacauuauggccuucaauccucccuggggagacaucaacaagagcgggcggucuggcauugcgcugguugccacagggcucgcuaaacuggccgagaccgaaggaaagggcguguuugaugaggcuaagaaaacgguggaagcccuuaacggguaucuggacaagcauaaagacgaggucgaucgcgccuccgcugacagcauggugaccaaucuccugaagcacaucgcgaaagcccaggaacuuuacaagaacucuuccgcucugagagcccagggagcccagauugauacagcuuucagcuccuacuauuggcucuacaaggccggcguuaccccugagacauuuccgaccgugucucaauuccuguucgagcugggcaaacagccccgggggacgaagaaaaugaagaaagcgcuccugagcacaccuaugaaguggggaaagaaacuuuaugaacuguuugcugacgauuccuuccagcagaaucgcaucuacaugcaucccgccguccucaccgccggcagaaucagcgagaugggggugugcuuuggaacaauuccuguugcuaaccccgacgaugccgcucaaggcucugggcacaccaaguccauccugaaucuucggaccaacacagaaacgaauaacccgugugcccgcaccauugugaaacuguucgagauccagaagacaggauuuaauauucaggacauggauaucgucgcgagcgaacaucuccugcaccaaucucuggugggcaaacagagcccuuuccagaacgccuauaaugucaagggcaacgcuaccuccgccaauaucauuuga

SEQ ID NO: 7376 - RNA, 1449 nt, Artificial Sequence
  derived and/or modified CDS sequence (opt5) from CCHFV(SPU 187/90)__KJ682823.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccagcgcuacggaugacgcccaaaaggauuccauuuaugcgucugcucugguggaggccaccaaguucugugccccuaucuacgagugcgcuugggucagcuccacaggaauugugaaaagaggccuugaaugguuugagaagaaugccgggaccaucaaaucuugggacgaaagcuauacagagcugaagguugaugugccgaaaauugagcagcucgcuaacuaccagcaggccgcgcugaaguggcggaaggacaucggauuccgcgucaaugccaacaccgcugcccuuuccaauaaagugcuggcugaauauaagguucccggcgagaucgugaugagcgucaaagaaaugcucucugauaugauuagacggcgcaaccaaauccugaauagagggggagacgagaacccucggggccccgugucccgcgaacacguggauugguguagagaguuugucaagggcaaauacauuauggccuucaauccucccuggggagacaucaacaagagcgggcggucuggcauugcgcugguugccacagggcucgcuaaacuggccgagaccgaaggaaagggcguguuugaugaggcuaagaaaacgguggaagcccuuaacggguaucuggacaagcauaaagacgaggucgaucgcgccuccgcugacagcaugaucaccaaucuccugaagcacauugcgaaagcccaggaacuuuacaagaacucuuccgcucugagagcccagggagcccagaucgauacagcuuucagcuccuacuauuggcucuacaaggccggcgugaccccugagacauuuccgaccguuucucaauuccuguucgagcugggcaaacagccccgggggacgaagaaaaugaagaaagcgcuccugagcacaccuaugaaguggggaaagaaacuuuaugaacuguuugcugacgauuccuuccagcagaaucgcaucuacaugcaucccgccgugcucaccgccggcagaauuagcgagaugggggucugcuuuggaacaaucccuguggcuaaccccgacgaugccgcucaaggcucugggcacaccaaguccauucugaaucuucagaccaacacagaaacgaauaacccgugugcccggaccaucguuaaacuguucgagauucagaagacaggauuuaauauccaagacauggauaucguggcgagcgaacaucuccugcaccagucucuggucggcaaacagagcccuuuccagaacgccuauaaugugaagggcaacgcuaccuccgccaauauuaucuga

SEQ ID NO: 7377 - RNA, 1449 nt, Artificial Sequence
  derived and/or modified CDS sequence (opt5) from CCHFV(SPU 383/87)__KJ682816.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccggagcuacggaugacgcccaaaaggauagcauuuaugcguccgcucugguggaggccaccaaguucugugccccuaucuacgagugcgcuugggucucuagcacaggcauugugaaaagagggcuugaaugguuugagaagaaugccggaaccaucaaauccugggacgaaucuuauacagagcugaagguugaugugccgaaaauugagcagcucgcuaacuaccagcaggccgcgcugaaguggcggaaggacaucggcuuccgcgucaaugccaacaccgcugcccuuagcaauaaagugcuggcugaauauaagguucccggggagaucgugauguccgucaaagaaaugcucagcgauaugauuagacggcgcaaccaaauccugaauagaggaggcgacgagaacccucggggccccgugucucgcgaacacguggauugguguagagaguuugucaaggggaaauacauuauggccuucaauccucccuggggagacaucaacaaguccggccggagcgggauugcgcugguugccacaggacucgcuaaacuggccgagaccgaaggcaaggggguguuugaugaggcuaagaaaacgguggaagcccuuaacggauaucuggacaagcauaaagacgaggucgaucgcgccucugcugacuccaugaucaccaaucuccugaagcacauugcgaaagcccaggaacuuuacaagaacagcucugcucugagagcccagggcgcccagaucgauacagcuuucuccagcuacuauuggcucuacaaggccggcgugaccccugagacauuuccgaccguuucccaauuccuguucgagcuggggaaacagccccggggaacgaagaaaaugaagaaagcgcuccugucuacaccuaugaaguggggcaagaaacuuuaugaacuguuugcugacgauagcuuccagcagaaucgcaucuacaugcaucccgccgugcucaccgccgggagaauuuccgagaugggagucugcuuuggcacaaucccuguggcuaaccccgacgaugccgcucaagggagcggacacaccaagucuauucugaaucuucggaccaacacagaaacguccaauccgugugcccgcaccaucguuaaacuguucgagauucagaagacaggcuuuaacauccaggacauggauaucguggcgagcgaacaucuccugcaccaaucucuggucggcaaacagagcccuuuccagaaugccuauaacgugaaggggaaugcuaccuccgccaacauugucuga

SEQ ID NO: 7378 - RNA, 1449 nt, Artificial Sequence
  derived and/or modified CDS sequence (opt5) from CCHFV(SPU 383/87)__KJ682816.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccggagcuacggaugacgcccaaaaggauagcauuuaugcguccgcucugguggaggccaccaaguucugugccccuaucuacgagugcgcuugggucucuagcacaggcauugugaaaagagggcuugaaugguuugagaagaaugccggaaccaucaaauccugggacgaaucuuauacagagcugaagguugaugugccgaaaauugagcagcucgcuaacuaccagcaggccgcgcugaaguggcggaaggacaucggcuuccgcgucaaugccaacaccgcugcccuuagcaauaaagugcuggcugaauauaagguucccggggagaucgugauguccgucaaagaaaugcucagcgauaugauuagacggcgcaaccaaauccugaauagaggaggcgacgagaacccucggggccccgugucucgcgaacacguggauugguguagagaguuugucaaggggaaauacauuauggccuucaauccucccuggggagacaucaacaaguccggccggagcgggauugcgcugguugccacaggacucgcuaaacuggccgagaccgaaggcaaggggguguuugaugaggcuaagaaaacgguggaagcccuuaacggauaucuggacaagcauaaagacgaggucgaucgcgccucugcugacuccaugaucaccaaucuccugaagcacauugcgaaagcccaggaacuuuacaagaacagcucugcucugagagcccagggcgcccagaucgauacagcuuucuccagcuacuauuggcucuacaaggccggcgugaccccugagacauuuccgaccguuucccaauuccuguucgagcuggggaaacagccccggggaacgaagaaaaugaagaaagcgcuccugucuacaccuaugaaguggggcaagaaacuuuaugaacuguuugcugacgauagcuuccagcagaaucgcaucuacaugcaucccgccgugcucaccgccgggagaauuuccgagaugggagucugcuuuggcacaaucccuguggcuaaccccgacgaugccgcucaagggagcggacacaccaagucuauucugaaucuucggaccaacacagaaacguccaauccgugugcccgcaccaucguuaaacuguucgagauucagaagacaggcuuuaacauccaggacauggauaucguggcgagcgaacaucuccugcaccaaucucuggucggcaaacagagcccuuuccagaaugccuauaacgugaaggggaaugcuaccuccgccaacauuaucuga

SEQ ID NO: 7379 - RNA, 1449 nt, Artificial Sequence
  derived and/or modified CDS sequence (opt5) from CCHFV(SPU 431/85)__KJ682815.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccagcgcuacggaugacgcccaaaaggauuccauuuaugcgucugcucugguggaggccaccaaguucugugccccugucuacgagugcgcuugggugagcuccacaggaaucguuaaaagaggccuugaaugguuugagaagaaugccgggaccauuaaaucuugggacgaaagcuauacagagcugaagguggaugucccgaaaaucgagcagcucgcuaacuaccagcaggccgcgcugaaguggcggaaggacauuggauuccgcgugaaugccaacaccgcugcccuuuccaauaaaguucuggcugaauauaaggugcccggcgagaucgucaugagcgugaaagaaaugcucucugauaugaucagacggcgcaaccaaauucugaauagagggggagacgagaacccucggggccccgugucccgcgaacacgucgauugguguagagaguuuguuaagggcaaauacaucauggccuucaauccucccuggggagacauuaacaagagcgggcggucuggcaucgcgcugguggccacagggcucgcuaaacuggccgagaccgaaggaaagggcguguuugaugaggcuaagaaaacggucgaagcccuuaacggguaucuggacaagcauaaagacgagguggaucgcgccuccgcugacagcaugauuaccaaucuccugaagcacaucgcgaaagcccaggaacuuuacaagaacucuuccgcucugagagcccagggagcccagauugauacagcuuucagcuccuacuauuggcucuacaaggccggcguuaccccugagacauuuccgaccgugucucaauuccuguucgagcugggcaaacagccccgggggacgaagaaaaugaagaaagcgcuccugagcacaccuaugaaguggggaaagaaacuuuaugaacuguuugcugacgauaccuuccagcagaaucgcaucuacaugcaucccgccguccucacagccggcagaaucuccgagaugggggugugcuuuggaaccauuccuguugcuaaccccgacgaugccgcucaaggcagcgggcacaccaagucuauccugaaucuucggacaaacacggaaaccaauaacccgugugcccgcacaauugugaaacuguucgagauccagaagaccggauuuaauauucaggacauggauaucgucgcguccgaacaucuccugcaccaaagccuggugggcaaacagucuccuuuccagaacgccuauaaugucaagggcaacgcuacaagcgugaauaucauuuga

SEQ ID NO: 7380 - RNA, 1449 nt, Artificial Sequence
  derived and/or modified CDS sequence (opt5) from CCHFV(SPU 45/88)__KJ682819.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccagcgcuacggaugacgcccaaaaggauuccauuuaugcgucugcucugguggaggccaccaaguucugugccccuaucuacgagugcgcuugggucagcuccacaggaauugugaaaagaggccuugaaugguuugagaagaaugccgggaccaucaaaucuugggacgaaagcuauacagagcugaagguugaugugccgaaaauugagcagcucgcuaacuaccagcaggccgcgcugaaguggcggaaggacaucggauuccgcgucaaugccaacaccgcugcccuuuccaauaaagugcuggcugaauauaagguucccggcgagaucgugaugagcgucaaagaaaugcucucugauaugauuagacggcgcaaccaaauccugaauagagggggagacgagaacccucggggccccgugucccgcgaacacguggauugguguagagaguuugucaagggcaaauacauuauggccuucaauccucccuggggagacaucaacaagagcgggcggucuggcauugcgcugguugccacagggcucgcuaaacuggccgagaccgaaggaaagggcguguuugaugaggcuaagaaaacgguggaagcccuuaacggguaucuggacaagcauaaagacgaggucgaucgcgccuccgcugacagcaugaucaccaaucuccugaagcacauugcgaaagcccaggaacuuuacaagaacucuuccgcucugagagcccagggagcccagaucgauacagcuuucagcuccuacuauuggcucuacaaggccggcgugaccccugagacauuuccgaccguuucucaauuccuguucgagcugggcaaacagccccgggggacgaagaaaaugaagaaagcgcuccugagcacaccuaugaaguggggaaagaaacuuuaugaacuguuugcugacgauuccuuccagcagaaucgcaucuacaugcaucccgccgugcucaccgccggcagaauuagcgagaugggggucugcuuuggaacaaucccuguggcuaaccccgacgaugccgcucaaggcucugggcacaccaaguccauucugaaucuucggaccaacacagaaacgaauaacccgugugcccgcaccaucguuaaacuguucgagauucagaagacaggauuuaauauccaggacauggauaucguggcgagcgaacaucuccugcaccaaucucuggucggcaaacagagcccuuuccagaacgccuauaaugugaagggcaacgcuaccuccgccaauauuaucuga

SEQ ID NO: 7381 - RNA, 1449 nt, Artificial Sequence
  derived and/or modified CDS sequence (opt5) from CCHFV(SPU 48/90)__KJ682822.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccagcgcuacggaugacgcccaaaaggauuccauuuaugcgucugcucugguggaggccaccaaguucugugccccuaucuacgagugcgcuugggucagcuccacaggaauugugaaaagaggccuugaaugguuugagaagaaugccgggaccaucaaaucuugggacgaaagcuauacagagcugaagguugaugugccgaaaauugagcagcucgcuaacuaccagcaggccgcgcugaaguggcggaaggacaucggauuccgcgucaaugccaacaccgcugcccuuuccaauaaagugcuggcugaauauaagguucccggcgagaucgugaugagcgucaaagaaaugcucucugauaugauuagacggcgcaaccaaauccugaauagagggggagacgagaacccucggggccccgugucccgcgaacacguggauugguguagagaguuugucaagggcaaauacauuauggccuucaauccucccuggggagacaucaacaagagcgggcggucuggcauugcgcugguugccacagggcucgcuaaacuggccgagaccgaaggaaagggcguguuugaugaggcuaagaaaacgguggaagcccuuaacggguaucuggacaagcauaaagacgaggucgaucgcgccuccgcugacagcaugaucaccaaucucuucaagcacauugcgaaagcccaggaacuguacaagaacucuuccgcucuuagagcccagggagcccagaucgauacagcuuuuagcuccuacuauuggcuguacaaggccggcgugaccccugagacauucccgaccguuucucaauuccucuuugagcugggcaaacagccccgggggacgaagaaaaugaagaaagcgcugcucagcacaccuaugaaguggggaaagaaacuguaugaacuuuucgcugacgauuccuuucagcagaaucgcaucuacaugcaucccgccgugcugaccgccggcagaauuagcgagaugggggucugcuucggaacaaucccuguggcuaaccccgacgaugccgcucaaggcucugggcacaccaaguccauucucaaucugcggaccaacacagaaacgaauaacccgugugcccgcaccaucguuaaacuuuuugagauucagaagacaggauucagcauccaggacauggauaucguggcgucugaacaucugcuccaccaaagccuggucggcaaacaguccccuuuucagaaugccuauaacgugaagggcaaugcuaccucugccaacauuaucuga

SEQ ID NO: 7382 - RNA, 1449 nt, Artificial Sequence
  derived and/or modified CDS sequence (opt5) from CCHFV(SPU 497/88)__KJ682820.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccagcgcuacggaugacgcccaaaaggauuccauuuaugcgucugcucugguggaggccaccaaguucugugccccuaucuacgagugcgcuugggucagcuccacaggaauugugaaaagaggccuugaaugguuugagaagaaugccgggaccaucaaaucuugggacgaaagcuauacagagcugaagguugaugugccgaaaauugagcagcucgcuaacuaccagcaggccgcgcugaaguggcggaaggacaucggauuccgcgucaaugccaacaccgcugcccuuuccaauaaagugcuggcugaauauaagguucccggcgagaucgugaugagcgucaaagaaaugcucucugauaugauuagacggcgcaaccaaauccugaauagagggggagacgagaacccucggggccccgugucccgcgaacacguggauugguguagagaguuugucaagggcaaauacauuauggccuucaauccucccuggggagacaucaacaagagcgggcggucuggcauugcgcugguugccacagggcucgcuaaacuggccgagaccgaaggaaagggcguguuugaugaggcuaagaaaacgguggaagcccuuaacggguaucuggacaagcauaaagacgaggucgaucgcgccuccgcugacagcaugaucaccaaucuccugaagcacauugcgaaagcccaggaacuuuacaagaacucuuccgcucugagagcccagggagcccagaucgauacagcuuucagcuccuacuauuggcucuacaaggccggcgugaccccugagacauuuccgaccguuucucaauuccuguucgagcugggcaaacagccccgggggacgaagaaaaugaagaaagcgcuccugagcacaccuaugaaguggggaaagaaacuuuaugaacuguuugcugacgauuccuuccagcagaaucgcaucuacaugcaucccgccgugcucaccgccggcagaauuagcgagaugggggucugcuuuggagcuaucccuguggccaaccccgacgaugcugcccaaggcucugggcacacaaaguccauucugaaucuucggaccaacaccgaaacaaauaacccgugugcgcgcacgaucguuaaacuguucgagauucagaagaccggauuuaauauccaggacauggauaucguggccagcgaacaucuccugcaccaaucucuggucggcaaacagagcccuuuccagaacgcuuauaaugugaagggcaacgccacauccgcuaauauuaucuga

SEQ ID NO: 7383 - RNA, 1449 nt, Artificial Sequence
  derived and/or modified CDS sequence (opt5) from CCHFV(SPU 556/87)__KJ682817.1__N
auggagaacaagaucgaagugaauaacaaagacgagaugaauagaugguucgaagaguuuaagaaaggcaacgggcuggucgauaccuucacaaauagcuacuccuuuugcgaaucuguucccaaccucgaccgguucguguuucagauggccggagcuacggaugacgcccaaaaggauagcauuuaugcguccgcucugguggaggccaccaaauucugugccccuaucuacgagugcgcuugggucucuagcacaggcauugugaagaaggggcuugaaugguuugagaaaaaugccggaaccaucaaguccugggacgaaucuuauacagagcugaaaguugaugugccgaagauugagcagcucgcuaacuaccagcaggccgcgcugaaauggcgcaaggacaucggcuucagagucaaugccaacaccgcugcccuuagcaauaaggugcuggcugaauauaaaguucccggggagaucgugauguccgucaaggaaaugcucagcgauaugauucggcgcagaaaccaaauccugaaucggggaggcgacgagaacccucgcggccccgugucuagagaacacguggauuggugucgggaguuugucaaagggaaguacauuauggccuucaauccucccuggggagacaucaacaaauccggccgcagcgggauugcgcugguugccacaggacucgcuaagcuggccgagaccgaaggcaaagggguguuugaugaggcuaagaagacgguggaagcccuuaacggauaucuggacaaacauaaggacgaggucgauagagccucugcugacuccaugaucaccaaucuccugaaacacauugcgaaggcccaggaacuuuacaaaaacagcucugcucugcgggcccagggcgcccagaucgauacagcuuucuccagcuacuauuggcucuacaaggccggcgugaccccugagacauuuccgaccguuucccaauuccuguucgagcuggggaagcagccccgcggaacgaaaaagaugaaaaaggcgcuccugucuacaccuaugaaauggggcaagaaacuuuaugaacuguuugcugacgauagcuuccagcagaauagaaucuacaugcaucccgccgugcucaccgccgggcggauuuccgagaugggagucugcuuuggcacaaucccuguggcuaaccccgacgaugccgcucaagggagcggacacaccaagucuauucugaaucuucgcaccaacacagaaacgaauaacccgugugccaagaccaucguuaaacuguucgagauucagaagacaggcuuuaauauccaggacauggauaucguggcguccgaacaucuccugcaccaaagccuggucggcaaacagucuccuuuccagaacgccuauaaugugaaggggaacgcuaccagcgccaauauuaucuga

SEQ ID NO: 7384 - RNA, 1449 nt, Artificial Sequence
  derived and/or modified CDS sequence (opt5) from CCHFV(SPU 92/01)__KC880335.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccagcgcuacggaugacgcccaaaaggauuccauuuaugcgucugcucugguggaggccaccaaguucugugccccuaucuacgagugcgcuugggucagcuccacaggaauugugaaaagaggccuugaaugguuugagaagaaugccgggaccaucaaaucuugggacgaaagcuauacagagcugaagguugaugugccgaaaauugagcagcucgcuaacuaccagcaggccgcgcugaaguggcggaaggacaucggauuccgcgucaaugccaacaccgcugcccuuuccaauaaagugcuggcugaauauaagguucccggcgagaucgugaugagcgucaaagaaaugcucucugauaugauuagacggcgcaaccaaauccugaauagagggggagacgagaacccucggggccccgugucccgcgaacacguggauugguguagagaguuugucaagggcaaauacauuauggccuucaauccucccuggggagacaucaacaagagcgggcggucuggcauugcgcugguugccacagggcucgcuaaacuggccgagaccgaaggaaagggcguguuugaugaggcuaagaaaacgguggaagcccuuaacggguaucuggacaagcauaaagacgaggucgaucgcgccuccgcugacagcaugaucaccaaucuccugaagcacauugcgaaagcccaggaacuuuacaagaacucuuccgcucugagagcccagggagcccagaucgauacagcuuucagcuccuacuauuggcucuacaaggccggcgugaccccugagacauuuccgaccguuucucaauuccuguucgagcugggcaaacagccccgggggacgaagaaaaugaagaaagcgcuccugagcacaccuaugaaguggggaaagaaacuuuaugaacuguuugcugacgauuccuuccagcagaaucgcaucuacaugcaucccgccgugcucaccgccggcagaauuagcgagaugggggucugcuuuggaacaaucccuguggcuaaccccgacgaugccgcucaaggcucugggcacaccaaguccauucugaaucuucagaccaacacagaaacgaauaacccgugugcccggaccaucguuaaacuguucgagauucagaagacaggauuuaauauccaagacauggauaucguggcgagcgaacaucuccugcaccagucucuggucggcaaacagagcccuuuccagaacgccuauaaugugaagggcaacgcuaccuccgucaauauuaucuga

SEQ ID NO: 7385 - RNA, 1449 nt, Artificial Sequence
  derived and/or modified CDS sequence (opt5) from CCHFV(SRR)__KU707901.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccggagcuacggaugacgcccaaaaagauagcauuuaugcguccgcucugguggaggccaccaaguucugugccccuaucuacgagugcgcuugggucucuagcacaggcauugugaagaaagggcuugaaugguuugagaagaaugccggaaccaucaaauccugggacgaaucuuauacagagcugaagguugaggugccgaaaauugaacagcucgcuaacuaccagcaggccgcgcugaaguggcggaaggauaucggcuuccgcgucaaugccaacaccgcugcccuuagccacaaagugcuggcugaguauaagguucccggggaaaucgugauguccgucaaagagaugcucagcgacaugauuagacggcgcaaucugauccugaacagaggaggcgaugaaaauccucggggccccgugucucgcgagcacguggagugguguagagaauuugucaaggggaaauacauuauggccuucaacccucccuggggagacaucaauaaguccggccggagcgggauugcgcucguugccacaggacuggcuaaacuugccgagaccgaaggcaaggggguguuugaugaggcuaagaaaacgguggaagcccugaacggauaucucgacaagcacaaagaugaggucgacaaggccucugcugacaacaugaucaccaaucugcuuaaacauauugcgaaggcccaagagcuguacaagaacuccagcgcucuccgcgcccagggcgcccagaucgauacagcuuucucuuccuacuauuggcuguacaaagccggcgugaccccugaaacauuuccgaccguuagccaguuccuguucgagcucgggaagcaacccagaggaacgaaaaagaugaaaaaggcgcugcuuuccacaccuaugcgguggggcaagaaacuguaugaacucuuugcugacgauucuuuccagcagaaucgcaucuacaugcaccccgccgugcugaccgccgggagaauuagcgagaugggagucugcuuuggcacaaucccuguggcuaaccccgacgaugccgcucagggguccggacauaccaagagcauucuuaaucugcggaccaacacagaaacgaauaacccgugugccaaaaccaucguuaaacucuucgagauucaaaagacaggcuuuaauauccaggacauggauaucguggcgucugagcaucugcugcaccagucccucgucggcaagcaaagcccuuuccagaacgccuauaaugugaaggggaacgcuaccucugccaauauuaucuga

SEQ ID NO: 7386 - RNA, 1449 nt, Artificial Sequence
  derived and/or modified CDS sequence (opt5) from CCHFV(STV/HU29223)__AF481802.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaaaauucugggaccaucaagagcugggacgaaaacuaugccgagcugaaaguggauguuccgaagauugagcagcucgcuaauuaccagcaggccgcgcugaaguggagaaaagacaucggauuccgggugaacgccaauacagcugcccuuuccaacaagguccuggcugaauauaaagugcccggcgagaucguuaugagcgugaaggaaaugcucucugauaugauucgcagacggaaucugauccugaaccgcgggggagacgagaaucucagaggcccugucucccgggaacacguggaguggugucgcgaguuugugaaaggcaaguacauuauggccuucaaucccccuuggggagauaucaacaaaagcggaagaucuggcauugcgcuggucgccaccgggcuugcuaagcuggccgaaacagagggaaagggcguuuuugacgaagcuaaaaagaccguggaggcccucaauggguaucuggauaaacaucgggacgaaguggacaaggccuccgcugauagcaugaucacgaaccuucugaaacacauugcgaaggcccaagagcucuacaagaacucuuccgcucugcgcgcccagggagcccagaucgacacccccuucagcuccuuuuacuggcuguauaaagcuggcgucacaccugagaccuucccgacaaucucucaguuccucuuugaacugggcaagcaacccagagggaccaaaaagaugaaaaaggcccuucugagcacgccuaugaagugggggaaaaagcucuacgagcuguucgcggaugacuccuuucagcagaaccggauuuauaugcaucccgcugugcuuacagccggccgcaucagcgaaauggggguuugcuucggaaccauuccuguggccaaucccgaugacgcugcccagggcucugggcacacaaaauccauccugaaccucagaaccagcaccgagacaaauaacccgugugcuaagacgauugucaaacuguuugaaauccaaaagaccggauucaauauccaggauauggacauuguggccucugagcaucugcuccaccagagccugguuggcaagcaauccccuuuucagaacgcguacaaugugaaaggcaacgccacaucugcuaauaucauuuga

SEQ ID NO: 7387 - RNA, 1449 nt, Artificial Sequence
  derived and/or modified CDS sequence (opt5) from CCHFV(TAJ/HU8966)__AY049083.2__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagaaaggccuugaaugguuugagaagaaugccgggaccaucaaaucuugggacgaaagcuauacagagcugaagguugaggugccgaaaauugaacagcucgcuaacuaccagcaggccgcgcugaaguggcggaaggauaucggauuccgcgucaaugccaacaccgcugcccuuucccacaaagugcuggcugaguauaagguucccggcgaaaucgugaugagcgucaaagagaugcucucugacaugauuagacggcgcaaucugauccugaacagagggggagaugaaaauccucggggccccgugucccgcgagcacguggagugguguagagaauuugucaagggcaaauacauuauggccuucaacccucccuggggagacaucaauaagagcggacggucuggcauugcgcucguugccacagggcuggcuaaacuugccgagaccgaaggaaagggcguguuugaugaggcuaagaaaacgguggaagcccugaacggguaucucgacaagcacaaagaugaggucgacaaggccuccgcugacaacaugaucaccaaucugcuuaaacauauugcgaaggcccaagagcuguacaagaacagcucugcucuccgcgcccagggagcccagaucgauacagcuuucuccagcuacuauuggcuguacaaagccggcgugaccccugaaacauuuccgaccguuucccaguuccuguucgagcucggcaagcaacccagagggacgaaaaagaugaaaaaggcgcugcuuucuacaccuaugaagugggggaaaaagcuguaugaacucuuugcugacgauagcuuccagcagaaucggaucuacaugcaccccgccgugcugaccgccggccgcauuuccgagaugggggucugcuuuggaacaaucccuguggcugaccccgaugacgccgcucagggcagcgggcauaccaaaucuauucuuaaccugagaaccaauacagaaacgaacaauccgugugccaagaccaucguuaaacucuucgagauucaaaagacaggauuuaacauccaggauauggacaucguggcguccgagcaucugcugcaccagagccucgucggcaagcaaucuccuuuccagaaugccuauaacgugaaaggcaaugcuaccagcgccaacauuaucuga

SEQ ID NO: 7388 - RNA, 1449 nt, Artificial Sequence
  derived and/or modified CDS sequence (opt5) from CCHFV(TAJ/HU8975)__AY297692.2__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagaaaggccuugaaugguuugagaagaaugccgggaccaucaaaucuugggacgaaagcuauauugagcugaagguugaggugccgaaaaucgaacagcucgcuaacuaccagcaggccgcgcugaaguggcggaaggauaucggauuccgcgucaaugccaacacagcugcccuuucccacaaagugcuggcugaguauaagguucccggcgaaauugugaugagcgucaaagagaugcucucugacaugaucagacggcgcaaucugauucugaacagagggggagaugaaaauccucggggccccgugucccgcgagcacguggagugguguagagaauuugucaagggcaaauacaucauggccuucaacccucccuggggagacauuaauaagagcggacggucuggcaucgcgcucguugccaccgggcuggcuaaacuugccgagacagaaggaaagggcguguuugaugaggcuaagaaaaccguggaagcccugaacggguaucucgacaagcacaaagaugaggucgacaaggccuccgcugacaacaugauuacgaaucugcuuaaacauaucgcgaaggcccaagagcuguacaagaacagcucugcucuccgcgcccagggagcccagaucgauaccgcuuucuccagcuacuauuggcuguacaaagccggcgugacaccugaaaccuuuccgacaguuucccaguuccuguucgagcucggcaagcaacccagagggaccaaaaagaugaaaaaggcgcugcuuucuacgccuaugaagugggggaaaaagcuguaugaacucuuugcugacgauagcuuccagcagaaucggauuuacaugcaccccgccgugcugacagccggccgcaucuccgagaugggggucugcuuuggaaccauuccuguggcuaaccccgacgaugccgcucagggcagcgggcauacaaaaucuauccuuaaucugagaaccaacaccgaaacaaauaacccgugugccaagacgauuguuaaacucuucgagauccaaaagaccggauuuaauauccaggacauggauauuguggcguccgagcaucugcugcaccagagccucgucggcaagcaaucuccuuuccagaacgccuauaaugugaaaggcaacgcuacaagcgccaauaucauuuga

SEQ ID NO: 7389 - RNA, 1449 nt, Artificial Sequence
  derived and/or modified CDS sequence (opt5) from CCHFV(TAJ/HU8978)__AY297691.2__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccggagcuacggaugacgcccaaaaagauagcauuuaugcguccgcucugguggaggccaccaaguucugugccccuaucuacgagugcgcuugggucucuagcacaggcauugugaagaaagggcuugaaugguuugagaagaaugccggaaccaucaaauccugggacgaaucuuauacagagcugaagguugaggugccgaaaauugaacagcucgcuaacuaccagcaggccgcgcugaaguggcggaaggauaucggcuuccgcgucaaugccaacaccgcugcccuuagccacaaagugcuggcugaguauaagguucccggggaaaucgugauguccgucaaagagaugcucagcgacaugauuagacggcgcaaucuguuucugaacagaggaggcgaugaaaauccucggggccccgugucucgcgagcacguggagugguguagagaguucgucaaggggaaauacaucauggccuuuaacccucccuggggagacauuaauaaguccggccggagcgggaucgcgcucguugccacaggacuggcuaaacuugccgaaaccgaaggcaaggggguguucgaugaggcuaagcgcacgguggaagcccugaacggauaucucgacaaacacaaggaugaggucgacaaagccucugcugacaacaugauuaccaaucugcuuaagcauaucgcgaaagcccaagagcuguacaagaacuccagcgcucucagagcccagggcgcccagauugauacaucuuuuuccagcuacuauuggcuguacaaggcuggccggaccccugaaacauucccgaccgugucccaguuccuguuugagcucgggaaacaaccccgcggaacgaagaaaaugaagaaagcccugcuuucuacaccuaugaaguggggcaagaaacuguaugaacucuucgcggacgauagcuuucagcagaauagaaucuacaugcaccccgcuguucugaccgccgggcggaucuccgagaugggagugugcuucggcacaauuccugucgccaaccccgacgaugcugcccaggggagcggacauaccaagucuauccuuaaucugcgcaccaacacagaaacgaauaacccgugugcuaaaaccauugugaagcucuuugagauccagaaaacaggcuucaauauucaagacauggauaucguugccuccgagcaucugcugcaccagagccucgugggcaagcaaucuccuuuucagaacgcguauaaugucaaggggaacgccaccagcgcuaauaucauuuga

SEQ ID NO: 7390 - RNA, 1449 nt, Artificial Sequence
  derived and/or modified CDS sequence (opt5) from CCHFV(Uzbek/TI10145)__AF481799.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagaaaggccuugaaugguuugagaagaaugccgggaccaucaaaucuugggacgaaagcuauacagagcugaagguugaggugccgaaaauugaacagcucgcugauuaccagcaggccgcgcugaaguggcggaaggacaucggauuccgcgucaacgccaauaccgcugcccuuucccacaaagugcuggcugaguauaagguucccggcgaaaucgugaugagcgucaaagagaugcucucugauaugauuagacggcgcaaccugauccugaauagagggggagacgaaaacccucggggccccgugucccgcgagcacguggagugguguagagaauuugucaagggcaaauacauuauggccuucaauccucccuggggagauaucaacaagagcggacggucuggcauugcgcucguugccacagggcuggcuaaacuugccgagaccgaaggaaagggcguguuugacgaggcuaagaaaacgguggaagcccugaauggguaucucgauaagcacaaagacgaggucgacaaggccuccgcugauaacaugaucaccaaccugcuuaaacauauugcgaaggcccaagagcuguacaagaauagcucugcucuccgcgcccagggagcccagaucgacacagcuuucuccagcuacuauuggcuguacaaagccggcgugaccccugaaacauuuccgaccguuucccaguuccuguucgagcucggcaagcaacccagagggacgaaaaagaugaaaaaggcgcugcuuucuacaccuaugaagugggggaaaaagcuguaugaacucuuugcugaugacagcuuccagcagaaccggaucuacaugcaccccgccgugcugaccgccggccgcauuuccgagaugggggucugcuuuggaacaaucccuguggcuaaucccgaugacgccgcucagggcagcgggcauaccaaaucuauucuuaaccugagaaccaauacagaaacgaacaauccgugugccaagaccaucguuaaacucuucgagauucaaaagacaggauuuaacauccaggauauggacaucguggcguccgagcaucugcugcaccagagccucgucggcaagcaaucuccuuuccagaaugccuauaacgugaaaggcaaugcuaccagcgccaacauuaucuga

SEQ ID NO: 7391 - RNA, 1449 nt, Artificial Sequence
  derived and/or modified CDS sequence (opt5) from CCHFV(ROS/TI28044)__AY277672.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaaaauucugggaccaucaagagcugggacgaaaacuaugccgagcugaaaguggauguuccgaagauugagcagcucgcuaauuaccagcaggccgcgcugaaguggagaaaagacaucggauuccgggugaacgccaauacagcugcccuuuccaacaagguccuggcugaauauaaagugcccggcgagaucguuaugagcgugaaggaaaugcucucugauaugauucgcagacggaaucugauccugaaccgcgggggagacgagaauccuagaggccccgucucccgggaacacguggaguggugucgcgaguuugugaaaggcaaguacauuauggccuucaacccucccuggggagauaucaacaaaccuggaagaagcggcauugcgcucgucgccaccgggcuggcuaaacuugccgaaacagagggaaagggcguuuuugacgaagcuaaaaagaccguggaggcccugaauggguaucucgauaaacaucgggacgaaguggacaaggccucugcugauuccaugaucgcgaaccugcuuaaacacauugccaaggcucaagagcuguacaagaauagcucugcccuccgcgcccagggagcucagaucgacacgccguucuccagcuuuuacuggcuguauaaagccggcgucacccccgagacauucccuaccaucucccaguuccuguuugaacucggcaagcaacccagagggacaaagaagaugaaaaaggcgcugcuuucuaccccuaugaagugggggaaaaagcuguacgaacucuucgcugaugacagcuuucagcagaaccggauuuauaugcaucccgccgugcugacggccggccgcaucuccgagauggggguuugcuucggaacaauuccgguggcuaauccugaugacgccgcucagggcagcgggcacaccaaaucuauccuuaaccugagaacauccaccgagaccaauaaccccugugccaagacaauugucaaacucuuugaaauccaaaagacgggauucaauauccaggauauggacauuguggcgagcgagcaucugcugcaccagucucucguuggcaagcaaagcccuuuucagaacgccuacaaugugaaaggcaacgcuaccuccgccaauaucauuuga

SEQ ID NO: 7392 - RNA, 1449 nt, Artificial Sequence
  derived and/or modified CDS sequence (opt5) from CCHFV(7001)__AF415236.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagcggggccuugaaugguuugagaaaaaugccgggaccaucaagucuugggacgaaagcuauacagagcugaaaguugaggugccgaagauugaacagcucgcugauuaccagcaggccgcgcugaaauggcgcaaggacaucggauucagagucaacgccaauaccacagcucuuucccacaaggugcuggccgaguauaaaguucccggcgaaaucgugaugagcgucaaggagaugcucucugauaugauucggcgcagaaaccugauccugaaucgcgggggagacgaauccccucggggccccgugagcagagagcacguggaguggugucgggaauuugucaaaggcaaguacauuauggcuuucaacccucccuggggagauaucaauaaaucugggcgcuccggcauugcccucguugcgaccgggcuggccaaacuugcugagacggaaggaaaaggcguguuugacgaggccaagaagaccguggaagcucugaacggguaucucaauaaacacaaggaugaggucgacaaagccagcgccgacucuaugaucacaaaccugcuuaagcauauugcuaaagcgcaagagcuguacaagaacuccagcgcccucagagcucagggagcccagaucgauaccgccuucuccucuuacuauuggcuguacaaggcuggcgugacaccugaaaccuuuccgacgguuagccaguuccuguucgagcucggcaaacaaccccgggggacaaagaaaaugaagaaagcccugcuuuccaccccucugaaguggggaaagaaacucuaugaacuguuugcggacgauagcuuccagcagaaucgcaucuacaugcaccccgcugugcuuacagccggcagaauuucugagaugggggucugcuuuggaaccaucccuguggccaaccccgacgaugcugcccagggcuccgggcauaccaagagcauucugaaucuccggacaaacacggaaaccaauaacccguguccuaaaacaaucguuaagcuguucgagauucaaaagaccggauuuaauauccaggacauggauaucguggcuucugagcaucugcuccaccagagccuggucggcaagcaaucccccuuccagaacgccuauaaugugaagggcaacgcgacaucugccaauauuaucuga

SEQ ID NO: 7393 - RNA, 1449 nt, Artificial Sequence
  derived and/or modified CDS sequence (opt5) from CCHFV(79121M18)__GU477494.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagcggggccuugaaugguuugagaaaaaugccgggaccaucaagucuugggacgaaagcuauacagagcugaaaguugaggugccgaagauugaacagcucgcugauuaccagcaggccgcgcugaaauggcgcaaggacaucggauucagagucaacgccaauaccacagcucuuucccacaaggugcuggccgaguauaaaguucccggcgaaaucgugaugagcgucaaggagaugcucucugauaugauucggcgcagaaaccugauccugaaucgcgggggagacgaauccccucggggccccgugagcagagagcacguggaguggugucgggaauuugucaaaggcaaguacauuauggcuuucaacccucccuggggagauaucaauaaaucugggcgcuccggcauugcccucguugcgaccgggcuggccaaacuugcugagacggaaggaaaaggcguguuugacgaggccaagaagaccguggaagcucugaacggguaucucaauaaacacaaggaugaggucgacaaagccagcgccgacucuaugaucacaaaccugcuuaagcauauugcuaaagcgcaagagcuguacaagaacuccagcgcccucagagcucagggagcccagaucgauaccgccuucuccucuuacuauuggcuguacaaggcuggcgugacaccugaaaccuuuccgacgguuagccaguuccuguucgagcucggcaaacaaccccgggggacaaagaaaaugaagaaagcccugcuuuccaccccucugaaguggggaaagaaacucuaugaacuguuugcggacgauagcuuccagcagaaucgcaucuacaugcaccccgcugugcuuacagccggcagaauuucugagaugggggucugcuuuggaaccaucccuguggccaaccccgacgaugcugcccagggcuccgggcauaccaagagcauucugaaucuccggacaaacacggaaaccaauaacccgugugcuaaaacaaucguuaagcuguucgagauucaaaagaccggauuuaauauccaggacauggauaucguggccucugagcaucugcuccaccagagccuggucggcaagcaauccccuuuccagaacgcguauaaugugaagggcaacgccacaucugcuaauauuaucuga

SEQ ID NO: 7394 - RNA, 1449 nt, Artificial Sequence
  derived and/or modified CDS sequence (opt5) from CCHFV(AP92)__DQ211638.1__N
auggagaacaagaucgaagugaauagcaaagacgaucugaacaagugguucgaggaauuuaaaaagggcaaugggcucgucgacaccuucacaaacuccuacucuuuuugcgagaauguucccaaccuggauagauucguguaucagauggccagcgcuacggacgaugcccaaaaagacuccauuuacgcgucugcucuuguggaagccaccaaguauugugccccuaucuacgagugcgcuugggucagcuccacaggaauugugaagaaaggccuggagugguuugaaaagaauaccucuacaaucaaaagcugggaugaguccuauaccgaacucaagguugacauuccgaaaaucgagcagcugagcucuuaccagcaggccgcucuuaaguggcggaaggauaucggguuccgcauuaacgccaauacaaccgcgcuguccaacaaagugcucgccgaguauaagguccccggagaaauccuggugccuguuaaagagaugcugagcgacaugauuagacggcgcaauaucauucucaacagaggcucugaugaaaauccccgggggccugugucccacgagcauaucgaauggugucgcgaguuuauuaagggaaaauacaucauggcuuucaaucccccuuggggcgacaucaacaagagcggcagaucugggauugcccuggucgcuacgggacuugccaaacuggcggagaccgaaggcaaggggguguuugaggaagccaagaaaacaguggaggcucucaaggauuaccuggacaaacaccgggacgaagucgauaagaccuccgccgacaacaugguuacaagccuucugaaacauaucgcuaaggcccaagagcucuauaagaacuccucugcccugcgcgcucagggagcgcagauugauaccccguucagcuccuuuuacuggcuguauaaagccggcgugacgcccgagacauucccuaccgugagccaguuucucuucgaacuggggaagcaacccagaggaaccaaaaagaugaaaaaggcucugcugucuacaccuaugaaguggggcaaaaagcucuacgagcuguucgccgacgauuccuuucagcagaaucggaucuauaugcaccccgccguccuuaccgcuggccgcauuagcgaaaugggggugugcuucggaacaaucccgguugccaacccugacgaugcggcucagggcucugggcauacgaaaagcauccugaaucucagaaccaacacagaguccaauaaccccugugcccggaccauugugaagcuguuugaaauccagaaaacaggauucgacauuaaggauauggacaucgucgccucugagcaccuucuccaccaaagccuggugggcaagcaguccccuuuucaaaaugcuuacaacguuaaagggaaugccaccagcgcuaacauuaucuga

SEQ ID NO: 7395 - RNA, 1449 nt, Artificial Sequence
  derived and/or modified CDS sequence (opt5) from CCHFV(ArD15786)__DQ211640.1__N
auggagaacaagaucgaagugaauaacaaagacgagcugaauaagugguucgaagaguuuaaaaagggcaacgggcucgucgauaccuucacaaauagcuacuccuuuugcgaaaacguucccaaucuggacagauucguguuucagauggccggagcuacggaugacgcccaaaaagauucuauuuaugcgagcgcucuuguggaggccaccaaguacugugccccuaucuaugagugcgcuugggucuccucuacaggcauugugaagcgggggcuggaaugguucgagaaaaacaccggaacaaucaagagcugggacgaauccuacaccgagcucaaaguugaugugccgaagauugagcagcuggccaauuaucagcaggcugcccuuaaauggcgcaaggacaucggcuuuagagucaacgcgaauacagccgcucugucuaacaaggugcucagcgaauacaaaguucccggggagaucgugauguccgucaaggaaaugcugagcgauaugauucggcgcagaaaucugauccucaaccggggaggcgacgagaauccucgcggccccgugucuaaagaacacauugagugguguagagaguucgugaaggggaaauauaucauggccuuuaacccucccuggggagaugucaacaaguccggccggagcgggauugcucugguugccaccggacuugcgaaacuggccgaaacggagggcaaggggguguucgaagaggcuaagaaaaccguggaagcccucaaggaguaccuggacaaacauaaggaugaggucgacaaggcuucugccgacuccauggugacaaaucuucugaaacacaucaccaaggcccaagaacucuacaaaaacagcucugcucugcgcgcgcagggagcccagauugauacaccuuuuuccagcuucuauuggcuguacaaggcuggcguuaccccggagacguuucccacagugucccaguuccucuucgaacugggcaaacaaccuagagggaccaagaaaaugaagaaggcccuucugucuacacccaugaaauggggaaagaaacucuaugagcuguuugccgacgauagcuuccagcagaaucggaucuacaugcauccugcuguccuuaccgccggccgcaucuccgaaaugggggugugcuuuggaaccauucccguugcgaacccggacgaugcugcccagggcagcgggcacacaaagucuauccugaaucucagaacgaacuccgagaccaauaacccuugugccaaaacaauugugaagcuguucgagguccaaaagaccggauuuaauauccaggacauggauauuguggcuagcgaacaucugcuccaccagucucuggucggcaaacaaagccccuuccagaacgccuauaaugugaagggcaacgcuacauccgccaauaucaucuga

SEQ ID NO: 7396 - RNA, 1449 nt, Artificial Sequence
  derived and/or modified CDS sequence (opt5) from CCHFV(ArD39554)__DQ211641.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccagcgcuacggaugacgcccaaaaggauuccauuuaugcgucugcucugguggaggccaccaaguucugugccccuaucuacgagugcgcuugggucagcuccacaggaauugugaaaagaggccuugaaugguuugagaagaaugccgggaccaucaaaucuugggacgaaagcuauacagagcugaagguugaugugccgaaaauugagcagcucgcuaacuaccagcaggccgcgcugaaguggcggaaggacaucggauuccgcgucaaugccaacaccgcugcccuuuccaauaaagugcuggcugaauauaagguucccggcgagaucgugaugagcgucaaagaaaugcucucugauaugauuagacggcgcaaccaaauccugaauagagggggagacgagaacccucggggccccgugucccgcgaacacguggauugguguagagaguuugucaagggcaaauacauuauggccuucaauccucccuggggagacaucaacaagagcgggcggucuggcauugcgcugguugccacagggcucgcuaaacuggccgagaccgaaggaaagggcguguuugaugaggcuaagaaaacgguggaagcccuuaacggguaucuggacaagcauaaagacgaggucgauaaggccuccgcugacagcaugaucaccaaucuccugaaacacauugcgaaggcccaggaacuuuacaagaacucuuccgcucugcgcgcccagggagcccagaucgauacagcuuucagcuccuacuauuggcucuacaaagccggcgugaccccugagacauuuccgaccguuucucaauuccuguucgagcugggcaagcagcccagagggacgaaaaagaugaaaaaggcgcuccugacaaccccuaugaaguggggaaagaaacuuuaugaacuguuugcugacgauagcuuccagcagaaucggaucuacaugcaucccgccgugcucacagccggccgcauuuccgagaugggggucugcuuuggaaccaucccuguggcuaaccccgacgaugccgcucaaggcagcgggcacaccaaaucuauucugaaucuuagaacaaacacggaaaccaauaacccgugugcccggacaaucguuaagcuguucgagauucagaaaaccggauuuaauauccaggacauggauaucguggcguccgaacaucuccugcaccaaagccuggucggcaagcagucuccuuuccagaacgccuauaaugugaagggcaacgcuacaagcgccaauauuaucuga

SEQ ID NO: 7397 - RNA, 1449 nt, Artificial Sequence
  derived and/or modified CDS sequence (opt5) from CCHFV(BT958)__EF123122.1__N
auggagaacaagaucgaagugaauaacaaagacgagaugaauagaugguucgaagaguuuaagaaagaaaacggccuggucgauaccuucacaaauagccacuccuuuugcgagucuguucccaaccucgacaaguucguguuucagauggccagcgcuacggaugacgcccaaaaagauuccauuuacgcggcugcccugguggaggccaccaaguucugugcuccuaucuaugaaugcgccugggucucuagcacagggauugugaagaaaggacuugagugguuugaaaagaaugcuggcaccaucaaauccugggacgagucuuacacagagcugaagguugaagugccgaaaauugagcagcucagcaacuaucagcaggccgcgcugaaguggcggaaggauaucggguuccgcgucaaugccaacaccgcuacacuuucccauaaagugcuggccgaauacaagguucccggagagaucgugaugagcgucaaagaaaugcucucugacaugauuagacggcgcaaucugauccugaacagaggcggggaugagaauccucggggacccgugucccgcgagcacguggaaugguguagagaguuugucaagggcaaauauauuauggcuuucaacccucccuggggcgacaucaauaagagcgggcggucuggaauugcccucguugcgaccggccuggccaaacuugcugaagccgaggggaagggaguguuugaugaagcuaagaaaacgguggaggcccugaacggcuaccucgacaagcauaaagaugaggucgacaaguccagcgccgacucuaugaucaccaaccugcuuaaacacauugcuaaggcgcaagaacuguaucgcaauuccagcgcccucagagcucagggggcccagaucgauacagccuucuccucuuacuacuggcuguauaaggcuggagugaccccugagacauuuccgaccguuagccaguuccuguucgaacucggcaaacaaccccggggcacgaagaaaaugaagaaagcccugcuuuccacaccuaugaagugggggaagaaacuguacgagcucuuugcggacgauagcuuccagcagaaccgcaucuauaugcaucccgcugugcugaccgccggaagaauuucugaaaugggcgucugcuuugggacaaucccuguggccaaucccgacgaugcugcccuuggauccggccacaccaagagcauucugaaccuccggaccucuacagaggcuaauaacccgugugccaaaacgaucguuaagcuguucgagauucagaaaaagggguuugugaucaaggacauggauaucgucgcgagcgaacaucugcuccaccaaucccuggugggaaaacagucuccuuuccagaaugccuacaacgucaagggcaaugcuaccagcgccaacauuaucuga

SEQ ID NO: 7398 - RNA, 1449 nt, Artificial Sequence
  derived and/or modified CDS sequence (opt5) from CCHFV(C-68031)__DQ211642.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgagagauucguguuucagauggccagcgcuacggacgaugcccaaaaagacuccauuuaugcgucugcucugguggaggccaccaaguucugugccccuaucuacgaaugcgcuugggucagcuccacaggaauugugaagaaaggccuugagugguuugaaaagaaugccgggaccaucaaaucuugggaugagagcuauauugagcugaagguugaagugccgaaaaucgagcagcucgcuaacuaccagcaggccgcgcugaaguggcggaaggacaucggauuccgcgucaaugccaacacagcugcccuuucccacaaagugcuggcugaauauaagguucccggcgagauugugaugagcgucaaagaaaugcucucugauaugaucagacggcgcaaucugauucugaacagagggggagacgagaauccucggggccccgugucccgcgagcacguggaaugguguagagaguuugucaagggcaaauacaucauggccuucaacccucccuggggagauauuaauaagagcggacggucuggcaucgcgcucguugccaccgggcuggcuaaacuugccgaaacagagggaaagggcguguuugacgaagcuaagaaaaccguggaggcccugaacggguaucucgauaagcacaaagacgaggucgauaaggccuccgcugacaacaugauuacgaaucugcuuaaacauaucgcgaaggcccaagaacuguacaagaacagcucugcucuccgcgcccagggagcccagaucgacaccgcuuucuccagcuacuauuggcuguacaaagccggcgugacaccugagaccuuuccgacaguuucccaguuccuguucgaacucggcaagcaacccagagggaccaaaaagaugaaaaaggcgcugcuuucuacgccuaugaagugggggaaaaagcuguaugagcucuuugcugaugacagcuuccagcagaaucggauuuacaugcaccccgccgugcugacagccggccgcaucuccgaaaugggggucugcuuuggaaccauuccuguggcuaaccccgaugacgccgcucagggcagcgggcauacaaaaucuauccuuaaucugagaaccaacaccgagacaaauaacccgugugccaagacgauuguuaaacucuucgagauccaaaagaccggauuuaauauccaggauauggacauuguggcguccgaacaucugcugcaccagagccucgucggcaagcaaucuccuuuccagaacgccuauaaugugaaaggcaacgcuacaagcgccaauaucauuuga

SEQ ID NO: 7399 - RNA, 1449 nt, Artificial Sequence
  derived and/or modified CDS sequence (opt5) from CCHFV(China)__AF354296.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgagagauucguguuucagauggccagcgcuacggacgaugcccaaaaagacuccauuuaugcgucugcucugguggaggccaccaaguucugugccccuaucuacgaaugcgcuugggucagcuccacaggaauugugaagaaaggccuugagugguuugaaaagaaugccgggaccaucaaaucuugggaugagagcuauacagagcugaagguugaagugccgaaaauugagcagcucgcuaacuaccagcaggccgcgcugaaguggcggaaggacaucggauuccgcgucaaugccaacaccgcugcccuuucccacaaagugcuggcugaauauaagguucccggcgagaucgugaugagcgucaaagaaaugcucucugauaugauuagacggcgcaaucugauccugaacuccgggggagacgagaauccuagaggccccgugagccgggagcacguggaauggugucgcgaguuugucaagggcaaauacauuauggccuucaacccucccuggggagauaucaauaagucugggagauccggcauugcgcucguugccacagggcuggcuaaacuugccgaaaccggaggcaaggggguguuugacgaggcuaagaaaacgguggaagcccugaacggauaucucgauaagcacaaagacgaggucgauaaggccagcgcugacaacaugaucaccaaucugcuuaaacauauugcgaaggcccaagagcuguacaagaacucuuccgcucuccgggcccagggcgcccagaucgacacagcuuucagcuccuacuauuggcuguacaaagccggcgcgaccccugaaacauuuccgaccgugucucaguuccuguucgagcucgggaagcaaccccgcggaacgaaaaagaugaaaaaggcucugcuuagcacaccuaugaaguggggcaaaaagcuguaugaacucuuugccgaugacuccuuccagcagaauagaaucuacaugcaccccgccguucugaccgcugggcggauuagcgagaugggagugugcuuuggcacaaucccugucgccaaccccgaugacgcugcccaggggucuggacauaccaaauccauucuuaaucugcgcaccaacacagaaacgaauaacccgugugcgaagaccaucgugagacucuucgagauucagaaaacaggcuuuaauauccaagauauggacaucguugccagcgagcaucugcugcaccagucucucgugggcaagcaaagcccuuuccagaacgcuuauaaugucaaggggaacgccaccuccgcuaauauuaucuga

SEQ ID NO: 7400 - RNA, 1449 nt, Artificial Sequence
  derived and/or modified CDS sequence (opt5) from CCHFV(China)__AF358784.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagcggggccuugaaugguuugagaaaaaugccgggaccaucaagucuugggacgaaagcuauacagagcugaaaguugaggugccgaagauugaacaguucgcugauuaccagcaggccgcgcucaaauggcgcaaggacaucggauuuagagucaacgccaauaccacagcucugucccacaaggugcuugccgaguauaaaguucccggcgaaaucgugaugagcgucaaggagaugcugucugauaugauucggcgcagaaaccucauccugaaucgcgggggagacgaauccccucggggccccgugagcagagagcacguggaguggugucgggaguucgucaaaggcaaguacauuauggcuuuuaacccucccuggggagauaucaauaaaucugggcgcuccggcauugcccugguugcgaccgggcucgccaagcuggcugaaacggaaggaaaaggcguguucgacgaggccaagaagaccguggaagcucuuaacggguaucugaauaaacacaaggaugaggucgacaaagccagcgccgacucuaugaucacaaaccuccugaagcauauugcuaaagcgcaagagcuuuacaagaacuccagcgcccugagagcucagggagcccagaucgauaccgccuuuuccucuuacuauuggcucuacaaggcuggcgugacaccugaaaccuucccgacgguuagccaguuccuguuugagcugggcaaacaaccccgggggacaaagaaaaugaagaaagcccuccuguccaccccucuuaaguggggaaagaaacuguaugaacucuucgcggacgauagcuuucagcagaaucgcaucuacaugcaccccgcugugcugacagccggcagaauuucugagaugggggucugcuucggaaccaucccuguggccaaccccgacgaugcugcccagggcuccgggcauaccaagagcauucuuaaucugcggacaaacacggaaaccaauaacccgugugcuaaaacaaucguuaagcucuuugagauucagaaaaccggauucaauauccaagacauggauaucguggccucugagcaucugcugcaccagagccucgucggcaagcaauccccuuuucagaacgcguauaaugugaagggcaacgccacaucugcuaauauuaucuga

SEQ ID NO: 7401 - RNA, 1449 nt, Artificial Sequence
  derived and/or modified CDS sequence (opt5) from CCHFV(China)__AF362080.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgagagauucguguuucagauggccagcgcuacggacgaugcccaaaaagacuccauuuaugcgucugcucugguggaggccaccaaguucugugccccuaucuacgaaugcgcuugggucagcuccacaggaauugugaagaaaggccuugagugguuugaaaagaaugccgggaccaucaaaucuugggaugagagcuauacagagcugaagguugaagugccgaaaauugagcagcucaccaacuaccagcaggcugcccugaaguggcggaaggacaucggauuccgcgucaaugcgaacacagccgcucuuucccacaaagugcuggccgaauauaagguucccggcgagaucgugaugagcgucaaagaaaugcucucugauaugauuagacggcgcaaucugauccugaacagagggggagacgagaauccucggggccccgugucccgcgagcauguggaaugguguagagaguuugucaagggcaccuacauuauggcuuucaacccucccuggggagauaucaauaaaagcgggcggucuggcauugcccucguugcgacggggcuggccaagcuggcugaaaccgagggaaaaggcguguuugacgaagccaagaagacaguggaggcucugaacggguaucucgauaaacacaaggacgaggucgauaaagccuccgccgacaacaugaucaccaaucugcuuaagcauauugcuaaagcgcaagaacuguacaagaacagcucugcccuccgcgcucagggagcccagaucgacacagccuucuccagcuacuauuggcuguacaaggcuggcgugaccccugagacguuuccgacaguuucccaguuccuguucgaacucggcaaacaacccagagggaccaagaaaaugaagaaagcccugcuuucuacaccuaugaaguggggaaagaaacuguaugagcucuuugcggaugacagcuuccagcagaaucggaucuacaugcaccccgcugugcugaccgccggccgcauuuccgaaaugggggucugcuuuggaaccaucccuguggccaaccccgaugacgcugcccagggcagcgggcauacaaagucuauucuuaaucugagaacgaacaccgagacaaauaacccgugugcuaaaaccaucguuaaacucuucgagauucaaaagacaggauuuaauauccaggauauggacaucguggccuccgaacaccuucugcaccagagccucgucggcaagcaaucuccuuuccagaacgcguauaaugugaagggcaacgccaccagcgcuaauauuaucuga

SEQ ID NO: 7402 - RNA, 1449 nt, Artificial Sequence
  derived and/or modified CDS sequence (opt5) from CCHFV(China)__AY029157.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgagagauucguguuucagauggccagcgcuacggacgaugcccaaaaagacuccauuuaugcgucugcucugguggaggccaccaaguucugugccccuaucuacgaaugcgcuugggucagcuccacaggaauugugaagaaaggccuugagugguuugaaaagaaugccgggaccaucaaaucuugggaugagagcuauacagagcugaagguugaagugccgaaaauugagcagcucgcuaacuaccagcaggccgcgcugaaguggcggaaggacaucggauuccgcgucaaugccaacaccgcugcccuuucccacaaagugcuggcugaauauaagguucccggcgagaucgugaugagcgucaaagaaaugcucucugauaugauuagacggcgcaaucugauccugaacagagggggagacgagaauccucggggccccgugucccgcgagcacguggaaugguguagagaguuugucaagggcaaauacauuauggccuucaacccucccuggggagauaucaauaagagcggacggucuggcauugcgcucguugccacagggcuggcuaaacuugccgaaaccgagggaaagggcguguuugacgaagcuaagaaaacgguggaggcccugaacggguaucucgauaagcacaaagacgaggucgauaaggccuccgcugacaacaugaucaccaaucugcuuaaacauauugcgaaggcccaagaacuguacaagaacagcucugcucuccgcgcccagggagcccagaucgacacagcuuucuccagcuacuauuggcuguacaaagccggcgugaccccugagacauuuccgaccguuucccaguuccuguucgaacucggcaagcaacccagagggacgaaaaagaugaaaaaggcgcugcuuucuacaccuaugaagugggggaaaaagcuguaugagcucuuugcugaugacagcuuccagcagaaucggaucuacaugcaccccgccgugcugaccgccggccgcauuuccgaaaugggggucugcuuuggaacaaucccuguggcuaaccccgaugacgccgcucagggcagcgggcauaccaaaucuauucuuaaucugagaaccaacacagagacgaauaacccgugugccaagaccaucguuaaacucuucgagauucaaaagacaggauuuaauauccaggauauggacaucguggcguccgaacaucugcugcaccagagccucgucggcaagcaaucuccuuuccagaacgccuauaaugugaaaggcaacgcuaccagcgccaauauuaucuga

SEQ ID NO: 7403 - RNA, 1449 nt, Artificial Sequence
  derived and/or modified CDS sequence (opt5) from CCHFV(DAK 8194)__U88411.1__N
auggagaacaagaucgaagugaauaacaaagacgagcugaauaagugguucgaagaguuuaaaaagggcaacgggcucgucgauaccuucacaaauagcuacuccuuuugcgaaaacaugcccaaucuggacagauucguuuuucagauggccggagcuacggaugacgcccaaaaagauucuauuuaugcgagcgcucuuguggaggccaccaaguacugugccccuaucuaugagugcgcuuggguguccucuacaggcauugucaagcgggggcuggaaugguucgagaaaaacaccggaacaaucaagagcugggacgaauccuacaccgagcucaaaguggauguuccgaagauugagcagcuggccaauuaucagcaggcugcccuuaaauggcgcaaggacaucggcuuuagagugaacgcgaauacagccgcucugucuaacaagguccucagcgaauacaaagugcccggggagaucguuauguccgugaaggaaaugcugagcgauaugauucggcgcagaaaucugauccucaaccggggaggcgacgagaauccucgcggccccgucucuaaagaacacauugagugguguagagaguucgugaaggggaaauauaucauggccuuuaacccucccuggggagaugugaacaaguccggccggagcgggauugcucuggucgccaccggacuugcgaaacuggccgaaacggagggcaaggggguuuucgaagaggcuaagaaaaccguggaagcccucaaggaguaccuggacaaacauaaggaugagguggacaaggcuucugccgacuccauggucacaaaucuucugaaacacaucaccaaggcccaagaacucuacaaaaacagcucugcucugcgcgcgcagggagcccagauugauacaccuuuuuccagcuucuauuggcuguacaaggcuggcgugaccccggagacguuucccacaguuucccaguuccucuucgaacugggcaaacaaccuagagggaccaagaaaaugaagaaggcccuucugucuacacccaugaaauggggaaagaaacucuaugagcuguuugccgacgauagcuuccagcagaaucggaucuacaugcauccugcugugcuuaccgccggccgcaucuccgaaaugggggucugcuuuggaaccauucccguggcggacccggaugacgcugcccagggcagcgggcacacaaagucuauccugaaccucagaacguccagcgagaccaauaacccuugugccaaaacaauuguuaagcuguucgaggugcaaaagaccggauuuaauauccaggauauggacauugucgcuucugaacaucugcuccaccagagccuggugggcaaacaaucccccuuccagaacgccuauaaugucaagggcaacgcuacaucugccaauaucaucuga

SEQ ID NO: 7404 - RNA, 1449 nt, Artificial Sequence
  derived and/or modified CDS sequence (opt5) from CCHFV(Drosdov)__U88412.1__N
auggagaacaagaucgaagugaauagcaaagacgagaugaacaagugguucgaagaguuuaaaaaggaaaauggccugauggauaccuucacaaacuccuacucuuuuugcgagaauguccccaaccucgacaaauucguuuuucagauggccagcgcuacggaugacgcccaaaaggauuccauuuaugcgucugcucugguggaggccaccaaguucugugccccuaucuacgaaugcgcuugggugagcuccacagggauugucaaaaagggacuugagugguuugagaaaaauucuggcaccaucaagagcugggacgaaaacuauacagagcugaaaguggauguuccgaagauugaacagcucgccaauuaccagcaggcugcccugaaguggagaaaagacaucggguuccgggugaacgcgaauaccgccgcucuuuccaacaagguccuggccgaguauaaagugcccggagaaaucguuaugagcgugaaggagaugcucucugauaugauucgcagacggaaucugauccugaaccgcggcggggacgaaaauccuagaggacccgucucccgggagcacguggaguggugucgcgaauuugugaaaggcaaguacauuauggcuuucaacccucccuggggcgauaucaacaaaagcgggagaucuggaauugcccucgucgcgacaggccuggccaaacuugcugagaccgaagggaagggaguuuuugacgaggccaagaagacgguggaagcucugaauggcuaucucgauaaacaucgggacgagguggacaaggccuccgccgauagcaugaucaccaaccugcuuaaacacauugcuaaggcgcaagagcuguacaaaaauucuuccgcccuccgcgcucagggggcccagaucgacacaccuuucagcuccuuuuacuggcuguauaaggccggagucaccccggaaacauuccccaccaucucucaguuccuguuugagcucggcaagcaaccuagaggcacgaaaaagaugaaaaaggcucugcuuagcacacccaugaagugggggaaaaagcuguacgaacucuucgccgaugacuccuuucagcagaaccggauuuauaugcauccugcggugcugaccgcuggacgcaucagcgagaugggcguuugcuucgggacaauucccguggccaauccggaugacgccgcucagggaucuggccacaccaaauccauccuuaaccugagaaccagcacagaaacgaauaacccuugugccaagaccauugucaaacucuuugagauccaaaagacaggguucaauauccaggauauggacauuguggcuucugagcaucugcugcaccagagccucguuggaaagcaaucccccuuucagaacgccuacaaugugaaaggcaacgcgaccucugccaauaucauuuga

SEQ ID NO: 7405 - RNA, 1449 nt, Artificial Sequence
  derived and/or modified CDS sequence (opt5) from CCHFV(Eskisehir23-2012)__KR092376.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaaaauaccgggacaaucaagucuugggacgaaaacuaugccgagcugaaaguggauguuccgaagauugagcagcucgcuaauuaccagcaggccgcgcugaaguggagaaaagacaucggauuccgggugaacgccaauaccgcugcccuuagcaacaagguccuggcugaauauaaagugcccggcgagaucguuauguccgugaaggaaaugcucagcgauaugauucgcagacggaaucugauccugaaccgcgggggaggcgagaauccuagaggccccgucucucgggaacacguggaguggugucgcgaguuugugaaagggaaguacauuauggccuucaacccucccuggggagacaucaacaaauccggcagaagcgggauugcgcucgucgccacaggacuggcuaaacuugccgaaaccgagggcaaggggguuuuugaugaagcuaaacggacgguggaggcccugaauggauaucucgacaagcaucgcgaugaaguggacaaagccucugcugacuccaugaucaccaaccugcuuaagcacauugcgaaagcccaagagcuguacaagaauagcucugcucucagagcccagggcgcccagaucgauacaccuuucuccagcuuuuacuggcuguauaaggcuggcgucaccccggagacauuccccaccaucucccaguuccuguuugaacucgggaaacaaccucggggaacgaagaaaaugaagaaagcccugcuuucuacacccaugaaguggggcaagaaacuguacgaacucuucgcggacgauagcuuucagcagaaccgcauuuauaugcauccugcugugcugaccgccgggagaaucuccgagaugggaguuugcuucggcacaauucccguggccaauccggacgaugcugcccaggggagcggacacaccaagucuauccuuaaccugcggaccuccacagagacgaauaacccuugugcuaaaaccauugucaagcucuuugaaauccaaaagacaggcuucaauauccaggacauggauauuguggccagcgagcaucugcugcaccagucucucguuggcaagcaaagccccuuucagaacgcguacaaugugaaggggaacgccaccuccgcuaauaucauuuga

SEQ ID NO: 7406 - RNA, 1449 nt, Artificial Sequence
  derived and/or modified CDS sequence (opt5) from CCHFV(Hodzha)__AY223475.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagaaaggccuugaaugguuugagaagaaugccgggaccaucaaaucuugggacgaaagcuauacagagcugaagguugaggugccgaaaauugaacagcucgcuaacuaccagcaggccgcgcugaaguggcggaaggauaucggauuccgcgucaaugccaacaccgcugcccuuucccacaaagugcugagcgaguauaagguucccggcgaaaucgugaugucugucaaagagaugcucuccgacaugauuagacggcgcaaucugauccugaacagagggggagaugaaaauccucggggccccgugagccgcgagcacguggagugguguagagaauuugucaagggcaaauacauuauggcuuucaacccucccuggggagacaucaauaagucuggacgguccggcauugcccucguugcgacagggcuggccaaacuugcugagaccgaaggaaagggcguguuugaugaggccaagaaaacgguggaagcucugaacggguaucucgacaagcacaaagaugaggucgacaaggccagcgccgacaacaugaccacaaaucugcuuaaacauaucgcuaaggcgcaagagcuguacaagaacucuuccgcccuccgcgcucagggagcccagauugauaccgccuucagcuccuacuauuggcuguacaaagcuggcgugacaccugaaaccuuuccgacgguuucucaguuccuguucgagcucggcaagcaacccagagggaccaaaaagaugaaaaaggcccugcuuagcacaccuaugaagugggggaaaaagcuguaugaacucuuugcggacgauuccuuccagcagaaucggaucuacaugcaccccgcugugcugacagccggccgcaucagcgagaugggggucugcuuuggaaccgugccuguugccgaccccgaugacgcugcccagggcucugggcauaccaaauccauucuuaaccugagaacaaauacggaaaccaacaauccgugugcuaagacaaucgugaaacucuucgagauucaaaagaccggauuuaacauccaggauauggacauugucgccagcgagcaucugcugcaccagucucucgugggcaagcaaagcccuuuccagaaugcguauaacgucaaaggcaaugccacauccgcuaacaucaucuga

SEQ ID NO: 7407 - RNA, 1449 nt, Artificial Sequence
  derived and/or modified CDS sequence (opt5) from CCHFV(Iran-52)__DQ446212.1__N
auggagaacaagaucgaagugaauagcaaagacgagaugaacaagugguucgaagaguuuaaaaagggcaaugggcuggucgauaccuucacaaacuccuacucuuuuugcgaaagcguucccaaucucgacagauucguguuucagauggccuccgcuacggaugacgcccaaaaagauucuauuuaugcgagcgcucugguggaggccaccaaguucugugccccuaucuacgagugcgcuugggccuccucuacaggaauugucaagaaaggccuugaaugguuugagaagaacgcugggaccaucaaaagcugggacgaauccuauacagagcugaagguggagguuccgaaaauugaacagcucagcaauuaccagcaggccgcgcugaaguggcggaaggauaucggauuccgcgugaacgccaauaccgcugcccuuucuaacaaaguccuggcugaguauaaggugcccggcgaaaucguuauguccgugaaagagaugcucagcgacaugauuagacggcgcaaucugauccugaacagagggggagaugaaaauccucggggccccgucucucgcgagcacguggagugguguagagaauuugugaagggcaaauacauuauggccuucaacccucccuggggagacaucaauaaguccggacggagcggcauugcgcucgucgccacagggcuggcuaaacuugccgagaccgaaggaaagggcguuuuugaugaggcuaagaaaacgguggaagcccugaacggguaucucgacaagcauaaagaugagguggacaaggccucugcugacuccaugaucaccaaccugcuuaaacacauugcgaaggcccaagagcuguacaagaauagcuccgcucuccgcgcccagggagcccagaucgauacagucuucucuagcuacuauuggcuguacaaagcuggcgugaccccugacacauuuccgaccguuucccaguuccuguucgaacucggcaagcaacccagagggacgaaaaagaugaaaaaggcccugcuuagcacaccuaugaagugggggaaaaagcuguaugagcucuuugcggaugacucuuuccagcagaaccggaucuacaugcaucccgcugugcugaccgccggccgcauuuccgaaaugggggucugcuuuggaacaaucccuguggccaaucccgaugacgcugcccuuggcagcgggcacaccaaaucuauucugaaccucagaaccaauacagagacgaacaauccgugugcucggaccaucguuaagcuguucgaaauucagaaaacaggauuuaacauccaagauauggacaucguggccagcgagcaucugcuccaccagucccuggucggcaagcagucuccuuuccaaaaugcguauaacgugaagggcaaugccaccagcgcuaacauuaucuga

SEQ ID NO: 7408 - RNA, 1449 nt, Artificial Sequence
  derived and/or modified CDS sequence (opt5) from CCHFV(Iran-53)__DQ446213.1__N
auggagaacaagaucgaagugaauagcaaagacgagaugaacaagugguucgaagaguuuaaaaagggcaaugggcuggucgauaccuucacaaacuccuacucuuuuugcgaaagcguucccaaucucgacagauucguguuucagauggccuccgcuacggaugacgcccaaaaagauucuauuuaugcgagcgcucugguggaggccaccaaguucugugccccuaucuacgagugcgcuugggccuccucuacaggaauugucaagaaaggccuugaaugguuugagaagaacgcugggaccaucaaaagcugggacgaauccuauacagagcugaagguggagguuccgaaaauugaacagcucagcaauuaccagcaggccgcgcugaaguggcggaaggauaucggauuccgcgugaacgccaauaccgcugcccuuucuaacaaaguccuggcugaguauaaggugcccggcgaaaucguuauguccgugaaagagaugcucagcgacaugauuagacggcgcaaucugauccugaacaaagggggagaugaaaauccuagaggccccgucucucgggagcacguggaguggugucgcgaauuugugaagggcaaguacauuauggccuucaacccucccuggggagacaucaauaaauccgggagaagcggcauugcgcucgucgccacagggcuggcuaaacuugccgagaccgaaggaaagggcguuuuugaugaggcuaagaagacgguggaagcccugaacggguaucucgacaaacauaaggaugagguggacaaagccucugcugacuccaugaucaccaaccugcuuaagcacauugcgaaggcccaagagcuguacaaaaauagcuccgcucuccgggcccagggagcccagaucgauacagucuucucuagcuacuauuggcuguacaaggcuggcgugaccccugacacauuuccgaccguuucccaguuccuguucgaacucggcaaacaaccccgcgggacgaagaaaaugaagaaggcccugcuuagcacaccuaugaaauggggaaagaaacuguaugagcucuuugcggaugacucuuuccagcagaacagaaucuacaugcaucccgcugugcugaccgccggccggauuuccgaaaugggggucugcuuuggaacaaucccuguggccaaucccgaugacgcugcccuuggcagcgggcacaccaagucuauucugaaccuccgcaccaauacagagacgaacaauccgugugcuagaaccaucguuaaacuguucgaaauucagaagacaggauuuaacauccaagauauggacaucguggccagcgagcaucugcuccaccagucccuggucggcaagcagucuccuuuccaaaaugcguauaacgugaaaggcaaugccaccagcgcuaacauuaucuga

SEQ ID NO: 7409 - RNA, 1449 nt, Artificial Sequence
  derived and/or modified CDS sequence (opt5) from CCHFV(JD 206)__U88414.1__N
auggagaacaagaucgaagugaauagcaaagacgagaugaacaagugguucgaagaguuuaaaaagggcaaugggcuggucgauaccuucacaaacuccuacucuuuuugcgaaaauguucccaaccucgacagauucguguuucagauggccagcgcuacggaugacgcccaaaaagauuccauuuaugcgucugcucugguggaggccaccaaguucugugccccuaucuacgagugcgcuugggccagcuccacaggaauugucaagaaaggccuugaaugguuugagaagaaugcugggaccaucaaaucuugggacgaaagcuauacagagcugaagguggagguuccgaaaauugaacagcucuccaacuaccagcaggccgcgcugaaguggcggaaggauaucggauuccgcgugaaugccaacaccgcugcccuuagcaauaaaguccuggcugaguauaaggugcccggcgaaaucguuaugucugugaaagagaugcucuccgacaugauuagacggcgcaaccugauccugaauagagggggagaugaaaacccucggggccccgucagccgcgagcacguggagugguguagagaauuugugaagggcauguacauuauggccuucaauccucccuggggagacaucaacaaaucugggcgguccggcauugcgcucgucgccacagggcuggcuaaacuugccgagaccgaaggaaagggcguuuuugaugaggcuaagaagacgguggaagcccugaacggguaucucgacaaacauaaggaugagguggacaaagccagcgcugacucuaugaucaccaaucugcuuaagcacauugcgaaagcccaagagcuguacaagaacuccagcgcucuccgcgcccagggagcccagaucgauacagucuucuccucuuacuauuggcuguacaaggcuggcgugaccccugacacauuuccgaccguuagccaguuccuguucgaacucggcaaacaacccagagggacgaagaaaaugaagaaagcccugcuuuccacaccuaugaaguggggaaagaaacuguaugagcucuuugcggaugacagcuuccagcagaaucggaucuacaugcaucccgcugugcugaccgccggccgcauuucugaaaugggggucugcuuuggaacaaucccuguggccaaccccgaugacgcugcccuuggcuccgggcacaccaagagcauucugaaucucagaaccaacacagagacgaauaacccgugugcuaaaaccaucguuaagcuguucgaaauucagaaaacaggauuuaauauccaagauauggacaucguggccucugagcaucugcuccaccagagccuggucggcaagcaguccccuuuccaaaacgcguauaaugugaagggcaacgccaccucugcuaauauuaucuga

SEQ ID NO: 7410 - RNA, 1449 nt, Artificial Sequence
  derived and/or modified CDS sequence (opt5) from CCHFV(Kashmanov)__DQ211644.1__N
auggagaacaagaucgaagugaauagcaaagacgagaugaacaagugguucgaagaguuuaaaaaggaaaauggccugauggauaccuucacaaacuccuacucuuuuugcgagaauguccccaaccucgacaaauucguuuuucagauggccagcgcuacggaugacgcccaaaaggauuccauuuaugcgucugcucugguggaggccaccaaguucugugccccuaucuacgaaugcgcuugggugagcuccacagggauugucaaaaagggacuugagugguuugagaaaaauucuggcaccaucaagagcugggacgaaaacuaugccgagcugaaaguggauguuccgaagauugaacagcucgcuaauuaccagcaggccgcgcugaaguggagaaaagacaucggguuccgggugaacgccaauacagcugcccuuuccaacaagguccuggcugaguauaaagugcccggagaaaucguuaugagcgugaaggagaugcucucugauaugauucgcagacggaaucugauccugaaccgcggcggggacgaaaauccuagaggacccgucucccgggagcacguggaguggugucgcgaauuugugaaaggcaaguacauuauggccuucaacccucccuggggcgauaucaacaaaagcgggagaucuggaauugcgcucgucgccaccggccuggcuaaacuugccgagacagaagggaagggaguuuuugacgaggcuaagaagaccguggaagcccugaauggcuaucucgauaaacaucgggacgagguggacaaggccuccgcugauagcaugaucacgaaccugcuuaaacacauugcgaaggcccaagagcuguacaaaaauucuuccgcucuccgcgcccagggggcccagaucgacaccccuuucagcuccuuuuacuggcuguauaaggcuggagucacaccggaaaccuuccccacaaucucucaguuccuguuugagcucggcaagcaaccuagaggcaccaaaaagaugaaaaaggcccugcuuagcacgcccaugaagugggggaaaaagcuguacgaacucuucgcggaugacuccuuucagcagaaccggauuuauaugcauccugcugugcugacagccggacgcaucagcgagaugggcguuugcuucgggaccauucccguggccaauccggaugacgcugcccagggaucuggccacacaaaauccauccuuaaccugagaaccagcaccgaaacaaauaacccuugugcuaagacgauugucaaacucuuugagauccaaaagaccggguucaauauccaggauauggacauuguggccucugagcaucugcugcaccagagccucguuggaaagcaaucccccuuucagaacgcguacaaugugaaaggcaacgccacaucugcuaauaucauuuga

SEQ ID NO: 7411 - RNA, 1449 nt, Artificial Sequence
  derived and/or modified CDS sequence (opt5) from CCHFV(NIV 10405051)__JF922681.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggucagcuccacaggaauugugaagaaaggccuugaaugguuugagaagaaugccgggaccaucaaaucuugggacgaaagcuauacagagcugaagguugaggugccgaaaauugaacagcucgcuaacuaccagcaggccgcgcugaaguggcggaaggauaucggauuccgcgucaaugccaacaccgcugcccuuucccacaaagugcuggcugaguauaagguucccggcgaaaucgugaugagcgucaaagagaugcucucugacaugauuagacggcgcaaucugauccugaacagagggggagaugaaaauccucggggccccgugucccgcgagcacguggagugguguagagaauuugucaagggcaaauacauuauggccuucaacccucccuggggagacaucaauaagagcgggcggucuggcauugcgcucguugccacagggcuggcuaaacuugccgagaccgaaggaaagggcguguuugaugaggcuaagaaaacgguggaagcccugaacggguaucucgacaagcacaaagaugaggucgacaaggccuccgcugacaacaugaucaccaaucugcuuaaacauauugcgaaggcccaagagcuguacaagaacagcucugcucuccgcgcccagggagcccagaucgauacagcuuucuccagcuacuauuggcuguacaaagccggcgugaccccugaaacauuuccgaccguuucccaguuccuguucgagcucggcaagcaacccagagggacgaaaaagaugaaaaaggcgcugcuuucuacaccuaugcgguggggaaagaaacuguaugaacucuuugcugacgauagcuuccagcagaaucgcaucuacaugcaccccgccgugcugaccgccggcagaauuuccgagaugggggucugcuuuggaacaaucccuguggcuaaccccgacgaugccgcucagggcagcgggcauaccaagucuauucuuaaucugcggaccaacacagaaacgaauaacccgugugccaaaaccaucguuaaacucuucgagauucaaaagacaggauuuaauauccaggacaucgauauuguggcguccgagcaucugcugcaccagagccucgucggcaagcaaucuccuuuccagaacgccuauaaugugaagggcaacgcuaccagcgccaauaucauuuga

SEQ ID NO: 7412 - RNA, 1449 nt, Artificial Sequence
  derived and/or modified CDS sequence (opt5) from CCHFV(Oman)__DQ211645.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggccagcuccacaggaauugucaagaaaggccuugaaugguuugagaagaaugcugggaccaucaaaucuugggacgaaagcuauacagagcugaagguggagguuccgaaaauugaacagcucuccaacuaccagcaggccgcgcugaaguggcggaaggauaucggauuccgcgugaaugccaacaccgcugcccuuagcaauaaaguccuggcugaguauaaggugcccggcgaaaucguuaugucugugaaagagaugcucuccgacaugauuagacggcgcaaccugauccugaauagagggggagaugaaaacccucggggccccgucagccgcgagcacguggagugguguagagaauuuauuaagggcaaauacaucauggccuucaauccucccuggggagacauuaacaagucuggacgguccggcaucgcgcucguggccacagggcuggcuaaacuugccgagaccgaaggaaagggcgucuuugaugaggcuaagaaaacgguugaagcccugaacggguaucucgacaagcauaaagaugagguggacaaggccagcgcugacucuaugauuaccaaucugcuuaaacacaucgcgaaggcccaagagcuguacaagaacuccagcgcucuccgcgcccagggagcccagaucgauacaguguucuccucuuacuauuggcuguacaaagcuggcgucaccccugacacauuuccgaccgugagccaguuccuguucgaacucggcaagcaacccagagggacgaaaaagaugaaaaaggcccugcuuuccacaccuaugaagugggggaaaaagcuguaugagcucuuugcggaugacagcuuccagcagaaucggauuuacaugcaucccgcuguucugaccgccggccgcaucucugaaaugggggugugcuuuggaacaauuccugucgccaaccccgaugacgcugcccuuggcuccgggcacaccaaaagcauccugaaucucagaaccaacacagagacgaauaacccgugugcuaagaccauugugaaacuguucgaaauccagaagacaggauuuaauauccaagauauggacauuguugccucugagcaucugcuccaccagagccuggugggcaagcaguccccuuuccaaaacgcguauaaugucaaaggcaacgccaccucugcuaauaucauuuga

SEQ ID NO: 7413 - RNA, 1449 nt, Artificial Sequence
  derived and/or modified CDS sequence (opt5) from CCHFV(SCT ex Afghanistan)__JX908640.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugacgcccaaaaagauuccauuuaugcgucugcucugguggaggccaccaaguucugugccccuaucuacgagugcgcuugggccagcuccacaggaauugucaagaaaggccuugaaugguuugagaagaaugcugggaccaucaaaucuugggacgaaagcuauacagagcugaagguggagguuccgaaaauugaacagcucuccaacuaccagcaggccgcgcugaaguggcggaaggauaucggauuccgcgugaaugccaacaccgcugcccuuagcaauaaaguccuggcugaguauaaggugcccggcgaaaucguuaugucugugaaagagaugcucuccgacaugauuagacggcgcaaccugauccugaauagagggggagaugaaaacccucggggccccgucagccgcgagcacguggagugguguagagaauuuauuaagggcaaauacaucauggccuucaauccucccuggggagacauuaacaagucuggacgguccggcaucgcgcucguggccacagggcuggcuaaacuugccgagaccgaaggaaagggcgucuuugaugaggcuaagaaaacgguugaagcccugaacggguaucucgacaagcauaaagaugagguggacaaggccagcgcugacucuaugauuaccaaucugcuuaaacacaucgcgaaggcccaagagcuguacaagaacuccagcgcucuccgcgcccagggagcccagaucgauacaguguucuccucuuacuauuggcuguacaaagcuggcgucaccccugaaacauuuccgaccgugagccaguuccuguucgagcucggcaagcaacccagagggacgaaaaagaugaaaaaggcccugcuuuccacaccuaugaagugggggaaaaagcuguaugaacucuuugcggacgauagcuuccagcagaaucggauuuacaugcaucccgcuguucugaccgccggccgcaucucugagaugggggugugcuuuggaacaauuccugucgccaaccccgacgaugcugcccuuggcuccgggcacaccaaaagcauccugaaucucagaaccaacacagaaacgaauaacccgugugcuaagaccauugugaaacuguucgagauccagaagacaggauuuaauauccaagacauggauauuguugccucugagcaucugcuccaccagagccuggugggcaagcaguccccuuuccaaaacgcguauaaugucaaaggcaacgccaccucugcuaauaucauuuga

SEQ ID NO: 7414 - RNA, 1449 nt, Artificial Sequence
  derived and/or modified CDS sequence (opt5) from CCHFV(Semunya)__DQ076413.1__N
auggagaacaagaucgaagugaccagcaaagacgagaugaauagaugguucgaagaguuuaagaaauccaacggccuggucgauacauucaccaauucuuacagcuuuugcgaauccguucccaaccucgaccgguucguguuucagauggccucugcuacggaugacgcccaaaaggauagcauuuaugcguccgcucugguggaggccacaaaauucugugccccuaucuacgagugcgcuugggucucuagcaccgggauugugaagaagggacuugaaugguuugagaaaaaugccggcacaaucaaguccugggacgaaagcuauaccgagcugaaaguuggggugccgaagauugagcagcucgcuaacuaccagcaggccgcgcugaaauggcgcaaggauaucggauucagagucaaugccaacacagcugcccuuucuaauaaggugcuggcugaauauaaaguucccggcgagaucgugauguccgucaaggaaaugcucagcgacaugauucggcgcagaaaccugauccugaaucgcgggggagaugagaacccucggggccccgugucuagagaacacguggaguggugucgggaguuugucaaaggcaaguacauuauggccuucaauccucccuggggagacaucaacaaauccgggcgcagcggcauugcgcucguugccaccgggcuggcuaagcucgccgaaacggagggaaaaggcguguuugaugaagcuaagaagaccguggaggcccugaauggguaucucgacaaacauaaggaugaagucgacaaagccucugcugacggaauggugacaaaccugcuuaagcacaucgcgaaagcccaagagcuguacaagaacuccagcgcucucagagcccagggcgcccagauugauaccccuuucuccucuuuuuacuggcuguauaaggcuggcguuagcccggagacauuccccaccgugucccaguuccuguuugaacucgggaaacaaccucggggaacgaagaaaaugaagaaagcccugcuuagcacacccaugaaguggggcaagaaacuguacgagcuuuucgcggacgauucuuuucaggaaaaucgcaucuauaugcauccugcuguccugaccgccgggagaaucuccgagaugggagugugcuucggcacaauucccguugccaacccggacgaugcugcccaggggagcggacacaccaagucuauccuuaaucugcggaccaacacagaaacgaauaacccuugugcuaaaaccauugugaagcucuuugagauccagaaaacaggcuucaauauucaagacauggauaucgucgccagcgagcaucugcugcaccagucccucgugggcaagcagucucccuuucaaaacgcguacaaugucaaggggaacgccaccagcgcuaauaucauuuga

SEQ ID NO: 7415 - RNA, 1449 nt, Artificial Sequence
  derived and/or modified CDS sequence (opt5) from CCHFV(SK 2015/human)__KX129738.1__N
auggagaacaagaucgaagugaauaacaaagacgagaugaauaagugguucgaagaguuuaaaaagggcaacgggcuggucgauaccuacacaaauagcuauuccuucugcgaaucuguucccaaccucgacagauuuguguuccagauggccagcgcuacggaugacgcccaaaaagauuccauuuacgcgucugcucugguggaggccaccaaguuuugugccccuaucuaugagugcgcuugggccagcuccacaggaauugucaagaaaggccuugaaugguucgagaagaaugcugggaccaucaaacugugggacgaaucuuacgccgagcucaagguggagguuccgaaaauugaacagcugagcaacuaucagcaggcggcccuuaaguggcggaaggauaucggauuucgcgugaaugcuaacacagccgcucuguccaauaaaguccucgccgaguacaaggugcccggcgaaaucguuaugagcgugaaagagaugcugucugacaugauuagacggcgcaaccugauccucaauagagggggagaugaaaacccucggggccccgucucccgcgagcacguggagugguguagagaguucgugaagggcaaauauauuauggcguuuaauccucccuggggagacaucaacaagagcggacggucuggcauugcccuggucgcuaccgggcuugccaaacuggcugaaacagaaggaaagggcguuuucgaugaggccaagaaaaccguggaagcccucaacggguaccuggacaagcauaaagaugagguggacaaggcuuccgcggacagcaugaucacgaaucuucugaaacacauugccaaggcucaagagcucuacaagaacucuuccgcccugcgcgcccagggagcucagaucgauaccgucuuuagcuccuauuacuggcuguauaaagccggcgugacaccugacaccuucccgacaguuucucaguuucucuucgaacugggcaagcaacccagagggaccaaaaagaugaaaaaggcgcuucugagcacgccuaugaagugggggaaaaagcucuacgagcuguucgcugaugacuccuuucagcagaaucggaucuauaugcaucccgccgugcuuacagccggccgcauuagcgaaaugggggucugcuucggaaccgugccuguugcuaaccccgaugacgccgcucugggcucugggcacacaaaauccauccucaaucugagaaccaacaccgagacaaauaacccgugugccaagacgauugugaaacuguuugaaauccagaagaccggauucaauauucaagauauggacaucgucgcgagcgagcaucuccugcaccagucucuugugggcaagcagagcccuuuucaaaacgccuacaaugucaaaggcaacgcuacauccgccaauaucauuuga

SEQ ID NO: 7416 - RNA, 1449 nt, Artificial Sequence
  derived and/or modified CDS sequence (opt5) from CCHFV(SPU128/81/7)__DQ076415.1__N
auggagaacaagaucgaagugaauaacaaacacgagaugaauaagugguucgaagaguuuaaaaagggcaacgggcuggucgacaccuucacaaauagcuacuccuuuugcgaaucuguucccaaccucgauaaauucguguuucagauggccagcgcuacggacgaugcccaaaaggacuccauuuaugcgucugcucugguggaggccaccaaguucugugccccuaucuacgagugcgcuugggucagcuccacaggaauugugaaaagaggccuugaaugguuugagaagaaugccgggaccaucaaaucuugggaugaaagcuauacagagcugaagguugacgugccgaaaauugagcagcucgcuaacuaccagcaggccgcgcugaaguggcggaaggauaucggauuccgcgucaaugccaacaccgcugcccuuuccaauaaagugcuggcugaauauaagguucccggcgagaucgugaugagcgucaaagaaaugcucucugacaugauuagacggcgcaaccaaauccugaauagagggggagaugagaacccucggggccccgugucccgcgaacauguggacugguguagagaguuugucaagggcaaauacauuauggccuucaauccucccuggggagauaucaacaagagcgggcggucuggcauugcgcugguugccacagggcucgcuaaacuggccgagaccgaaggaaagggcguguuugacgaggcuaagaaaacgguggaaguccuuaacggguaucuggauaagcacaaagacgagguggaccgcgccuccgccgauagcaugaucaccaaucuccugaagcauauugcuaaagcgcaggaacuuuacaagaacucuuccgcccugagagcucagggagcccagaucgacacagccuucagcuccuacuauuggcucuacaaggcuggcguuaccccugagacauuuccgaccgugucucaauuccuguucgagcugggcaaacagccccgggggacgaagaaaaugaagaaagcccuccugagcacaccuaugaaguggggaaagaaacuuuaugaacuguuugcggaugacuccuuccagcagaaucgcaucuacaugcaccccgcuguccucaccgccggcagaauuagcgagaugggggugugcuuuggaacaaucccuguugccaaccccgaugacgcugcccaaggcucugggcauaccaaguccauucugaaucuucggaccaacacagaaacgaauaacccgugugcucgcaccaucgugaaacuguucgagauucagaagacaggauuuaauauccaggauauggacaucgucgccagcgaacaccuccugcaccaaucucuggugggcaaacagagcccuuuccagaacgcguauaaugucaagggcaacgccaccuccgcuaauauuaucuga

SEQ ID NO: 7417 - RNA, 1449 nt, Artificial Sequence
  derived and/or modified CDS sequence (opt5) from CCHFV(Sudan Al-Fulah 4-2008)__GQ862372.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccagcgcuacggaugacgcccaaaaggauuccauuuaugcgucugcucugguggaggccaccaaguucugugccccuaucuacgagugcgcuugggucagcuccacaggaauugugaaaagaggccuugaaugguuugagaagaaugccgggaccaucaaaucuugggacgaaagcuauacagagcugaagguugaugugccgaaaauugagcagcucgcuaacuaccagcaggccgcgcugaaguggcggaaggacaucggauuccgcgucaaugccaacaccgcugcccuuuccaauaaagugcuggcugaauauaagguucccggcgagaucgugaugagcgucaaagaaaugcucucugauaugauuagacggcgcaaccaaauccugaauagagggggagacgagaacccucggggccccgugucccgcgaacacguggauugguguagagaguuugucaagggcaaauacauuauggccuucaauccucccuggggagacaucaacaagagcgggcggucuggcauugcgcugguugccacagggcucgcuaaacuggccgagaccgaaggaaagggcguguuugaugaggcuaagaaaacgguggaagcccuuaacggguaucuggacaagcauaaagacgaggucgaucgcgccuccgcugacagcaugaucaccaaucuccugaagcacauugcgaaagcccaggaacuuuacaagaacucuuccgcucugagagcccagggagcccagaucgauacagcuuucagcuccuacuauuggcucuacaaggccggcgugaccccugagacauuuccgaccguuucucaauuccuguucgagcugggcaaacagccccgggggacgaagaaaaugaagaaagcgcuccugagcacaccuaugaaguggggaaagaaacuuuaugaacuguuugcugacgauuccuuccagcagaaucgcaucuacaugcaucccgccgugcucaccgccggcagaauuagcgagaugggggucugcuuuggaacaaucccuguggcuaaccccgacgaugccgcucaaggcucugggcacaccaaguccauucugaaucuucggaccaacacagaaacgaauaacccgugugcccgcaccaucguuaaacuguucgagauucagaagacaggauuuagcauccaggacauggauaucguggcgucugaacaucuccugcaccaaagccuggucggcaaacaguccccuuuccagaaugccuauaacgugaagggcaaugcuaccucugccaacauuaucuga

SEQ ID NO: 7418 - RNA, 1449 nt, Artificial Sequence
  derived and/or modified CDS sequence (opt5) from CCHFV(TAJUK)__JN086996.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccagcgcuacggaugaggcccaaaaagacuccauuuaugcgucugcucugguggaggccaccaaguucugugccccuaucuacgaaugcgcuugggucagcuccacaggaauugugaagaaaggccuugagugguuugaaaagaaugccgggaccaucaaaucuugggaugagagcuauacagagcugaagguugaagugccgaaaauugagcagcucgcuaacuaccagcaggccgcgcugaaguggcggaaggacaucggauuccgcgucaaugccaacaccgcugcccuuucccacaaagugcuggcugaauauaagguucccggcgagaucgugaugagcgucaaagaaaugcucucugauaugauuagacggcgcaaucugauccugaacagagggggagacgagaauccucggggccccgugucccgcgagcacguggaaugguguagagaguuugucaagggcaaauacauuauggccuucaacccucccuggggagauaucaauaagagcggacggucuggcauugcgcucguugccacagggcuggcuaaacuugccgaaaccgagggaaagggcguguuugacgaagcuaagaaaacgguggaggcccugaacggguaucucgauaagcacaaagacgaggucgauaaggccuccgcugacaacaugaucaccaaucugcuuaaacauauugcgaaggcccaagaacuguacaagaacagcucugcucuccgcgcccagggagcccagaucgacacagcuuucuccagcuacuauuggcuguacaaagccggcgugaccccugagacauuuccgaccguuucccaguuccuguucgaacucggcaagcaacccagagggacgaaaaagaugaaaaaggcgcugcuuucuacaccuaugaagugggggaaaaagcuguaugagcucuuugcugaugacagcuuccagcagaaucggaucuacaugcaccccgccgugcugaccgccggccgcauuuccgaaaugggggucugcuuuggaacaaucccuguggcuaaccccgaugacgccgcucagggcagcgggcauaccaaaucuauucuuaaucugagaaccaacacagagacgaauaacccgugugccaagaccaucguuaaacucuucgagauucaaaagacaggauuuaauauccaggauauggacaucguggcguccgaacaucugcugcaccagagccucgucggcaagcaaucuccuuuccagaacgccuauaaugugaaaggcaacgcuaccagcgccaauauuaucuga

SEQ ID NO: 7419 - RNA, 1449 nt, Artificial Sequence
  derived and/or modified CDS sequence (opt5) from CCHFV(UG3010)__DQ211650.1__N
auggagaacaagaucgaagugaccagcaaagacgagaugaauagaugguucgaagaguuuaagaaauccaacggccuggucgauacauucaccaauucuuacagcuuuugcgaauccguucccaaccucgaccgguucguguuucagauggccucugcuacggaugacgcccaaaaggauagcauuuaugcguccgcucugguggaggccacaaaauucugugccccuaucuacgagugcgcuugggucucuagcaccgggauugugaagaagggacuugaaugguuugagaaaaaugccggcacaaucaaguccugggacgaaagcuauaccgagcugaaaguuggggugccgaagauugagcagcucgcuaacuaccagcaggccgcgcugaaauggcgcaaggauaucggauucagagucaaugccaacacagcugcccuuucuaauaaggugcuggcugaauauaaaguucccggcgagaucgugauguccgucaaggaaaugcucagcgacaugauucggcgcagaaaccugauccugaaucgcgggggagaugagaacccucggggccccgugucuagagaacacguggaguggugucgggaguuugucaaaggcaaguacauuauggccuucaauccucccuggggagacaucaacaaauccgggcgcagcggcauugcgcucguugccaccgggcuggcuaagcucgccgaaacggagggaaaaggcguguuugaugaagcuaagaagaccguggaggaccugaauggguaucucgauaaacauaaggacgaagucgacaaagccucugccgauggaauggugacaaaccugcuuaagcacaucgcuaaagcgcaagagcuguacaagaacuccagcgcccucagagcucagggcgcccagauugacaccccuuucuccucuuuuuacuggcuguauaaggccggcguuagcccggagacauuccccaccgugucccaguuccuguuugaacucgggaaacaaccucggggaacgaagaaaaugaagaaagcucugcuuagcacacccaugaaguggggcaagaaacuguacgagcuuuucgccgaugacucuuuucaggaaaaucgcaucuauaugcauccugcgguccugaccgcugggagaaucuccgagaugggagugugcuucggcacaauucccguugccaacccggaugacgccgcucaggggagcggacacaccaagucuauccuuaaucugcggaccaacacagaaacgaauaacccuugugccaaaaccauugugaagcucuuugagauccagaaaacaggcuucaauauucaagauauggacaucgucgcuagcgagcaucugcugcaccagucccucgugggcaagcagucucccuuucaaaacgccuacaaugucaaggggaacgcgaccagcgccaauaucauuuga

SEQ ID NO: 7420 - RNA, 1449 nt, Artificial Sequence
  derived and/or modified CDS sequence (opt5) from CCHFV(UGANDA 3010)__U88416.1__N
auggagaacaagaucgaagugaccagcaaagacgagaugaauagaugguucgaagaguuuaagaaauccaacggccuggucgauacauucaccaauucuuacagcuuuugcgaauccguucccaaccucgaccgguucguguuucagauggccucugcuacggaugacgcccaaaaggauagcauuuaugcguccgcucugguggaggccacaaaauucugugccccuaucuacgagugcgcuugggucucuagcaccgggauugugaagaagggacuugaaugguuugagaaaaaugccggcacaaucaaguccugggacgaaagcuauaccgagcugaaaguuggggugccgaagauugagcagcucgcuaacuaccagcaggccgcgcugaaauggcgcaaggauaucggauucagagucaaugccaacacagcugcccuuucuaauaaggugcuggcugaauauaaaguucccggcgagaucgugauguccgucaaggaaaugcucagcgacaugauucggcgcagaaaccugauccugaaucgcgggggagaugagaacccucggggccccgugucuagagaacacguggaguggugucgggaguuugucaaaggcaaguacauuauggccuucaauccucccuggggagacaucaacaaauccgggcgcagcggcauugcgcucguugccaccgggcuggcuaaacuugccgaaacggagggaaagggcguguuugaugaagcuaagaagaccguggaggaccugaauggguaucucgauaaacauaaggacgaagucgacaaagccucugccgauggaauggugacaaaccugcuuaagcacaucgcuaaagcgcaagagcuguacaagaacuccagcgcccuccugcugcagggcgcucagauugacaccccuuucuccucuuuuuacuggcucuauaaggccggcguuagcccggagacauuccccaccgugucccaguuccuguuugaacuugggaaacaaccuagaggaacgaagaaaaugaagaaagcccugcucagcacacccaugaaguggggcaagaaacuguacgagcuuuucgcugaugacucuuuucaggaaaaucggaucuauaugcauccugccguccugaccgcggggcgcaucuccgagaugggagugugcuucggcacaauucccguugcuaacccggaugacgccgcccaggggagcggacacaccaagucuauccucaaucugggcaccaacacagaaacgaauaacccuugugcuaaaaccauugugaagcuguuugagauccagaaaacaggcuucaauauucaagauauggacaucgucgccagcgagcaucuccugcaccagucccuuguggggaagcagucucccuuucaaaacgcuuacaaugucaagggaaacgccaccagcgcgaauaucauuuga

SEQ ID NO: 7421 - RNA, 1449 nt, Artificial Sequence
  derived and/or modified CDS sequence (opt5) from CCHFV(UK ex Bulgaria)__KM201260.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccagauucugugccccuaucuacgagugcgcuugggugagcuccacaggaauugucaagaaaggccuugaaugguuugagaaaaauucugggaccaucaaaagcugggacgaaaacuaugccgagcugaagguggauguuccgaaaauugagcagcucgcuaauuaccagcaggccgcgcugaaguggcggaaggacaucggauuccgcgugaacgccaauacagcugcccuuuccaacaaaguccuggcugaauauaaggugcccggcgagaucguuaugagcgugaaagaaaugcucucugauaugauuagacggcgcaaucugauccugaacagagggggagacgagaauccucggggccccgucucccgcgaacacguggagugguguagagaguuugugaagggcaaauacauuauggccuucaacccucccuggggagauaucaacaagagcgggcggucuggcauugcgcucgucgccaccgggcuggcuaaacuugccgaaacagagggaaagggcguuuuugacgaagcuaagaaaaccguggaggcccugaauggguaucucgauaagcaucgcgacgaaguggacaaagccuccgcugauagcaugaucacgaaccugcuuaagcacauugcgaaagcccaagagcuguacaaaaauucuuccgcucucagagcccagggagcccagaucgacaccccuuucagcuccuuuuacuggcuguauaaggcuggcgucacaccggagaccuuccccacaaucucucaguuccuguuugaacucggcaagcaaccucgggggaccaagaaaaugaagaaagcccugcuuagcacgcccaugaaguggggaaagaaacuguacgaacucuucgcggaugacuccuuucagcagaaccgcauuuauaugcauccugcugugcugacagccggcagaaucagcgagauggggguuugcuucggaaccauucccguggccaauccggaugacgcugcccagggcucugggcacacaaaguccauccuuaaccugcggaccagcaccgagacaaauaacccuugugcuaaaacgauugucaagcucuuugaaauccaaaagaccggauucaauauccaggauauggacauuguggccucugagcaucugcugcaccagagccucguuggcaagcaaucccccuuucagaacgcguacaaugugaagggcaacgccacaucugcuaauaucauuuga

SEQ ID NO: 7422 - RNA, 1449 nt, Artificial Sequence
  derived and/or modified CDS sequence (opt5) from CCHFV(Yozgat19-2012)__KR092375.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaaaauucugggaccaucaagagcugggacgaaaacuaugccgagcugaaaguggauguuccgaagauugagcagcucgcuaauuaccagcaggccgcgcugaaguggagaaaagacaucggauuccgggugaacgccaauacagcugcccuuuccaacaagguccuggcugaauauaaagugcccggcgagaucguuaugagcgugaaggaaaugcucucugauaugauucgcagacggaaucugauccugaaccgcuccggggacgagaauccuagaggacccgucagccgggaacacguggaguggugucgcgaguuugugaaaggcaaguacauuauggccuucaacccucccuggggcgauaucaacaaaucugggagauccggaauugcgcucgucgccaccggccuggcuaagcucgccgaaacagaggggaagggaguuuuugacgaagcuaaaaagaccguggaggcccugaauggcuaucucgauaaacaucgggacgaaguggacaaggccagcgcugauucuaugaucacgaaccugcuuaaacacauugcgaaggcccaagagcuguacaaaaauuccagcgcucuccgcgcccagggggcccagaucgacaccccuuucuccucuuuuuacuggcuguauaaggcuggagucacaccggagaccuuccccacaaucagccaguuccuguuugaacucggcaagcaaccuagaggcaccaaaaagaugaaaaaggcccugcuuuccacgcccaugaagugggggaaaaagcuguacgagcuuuucgcggaugacagcuuucagcagaaccggauuuauaugcauccugcugugcugacagccggacgcaucucugaaaugggcguuugcuucgggaccauucccguggccaauccggaugacgcugcccagggauccggccacacaaaaagcauccuuaaccugagaaccucuaccgagacaaauaacccuugugcuaagacgauugucaaacucuuugaaauccaaaagaccggguucaauauccaggauauggacauuguggccagcgagcaucugcugcaccagucccucguuggaaagcaaucucccuuucagaacgcguaccacgugaaaggcaaugccacaagcgcuaacaucauuuga

SEQ ID NO: 7423 - RNA, 1449 nt, Artificial Sequence
  derived and/or modified CDS sequence (opt5) from CCHFV(Yozgat207-2011)__KR092377.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaaaauucugggaccaucaagagcugggacgaaaacuaugccgagcugaaaguggauguuccgaagauugagcagcucgcuaauuaccagcaggccgcgcugaaguggagaaaagacaucggauuccgggugaacgccaauacagcugcccuuuccaacaagguccuggcugaauauaaagugcccggcgagaucguuaugagcgugaaggaaaugcucucugauaugauucgcagacggaaucugauccugaaccgcgggggagacgagaauccuagaggccccgucucccgggaacacguggaguggugucgcgaguuugugaaaggcaaguacauuauggccuucaacccucccuggggagauaucaacaaaagcggaagaucuggcauugcgcucgucgccaccgggcuggcuaagcucgccgaaacagagggaaagggcguuuuugacgaagcuaaaaagaccguggaggcccugaauggguaucucgauaaacaucgggacgaaguggacaaggccuccgcugauagcaugaucacgaaccugcuuaaacacauugcgaaggcccaagagcuguacaaaaauucuuccgcucuccgcgcccagggagcccagaucgacaccccuuucagcuccuuuuacuggcuguauaaggcuggcgucacaccggagaccuuccccacaaucucucaguuccuguuugaacucggcaagcaaccuagagggaccaaaaagaugaaaaaggcccugcuuagcacgcccaugaagugggggaaaaagcuguacgagcuuuucgcggaugacuccuuucagcagaaccggauuuauaugcauccugcugugcugacagccggccgcaucagcgaaauggggguuugcuucggaaccauucccguggccaauccggaugacgcugcccagggcucugggcacacaaaauccauccuuaaccugagaaccagcaccgagacaaauaacccuugugcuaagacgauugucaaacucuuugaaauccaagagaccggauucaauauccaggauauggacauuguggccucugagcaucugcugcaccagagccucguuggcaagcaaucccccuuucagaacgcguacaaugugaagggcaacgccacaucugcuaauaucauuuga

SEQ ID NO: 7424 - RNA, 1452 nt, Artificial Sequence
  derived and/or modified CDS sequence (opt5) from DUGV(ArD44313)__AF434161.1__N
auggagaaccagaucaaggccaauaacaaaaaggaguucgacgaaugguuuaaacccuucagcgaaaagcugcaacucagauccaaucugaccaacucugcuagccuuugcgaucgggugccugaccuggcccucgcggagaugaaaauggcucuggccacagaugacaaggaaaaggauuccaucuuuucuaaugcccuugucgaggcuacgcgcuucugugccccgauuuacgagugcgcuuggaccuguagcacaggcguugugcagaaaucccugucuugguuugacaagaacaaagauuucauuaagcucugggacgccaaauauauggaucugaagaaggggauccccgaaccugagcagcuggugagcuaccagcaagcggcccagaaauggagaaaggacgucggauaugaaauuaaucaguuuacccggucccucacacaccccgugguugcugaguacaaagugccuggcgagaucgccgucgaugugaaggaaaugcugagcgacaugauccgcagacggaacguucuucugaauggggauggagagaacgcuggcaaaaaggggcccauuucucgcgaacauguguccuggggaagagagcucgccggcggcaaauuccaggucguguuuaauccuccguggggagacaucaacaagugcggcaagagcgggauuccccuggcggccaccgcuauggugaaagucgccgaacuugacgggucuaagaaacuggaggauauccggcaagcucuccuggaccugaagaaauggguugaggauaauaaggacgcccucgaagauggaaagggcaacgagcuggugcagacaaugaccaaacaccuugcccaggcuguggaacuguccaagaaaagcaaugcgcuccgcgcccagggggcucaaauugacacgccuuucucugccuauuacugggccugguccgcuggagucaagcccgagaccuuuuucacacugagccaguuucuuuucgaaaugggccaguccgccagaggcgggaaaaagaugaucaaggcgcugaccucuacaccucuccgguggggaaaaggccugauuaaccuguucgcugaugacgauuuucucgggaaccgccuguauaugcaucccgccgugcuuaccccgggaagaaugagcgagaugggcgccuguuucgggguuaucccuguggcuucccccgaggacgccauccugggaagcggccacucuaagaauauucucaacuuuaaaaucgauacguccguccaaaauccuugcgcuagcacaauugugcagcuguaccggauccagaagucuggcuucgaccuugaaagccuggagguuguguccaccgaacaucuccugcaccagucuuuugucgggaaacgcugucccacacaaaacgccuacaaggugagaggaaaugcgaccaacgucaauauuaucuga

SEQ ID NO: 7425 - RNA, 1452 nt, Artificial Sequence
  derived and/or modified CDS sequence (opt5) from DUGV(ArD16095)__AF434162.1__N
auggagaaccagaucaaggccaauaacaaaaaggaauuugacgagugguuuaaacccuucagcgaaaagcugcaacucagauccaaucugaccaacucugcuagccuuugcgaucgggugccugaccuggcccucgcggagaugaaaauggcucuggccacagaugacaaggaaaaggauuccauuuucucuaaugcccuugucgaggcuacgcgcuucugugccccgaucuacgagugcgcuuggaccuguagcacaggcguugugcagaaaucccugucuugguuugacaagaacaaagauuucauuaagcucugggacagcaaauauauggaucugagaaaggggauccccgaaccugagcagcugguguccuaccagcaagccgcgcagaaguggcggaaagacgucggauaugaaauuaaucaguuuacccgcagccucacacaccccgugguugccgaguacaaggugccuggcgagaucgcugucgaugugaaagaaaugcugucugacaugaucagacggcgcaacguucuucugaauggggauggagagaacgccggcaagaaagggcccauuuccagagaacaugugagcuggggacgggagcucgcuggcggcaaguuccaggucguguuuaauccuccguggggagacaucaacaaaugcgggaagucuggcauuccccuggccgcgaccgccauggugaaggucgcugaacuugacggguccaaaaagcuggaggauauccgccaagcccuccuggaccugaaaaaguggguugaggauaauaaagacgcucucgaagauggaaagggcaacgagcuggugcagacaaugaccaagcaccuugcccaggccguggaacugagcaaaaagucuaaugcucucagagcgcagggggcccaaauugacacgccuuucuccgcuuauuacugggccuggagcgccggagucaaacccgagaccuuuuucacacugucccaguuucuuuucgaaaugggccagucugcucggggcgggaagaaaaugaucaaggcccugaccagcacaccucuccgcuggggaaagggccugauuaaccuguucgcggaugacgauuuuuccgggaacagacucuauaugcaucccgcugugcugaccccgggacggaugagcgagaugggcgccuguuucgggguuaucccuguggccucucccgaggacgcuauccuuggauccggccacagcaaaaauauucugaacuuuaagaucgauacgucuguccaaaauccuugcgccagcacaauugugcagcucuaccgcauccagaaauccggcuucgaccuggaaucucuugagguugugagcaccgaacaucugcuccaccaguccuuugucgggaagagaugucccacacaaaacgcuuacaaagugcggggaaaugccaccaacgucaauauuaucuga

SEQ ID NO: 7426 - RNA, 1452 nt, Artificial Sequence
  derived and/or modified CDS sequence (opt5) from DUGV(IbH11480)__AF434163.1__N
auggagaaccagaucaaggccaauaacaaaaaggaguucgacgaaugguuuaaacccuucagcgaaaagcugcaacucagauccaaucugaccaacucugcuagccuuugcgaucgggugccugaccuggcccucgcggagaugaaaauggcucuggccacagaugacaaggaaaaggauuccaucuuuucuaaugcccuugucgaggcuacgcgcuucugugccccgauuuacgagugcgcuuggaccuguagcacaggcguugugcagaaaucccugucuugguuugacaagaacaaagauuucauuaagcucugggacgccaaauauauggaucugagaaaggggauccccgaaccugagcagcuggugagcuaccagcaagcggcccagaaguggcggaaagacgucggauaugaaauuaaucaguuuacccgcucccucacacaccccgugguugcugaguacaaggugccuggcgagaucgccgucgaugugaaagaaaugcugagcgacaugaucagacggcgcaacguucuucugaauggggauggagagaacgcuggcaagaaagggcccauuucuagagaacauguguccuggggacgggagcucgccggcggcaaguuccaggucguguuuaauccuccguggggagacaucaacaaaugcggcaagagcgggauuccccuggcggccaccgcuauggugaaggucgccgaacuugacgggucuaaaaagcuggaggauauccgccaagcucuccuggaccugaaaaaguggguugaggauaauaaagacgcccucgaagauggaaagggcaacgagcuggugcagacaaugaccaagcaccuugcccaggcuguggaacuguccaaaaagagcaaugcgcucagagcccagggggcucaaauugacacgccuuucucugccuuuuauugggccugguccgcuggagucaaacccgagaccuucuuuacacugagccaguuccuuuucgaaaugggccaguccgcccggggcgggaagaaaaugaucaaggcgcugaccucuacaccucuccgcuggggaaagggccugauuaaccuguuugcugaugacgauuuccucgggaacagacuguacaugcaucccgccgugcuuaccccgggacggaugagcgagaugggcgccuguuuugggguuaucccuguggcuucccccgaggacgccauccugggaagcggccacucuaaaaauauucucaacuucaagaucgauacguccguccaaaauccuugcgcuagcacaauugugcagcuguaucgcauccagaaaucuggcuuugaccuugaaagccuggagguuguguccaccgaacaucuccugcaccagucuuucgucgggaagagaugucccacacaaaacgccuacaaagugcggggaaaugcgaccaacgucaauauuaucuga

SEQ ID NO: 7427 - RNA, 1452 nt, Artificial Sequence
  derived and/or modified CDS sequence (opt5) from DUGV(IbAr1792)__AF434164.1__N
auggagaaccagaucaaggccaauaacaaaaaggaguucgacgaaugguuuaaacccuucagcgaaaagcugcaacucagauccaaucugaccaacucugcuagccuuugcgaucgggugccugaccuggcccucgcggagaugaaaauggcucuggccacagaugacaaggaaaaggauuccaucuuuucuaaugcccuugucgaggcuacgcgcuucugugccccgauuuacgagugcgcuuggaccuguagcacaggcguugugcagaaaucccugucuugguuugacaagaacaaagauuucauuaagcucugggacgccaaauauauggaucugagaaaggggauccccgaaccugagcagcuggugagcuaccagcaagcggcccagaaguggcggaaagacgucggauaugaaauuaaucaguuuacccgcucccucacacaccccgugguugcugaguacaaggugccuggcgagaucgccgucgaugugaaagaaaugcugagcgacaugaucagacggcgcaacguucuucugaauggggauggagagaacgcuggcaagaaagggcccauuucuagagaacauguguccuggggacgggagcucgccggcggcaaguuccaggucguguuuaauccuccguggggagacaucaacaaaugcggcaagagcgggauuccccuggcggccaccgcuauggugaaggucgccgaacuugacgggucuaaaaagcuggaggauauccgccaagcucuccuggaccugaaaaaguggguugaggauaauaaagacgcccucgaagauggaaagggcaacgagcuggugcagacaaugaccaagcaccuugcccaggcuguggaacuguccaaaaagagcaaugcgcucagagcccagggggcucaaauugacacgccuuucucugccuauuacugggccugguccgcuggagucaaacccgagaccuuuuucacacugagccaguuucuuuucgaaaugggccaguccgcccggggcgggaagaaaaugaucaaggcgcugaccucuacaccucuccgcuggggaaagggccugauuaaccuguucgcugaugacgauuuucucgggaacagacuguauaugcaucccgccgugcuuaccccgggacggaugagcgagaugggcgccuguuucgggguuaucccuguggcuucccccgaggacgccauccugggaagcggccacucuaaaaauauucucaacuuuaagaucgauacguccguccaaaauccuugcgcuagcacaauugugcagcuguaccgcauccagaaaucuggcuucgaccuugaaagccuggagguuguguccaccgaacaucuccugcaccagucuuuugucgggaagagaugucccacacaaaacgccuacaaagugcggggaaaugcgaccaacgucaauauuaucuga

SEQ ID NO: 7428 - RNA, 1452 nt, Artificial Sequence
  derived and/or modified CDS sequence (opt5) from DUGV(KT281/75)__AF434165.1__N
auggagaaccagaucaaggccaauaccaaaaaggaguucgacgaaugguuuaaacccuucagcgauaagcugcaacucagauccacacugacgaacucugcuagccuuugcgaccgggugccugaucuggcccucgcggaaaugaaaauggcucuggccaccgacgauaaggagaaggacuccaucuuuucuaaugcccuugucgaagcuacacgcuucugugccccgauuuacgagugcgcuuggaccuguagcacaggcguugugcagaaaucccugucuugguuugauaagaacaaagacuucauuaagcucugggaugccaaauauauggaccugagaaaggggauccccgagccugaacagcuggugagcuaccagcaagcggcccagaaguggcggaaagauauuggauaugagaucaaucaguuuacccgcucccucacacaccccgucguggcugaauacaagguuccuggcgagaucgccguggacgucaaagagaugcugagcgauaugauuagacggcgcaacgugcuucugaauggggacggagaaaacgcuggcaagaaagggcccaucucuagagagcauguuuccuggggacgggaacucgccggcggcaaguuccagguggucuuuaauccuccguggggagacauuaacaaaugcggcaagagcgggaucccccuggcggccaccgcuauggugaagguggccgagcuugaugggucuaaaaagcuggaagacauucgccaagcucuccuggaucugaaaaaguggaucgaggacaauaaagaugcccucgaggacggaaagggcaacgaacugauucagacgaugaccaagcaccuugcccaggcugucgagcuguccaaaaagagcaaugcgcucagagcccagggggcucaaaucgauacaccuuucucugccuuuuauugggccugguccgcuggaguuaaacccgaaaccuucuuuacacugagccaguuccuuuucgagaugggccaguccgcccggggcgggaagaaaaugaucaaggcgcugaccucuacgccucuccgcuggggaaagggccugauuaaccuguuugcugacgaugacuucagcgggaauagacucuacaugcaucccgccgugcugacaccgggacggauguccgaaaugggcgccuguuuuggggugaucccugucgcuagccccgaggaugccauucuuggaucuggccacuccaaaaacauccugaacuucaagauugacaccagcgugcaaaauccuugcgcuucuacaaucguucagcucuaucgcauccagaaaagcggcuuugaccuggagucccuugaaguggucucuaccgagcaucugcuccaccagagcuucguggggaagagaugucccacccaaaacgccuacaaaguucggggaaaugcgacaaacgugaauauuaucuga

SEQ ID NO: 7429 - RNA, 1452 nt, Artificial Sequence
  derived and/or modified CDS sequence (opt5) from DUGV(NJT130)__FJ422213.2__N
auggagaaccagaucaaggccaauaacaaaaaggaauuugacgagugguuuaaacccuucagcgauaagcugcaacucagauccacccugacaaauucugcuagccuuugcgacaaagugccugaucuggcccucgcggaaaugaagauggcucuggccacggacgauaaggagaaagacuccauuuucucuaacgcccuugucgaagcuacccgguucugugccccgaucuacgagugcgcuuggacauguagcaccggcguugugcagaagucccugucuugguuugauaaaaauaaggacuucauuaaacucugggaugccaaguauauggaccugcgcaaggggauccccgagccugaacagcuggugagcuaccagcaagcggcccagaaauggagaaaggauauuggauaugagaucaaccaguuuacacggucccucacccaccccgucguggcugaauacaaaguuccuggcgagaucgccguggacgucaaggagaugcugagcgauaugauucgcagacggaaugugcuucugaacggggacggagaaaaugcuggcaaaaaggggcccaucucucgcgagcauguuuccuggggaagagaacucgccgagggcaaauuccagguggucuuuaacccuccguggggcgacauuaauaagugcggaaagagcgggaucccccuggcggccacagcuauggugaaaguggccgaacuugauggcucuaagaaacuggaggacauucggcaagcucuccuggaucugaagaaaugggucgaggacaacaaggaugcccucgaagacgggaagggaaaugagcugauccagaccaugacgaaacaccuugcccaggcuguugaacuguccaagaaaagcaacgcgcuccgcgcccagggcgcucaaauugauaccccuuucucugccuuuuauugggccugguccgcuggggugaagcccgagacauucuuuacccugagccaguuccuuuucgaaaugggacaguccgccagaggcggcaaaaagaugaucaaggcgcugacaucuaccccucuccggugggggaaaggacugaucaaucuguuugcugacgaugacuucagcggcaaccgccucuacaugcaucccgccgugcugacgccggggagaauguccgagaugggagccuguuuuggcgucauuccuguggcuagccccgaggaugccauccuugggucuggacacuccaagaacauucugaauuucaaaaucgacacaagcguucaaaacccuugcgcuucuaccauugugcagcucuaucggauccaaaagagcggcuuugaccuggaaucccuugaggucgugucuacagaacaucugcuccaccagagcuucguuggcaaacgcugucccacccagaaugccuacaaggugagagggaacgcgaccaaugucaacaucauuuga

SEQ ID NO: 7430 - RNA, 1452 nt, Artificial Sequence
  derived and/or modified CDS sequence (opt5) from DUGV(IbAr1792)__KU925457.1__N
auggagaaccagaucaaggccaauaacaaaaaggaguucgacgaaugguuuaaacccuucagcgaaaagcugcaacucagauccaaucugaccaacucugcuagccuuugcgaucgggugccugaccuggcccucgcggagaugaaaauggcucuggccacagaugacaaggaaaaggauuccaucuuuucuaaugcccuugucgaggcuacgcgcuucugugccccgauuuacgagugcgcuuggaccuguagcacaggcguugugcagaaaucccugucuugguuugacaagaacaaagauuucauuaagcucugggacgccaaauauauggaucugagaaaggggauccccgaaccugagcagcuggugagcuaccagcaagcggcccagaaguggcggaaagacgucggauaugaaauuaaucaguuuacccgcucccucacacaccccgugguugcugaguacaaggugccuggcgagaucgccgucgaugugaaagaaaugcugagcgacaugaucagacggcgcaacguucuucugaauggggauggagagaacgcuggcaagaaagggcccauuucuagagaacauguguccuggggacgggagcucgccggcggcaaguuccaggucguguuuaauccuccguggggagacaucaacaaaugcggcaagagcgggauuccccuggcggccaccgcuauggugaaggucgccgaacuugacgggucuaaaaagcuggaggauauccgccaagcucuccuggaccugaaaaaguggguugaggauaauaaagacgcccucgaagauggaaagggcaacgagcuggugcagacaaugaccaagcaccuugcccaggcuguggaacuguccaaaaagagcaaugcgcucagagcccagggggcucaaauugacacgccuuucucugccuuuuauugggccugguccgcuggagucaaacccgagaccuucuuuacacugagccaguuccuuuucgaaaugggccagaacgcccggggcgggaagaaaaugaucaaggcgcugaccuccacaccucuccgcuggggaaagggccugauuaaccuguuugcugaugacgauuuccucgggaauagacuguacaugcaucccgccgugcuuaccccgggacggaugucugagaugggcgccuguuuugggguuaucccuguggcuagccccgaggacgccauccugggauccggccacagcaaaaacauucucaauuucaagaucgauacgucuguccaaaacccuugcgcuuccacaauugugcagcuguaucgcauccagaaaagcggcuuugaccuugaaucucuggagguugugagcaccgaacaucuccugcaccaguccuucgucgggaagagaugucccacacaaaaugccuacaaagugcggggaaacgcgaccaaugucaacauuaucuga

SEQ ID NO: 7431 - RNA, 1449 nt, Artificial Sequence
  derived and/or modified CDS sequence (opt5) from NSDV(Jilin)__NC_034386.1__N
augcagaaccaaaucguggccgacaauaaggaugcuauucuggccuggcacaaaaccuacagcgagaagcauagacucaaauccguccugacaaacucugcgagcuucugcgaaacgauccccgaccuuuccggcuaugagguuucuaugcggcuggugagcuccgaaucugagaaggauagcguguacgcuuccgcccucgucgccgcuaccaaauuuugugccccuauucuggaaugcgcuuggacaagcuguaccgggaugguggagcgcggacuugacugguucgagaauaacaaggaaacaguuaagaucugggaugccgaguauggcaaacugagaaccgaagcgccgucucccgagcagcuccugggguaccagcgggccgcucugaaguggcgcaaagacacaaaguauggaauuaauagaaacaccgccgcucucgccgcggccaucgcuacggaguaccgggugccuggcuccaucgucgugaauguuaaagauaugcugagcgacaugauucgcagacggaacaagauccuuaaucgcgaugggucugaagacgugcccaagagaggaccugucuccaaagagcacauugauugggcccgggaccuggcucagggcaaguuucucgugguguucaaucccccuuggggcgauaucaacaaagccggaaagagcgggauugcccuggcugcgaccggcauggccaaacuuaucgaacuggacgggccgaagauugcugaggaccuccgcgaaucucugaaaggacuggucgccuggaucaacgcccauaaggaugagguugagaauggcaaggaagugguggacgggcucacaaaacaucugcaaaaggcucuugagcuggccaaacaguccagcgcgaugagagcucagggagcccagaucgauaccgucuuuuccucuuauuacuggcucuggaaggccggcgugacagcugaaauguuccccaccguuagccaauuucuguucgagcuuggcaaagugccucgggggaacaagaagaugaaaaaggcccuguccagcaugccccucaaauggggaaagaaacugcuggcucucuuugccgacgauucuuucacggcgaaucgcauuuacaugcacccuggcguccugacagccgggagaauguccgaacuuggagugugcuuuggcgcuauccccguugccaacccggacgaugcugccgaggggagcggacacauuaagaacauccuggcgcagaccacagacacccaggccggcaauccuugugcucagaacauuguggcccucuucaauauccaaaaggcuggcuuugauaucgagucuauggacauugucgcccuggaacaccuucugcaucagagccucguggggaaacggucccccuuccagaacgccuauaauaucagaggaaacgcuaccucuauucaaaucauuuga

SEQ ID NO: 7432 - RNA, 1449 nt, Artificial Sequence
  derived and/or modified CDS sequence (opt5) from NSDV(62873)__HQ286609.1__N
augcagaaccaaaucguggccgacaauaaggaugcuauucuggccuggcacaaaaccuacagcgagaagcauaaacucaaguccguccugacaaacucugcgagcuucugcgaaacgauccccgaccuuuccggcuaugagguuucuaugagacuggugagcuccgaaucugagaaagauagcguguacgcuuccgcccucgucgccgcuaccaaguuuugugccccuauucuggaaugcgcuuggacaagcuguaccgggaugauccagcggggacuugacugguucgagaauaacggcgagauggugaagauuugggaugccgacuaugggaaacugcgcacagaaaucccgucucccgagcagcuccugggauaccagagagcggcccugaaguggcggaaagauaccaaguauggcaucaauaaaaacacagcugcccucgcugccgcgauugccaccgaauaccgcguuccuggguccaucguggucaaugugaaggacaugcugagcgauaugauuagacggcgcaacaagauccuuaauagagacggaucugaggauguucccaaacggggcccuguguccaaggagcacauugacugggcucgcgaucuggcccaaggcaaauuucucgucguguucaaucccccuuggggagacaucaacaaggcugggaaaagcggcauugcccuggccgcuacggggauggcgaagcugaucgaacuggacggaccgaaaguggccgaggaucucaaggaaucucugaagucccuggucgcuuggaucaacgcccauaaagacgagguugaaaauggcaaggaggugguggaugggcucaccaaacaccuucagaaggcccuugagcuggcuaaacagagcuccgccaugagagcgcagggagcucaaauugacacagucuuuucuagcuauuacuggcucuggaaggccggcgugaccgccgaaauguuccccacaguuucccaguuucuguucgagcuuggcaaggugccucgggggaacaaaaagaugaaaaaggcucugagcucuaugccccucaaauggggaaagaagcugcuggcccucuuugcugaugacuccuucaccgccaaucgcaucuacaugcauccuggcguccugacggcggggagaaugagcgaacuuggagugugcuuuggcgccauucccguugcuaacccggaugacgccgcugaggggucuggacacaucaaaaacauucugaauuauaagacagauacccaggccggcaacccuugugcgcagaauaucguggcccucuucaacauccaaaaagcuggcuuugacauugaaagcauggauaucgucgccuccgagcaucugcuucaccagucucugguggggaagcggagccccuuccagaaugcuuacaacauucgcggaaaugccacauccauccaaauuaucuga

SEQ ID NO: 7433 - RNA, 1449 nt, Artificial Sequence
  derived and/or modified CDS sequence (opt5) from NSDV(779)__HQ286602.1__N
augcagaaccaaaucguggccgacaauaaggaugcuauucuggccuggcacaaaaccuacagcgagaagcauaaacucaaguccguccugacaaacucugcgagcuucugcgaaacgauccccgaccuuuccggcuaugagguuucuaugagacuggugagcuccgaaucugagaaagauagcguguacgcuuccgcccucgucgccgcuaccaaguuuugugccccuauucuggaaugcgcuuggacaagcuguaccgggaugauccagcggggacuugacugguucgauaauaacggcgagauggugaagauuugggacgccgauuaugggaaacugcgcacagagguuccgucucccgaacagcuccugggauaccagagagcggcccugaaguggcggaaagacaccaaguauggcaucaauaaaaacacagcugcccucgcugccgcgaucgccaccgaguaccgcgugccuggguccauugucgugaauguuaaggauaugcugagcgacaugaucagacggcgcaacaagauucuuaauagagauggaucugaagacgugcccaaacggggcccugucuccaaggagcacaucgauugggcucgcgaccuggcccaaggcaaauuucucgugguguucaaucccccuuggggagacauuaacaaggcugggaaaagcggcaucgcccuggccgcuacggggauggcgaagcugauugagcuggauggaccgaaagucgccgaagaccucaaggagucucugaagucccugguugcuuggaucaacgcccauaaagaugaaguggagaauggcaaggaaguggucgacgggcucaccaaacaccuucagaaggcccuugagcuggcuaaacagagcuccgccaugagagcgcagggagcucaaaucgauacaguguuuucuagcuauuacuggcucuggaaggccggcguuaccgccgagauguuccccacagugucccaguuucuguucgaacuuggcaaggucccucgggggaacaaaaagaugaaaaaggcucugagcucuaugccccucaaauggggaaagaagcugcuggcccucuuugcugacgauuccuucaccgccaaucgcauuuacaugcauccuggcgugcugacggcggggagaaugagcgagcuuggaguuugcuuuggcgccauccccguggcuaacccggacgaugccgcugaagggucuggacacauuaaaaacauccugaauuauaagacagacacccaggccggcaacccuugugcgcagaauauugucgcccucuucaacauccaaaaagcuggcuuugauaucgagagcauggacauuguggccuccgaacaucugcuucaccagucucuggucgggaagcggagccccuuccagaaugcuuacaacauccgcggaaaugccacauccauucaaaucauuuga

SEQ ID NO: 7434 - RNA, 1449 nt, Artificial Sequence
  derived and/or modified CDS sequence (opt5) from NSDV(6233)__HQ286603.1__N
augcagaaccaaaucguggccgacaauaaggaugcuauucuggccuggcacaaaaccuacagcgagaagcauaaacucaaguccguccugacaaacucugcgagcuucugcgaaacgauccccgaccuuuccggcuaugagguuucuaugagacuggugagcuccgaaucugagaaagauagcguguacgcuuccgcccucgucgccgcuaccaaguuuugugccccuauucuggaaugcgcuuggacaagcuguaccgggaugauccagcggggacuugacugguucgauaauaacggcgagauggugaagauuugggacgccgauuaugggaaacugcgcacagagguuccgucucccgaacagcuccugggauaccagagagcggcccugaaguggcggaaagacaccaaguauggcaucaauaaaaacacagcugcccucgcugccgcgaucgccaccgaguaccgcgugccuggguccauugucgugaauguuaaggauaugcugagcgacaugaucagacggcgcaacaagauucuuaauagagauggaucugaagacgugcccaaacggggcccugucuccaaggagcacaucgauugggcucgcgaccuggcccaaggcaaauuucucgugguguucaaucccccuuggggagacauuaacaaggcugggaaaagcggcaucgcccuggccgcuacggggauggcgaagcugauugagcuggauggaccgaaagucgccgaagaccucaaggagucucugaagucccugguugcuuggaucaacgcccauaaagaugaaguggagaauggcaaggacguggucgaugggcucaccaaacaccuucagaaggcccuugaacuggcuaaacagagcuccgccaugagagcgcagggagcucaaaucgacacaguguuuucuagcuauuacuggcucuggaaggccggcguuaccgccgagauguuccccacagugucccaguuucuguucgagcuuggcaaggucccucgggggaacaaaaagaugaaaaaggcucugagcucuaugccccucaaauggggaaagaagcugcuggcccucuuugcugaugacuccuucaccgccaaucgcauuuacaugcauccuggcgugcugacggcggggagaaugagcgaacuuggaguuugcuuuggcgccauccccguggcuaacccggaugacgccgcugaggggucuggacacauuaaaaacauccugaauuauaagacagauacccaggccggcaacccuugugcgcagaauauugucgcccucuucaacauccaaaaagcuggcuuugacaucgaaagcauggacauuguggccuccgagcaucugcuucaccagucucuggucgggaagcggagccccuuccagaaugcuuacaacauccgcggaaaugccacauccauucaaaucauuuga

SEQ ID NO: 7435 - RNA, 1449 nt, Artificial Sequence
  derived and/or modified CDS sequence (opt5) from NSDV(40350)__HQ286608.1__N
augcagaaccaaaucguggccgacagcaaggaugcuauucuggccuggcacaaaaccuacuccgagaagcauaaacucaagucuguccugacaaauagcgcguccuucugcgaaacgauccccgaccuuucuggcuaugagguuagcaugagacugguguccucugauagcgaaaaagacuccguguacgcuagcgcccucgucgccgcuaccaaguuuugugccccuauucuggagugcgcuuggacaucuuguaccgggaugauccagcggggacuugauugguucgaaaacaauggcgagauggugaagauuugggacgccgauuaugggaaacugcgcacagagguuccgucccccgaacagcuccugggauaccagagagcggcccugaaguggcggaaagacaccaaguauggcaucaacaaaaauacagcugcccucgcugccgcgaucgccaccgaguaccgcgugccugggagcauugucgugaacguuaaggauaugcugucugacaugaucagacggcgcaauaagauucuuaacagagauggauccgaagacgugcccaaacggggcccugucagcaaggagcacaucgauugggcucgcgaccuggcccaaggcaaauuucucgugguguucaaucccccuuggggagacauuaacaaggcugggaaaucuggcaucgcccuggccgcuacggggauggcgaagcugauugagcuggauggaccgaaaaucgccgaagaccucaaggagucccuuaagagccuggucgcuuggaucaaugcccauaaagaugaaguugagaacggcaaggaagugguggacgggcucaccaaacaucugcagaaggcccuugagcuggcuaaacaguccucugccaugagagcgcagggagcucaaauugauacagucuuuagcuccuauuacuggcucuggaaggccggcgugaccgccgagauguuccccacaguuagccaguuucuguucgaacuuggcaaggugccucgggggaauaaaaagaugaaaaaggcucugucuuccaugccccucaaauggggaaagaagcugcuggcccucuuugcugacgauagcuucaccgccaaccgcaucuacaugcacccuggcguccugacggcggggagaaugucugagcuuggagugugcuuuggcgccauucccguugcuaauccggacgaugccgcugaagggagcggacacaucaaaaacauucugaacuauaagacagacacccaggccggcaauccuugugcgcagaacaucguggcccucuucaauauccaaaaagcuggcuuugauauugaguccauggacaucgucgccucugaacaucugcuucaccagagccugguggggaagcggucccccuuccagaacgcuuacaauauucgcggaaacgccacaagcauccaaauuaucuga

SEQ ID NO: 7436 - RNA, 1449 nt, Artificial Sequence
  derived and/or modified CDS sequence (opt5) from NSDV(616287)__HQ286605.1__N
augcagaaccaaaucguggccgacaauaaggaugcuauucuggccuggcacaaaaccuacagcgagaagcauaaacucaaguccguccugacaaacucugcgagcuucugcgaaacgauccccgaccuuuccggcuaugagguuucuaugagacuggugagcuccgaaucugagaaagauagcguguacgcuuccgcccucgucgccgcuaccaaguuuugugccccuauucuggaaugcgcuuggacaagcuguaccgggaugauccagcggggacuugacugguucgauaauaacggcgagauggugaagauuugggacgccgauuaugggaaacugcgcacagagguuccgucucccgaacagcuccugggauaccagagagcggcccugaaguggcggaaagacaccaaguauggcaucaauaaaaacacagcugcccucgcugccgcgaucgccaccgaguaccgcgugccuggguccauugucgugaauguuaaggauaugcugagcgacaugaucagacggcgcaacaagauucuuaauagagauggaucugaagacgugcccaaaaagggcccugucuccaaagagcacguggauugggcucgggaccuggcccaaggcaaguuucucguggucuucaaucccccuuggggagacaucaacaaagcuggcaagagcgggauugcccuggccgcuacggggauggcgaaacuuaucgagcuggauggaccgaagguugccgaagaccucaaggagucucugaaaucccugguggcuuggauuaacgcccauaaggaugaaguggagaauggcaaagaagucguggacgggcucaccaagcaucugcagaaagcccuugagcuggcuaagcagagcuccgccaugcgcgcgcagggagcucaaaucgauacaguguuuucuagcuauuacuggcucuggaaggccggcguuaccgccgagauguuccccacagucucccaguuucuguucgaacuuggcaaagugccuagagggaacaagaaaaugaagaaagcucugagcucuaugccccucaaguggggaaagaaacugcuggcccucuuugcugacgauuccuucaccgccaaucggaucuacaugcacccuggcguucugacggcggggcgcaugagcgagcuuggagugugcuuuggcgccauucccgucgcuaacccggacgaugccgcugaagggucuggacacaucaagaacauucugaauuauaaaacagacacccaggccggcaacccuugugcgcagaauaucguggcccucuucaacauucaaaaggcuggcuuugauaucgagagcauggacaucgucgccuccgaacaucugcuucaccagucucugguggggaaaagaagccccuuccagaaugcuuacaacauucggggaaaugccacauccauccaaauuaucuga

SEQ ID NO: 7437 - RNA, 1449 nt, Artificial Sequence
  derived and/or modified CDS sequence (opt5) from NSDV(615526)__HQ286606.1__N
augcagaaccaaaucguggccgacaauaaggaugcuauucuggccuggcacaaagcguacagcgagaagcauaaacucaaguccguccugaccaacucugcuagcuucugcgaaacaauccccgaccuuuccggcuaugagguuucuaugagacuggugagcuccgaaucugagaaagauagcguguacgccuccgcccucgucgcugccacgaaguuuugugcuccuauucuggaaugcgccuggaccagcuguacagggaugauccagcggggacuugacugguucgauucuaauggcgagauggugaagauuugggacgcggauuaugggaaacugcgcaccgagguuccgucccccgaacagcuccugggauaccagagagccgcucugaaguggcggaaagacacaaaguauggcaucaacaaaaauaccgccgcucucgccgcggccaucgcuacagaguaccgcgugccugggagcauugucgugaacguuaaggauaugcugucugacaugaucagacggcgcaauaagauucuuaacagagauggauccgaagacgugcccaaaggcggcccugucagcaaggagcacaucgauugggcccgggaccuggcucaagggaaauuucucgugguguucaaucccccuuggggagacauuaacaaggccggcaaaucugggaucgcccuggcugcgaccggaauggccaagcugauugagcuggauggcccgaaaaucgcugaagaccucaaggagucccuuaagagccuggucgccuggaucaaugcccauaaagaugaaguugagaacgggaaggaagugguggacggacucacgaaacaucugcagaaggcucuugagcuggccaaacaguccucugcgaugcgcgcucagggcgcccaaauugauaccgucuuuagcuccuauuacuggcucuggaaggccggcgugacagcugagauguuccccaccguuagccaguuucuguucgaacuugggaaggugccuagaggaaauaaaaagaugaaaaaggcccugucuuccaugccccucaaauggggcaagaagcugcuggcucucuuugccgacgauagcuucacagcgaaccggaucuacaugcacccugggguccugaccgccggacgcaugucugagcuuggcgugugcuuuggggcuauucccguugccaauccggacgaugcugccgaaggaagcggccacaucaaaaacauucugaacuauaagacggacacacaggcgggcaauccuugugcccagaacaucguggcucucuucaauauccaaaaagccggguuugauauugaguccauggacaucgucgcuucugaacaucugcuucaccagagccuggugggaaagagaucccccuuccagaacgccuacaauauucggggcaacgccaccagcauccaaauuaucuga

SEQ ID NO: 7438 - RNA, 1449 nt, Artificial Sequence
  derived and/or modified CDS sequence (opt5) from NSDV(708)__AF504293.1__N
augcagaaccaaaucguggccgacaauaaggaugcuauucuggccuggcacaaagcguacagcgagaagcauaaacucaaguccguccugaccaacucugcuagcuucugcgaagccauccccgaccuuuccggcuaugagguuucuaugagacuggugagcuccgauucugaaaaagacagcguguacgccuccgcucucgucgccgcuacaaaguuuugugccccuauucuggagugcgcguggacgagcuguaccgggaugguggaacggggacuugauugguucgagaauaaccgcgagaugguuaagaucugggacacagaauauggcaaacugagaaccgaggugccgucucccgaacagcuccugggguaccagcgggccgcucugaaguggcgcaaagauacaaaguauggaauuaauaaaaacaccgccgcucucgccgcggccaucgcuacagaguacaaggucccuggcucccuggugguuaaugugaaggacaugcuuagcgauaugaucagacggcgcaacaaaauucugaauagagacgggucugaggauguccccaagcggggaccuguguccaaagaacacaucgacugggcccgcgaucucgcucagggcaaguuucugguggucuucaaucccccuuggggcgacauuaacaaagccggaaagagcgggaucgcccuugcugcgaccggcauggccaaacugauugagcucgacgggccgaagaucgcugaagaucugaaggagucucugaaaucccucguugccuggauuaacgcccauaaggacgaaguggagaauggaaaagagguggucgauagccugacgaaguaucuucaaaaagcucuggaacucgccaagcaguccucugcgaugagagcucagggcgcccagaucgacaccguguuuagcuccuacuacuggcuguggaaggccgggguuacagcugagauguuccccaccgugagccaauuucuuuucgaacugggaaaagucccucggggcaacaagaaaaugaagaaagcccucucuuccaugccccugaaguggggcaagaaacugcucgcucuguuugccgaugacagcuucacagcgaaucgcaucuauaugcacccuggggugcuuaccgccggaagaaugucugagcugggcguuugcuuuggggcuauucccguggccaacccggaugacgcugccgauggaagcggccauaucaaguccauucucaacuacaaaacggacacacaggcggggaauccuugugcccagaacaucgucgcucuguucaauauucagaaggccggauuugauaucgaaucuauggacaucguggcuagcgagcaccuucugcaccaaucccucgucggcaaacggagccccuuccagaacgccuauaauauucgcggcaacgccaccucuauccagauuaucuga

SEQ ID NO: 7439 - RNA, 702 nt, Artificial Sequence
  derived and/or modified CDS sequence (opt5) from BUNV__NC_001927.1__N
augaucgagcuggaguuccacgacguggccgcuaacaccagcuccacauuugaucccgaagucgccuacgcgaauuucaagagaguucauacgaccggccucucuuaugaccacauucggaucuuuuacauuaaagggcgcgaaaucaagacaagccuggcuaaaagauccgagugggaagugacccuuaaccugggaggcuggaagauuacaguguauaauaccaacuucccugggaaucggaacaauccgguccccgaugacggacucacacugcaucgccuuucuggcuuucuggccagauaccuccuggagaaaaugcugaaggugagcgagccugaaaagcucaucaucaaauccaagauuaucaacccccuggccgagaaaaaugggauuaccuggaacgauggagaagagguuuaucuuucuuucuuuccuggcagcgagauguuccugggcacguuucgguucuacccccucgcuaucgggauuuauaaggugcagcgcaaagaaauggagccuaaguaccuggaaaagaccaugagacaacgguacaugggacuugaggccgcuacauggaccgucuccaaacugacagaagugcagagcgcccucaccguugugucuucccugggcuggaagaaaacgaaugucagcgcggccgcucgcgacuuucuggccaaguucgggaucaacauguga

SEQ ID NO: 7440 - RNA, 702 nt, Artificial Sequence
  derived and/or modified CDS sequence (opt5) from BUNV(SFCrEq231)__KP063894.1__N
augaucgagcuggaguucaacgacguggccgcuaauaccagcuccacauuugaucccgaagucgccuacauuaacuucaagagaaucuauacgaccggccucucuuacgaccacauucggaucuuuuauauuaaagggcgcgaaaucaagacaagccugaccaaaagauccgagugggaaguuacacuuaaucugggaggcuggaaggugaccguguucaacacaaauuuuccugggaaccgcaauucuccgguccccgaugacggacucacccugcaucggcuuagcggcuuccuggcgagauaccuccuggagaaaauccugaagguguccgagccugaaaagcucauuaucaaaucuaagauuaucaacccccuggcugagaaaaaugggauuacguggagcgauggagaagagguuuaucuuuccuuuuucccuggcagcgagauguuucugggcaccuucaaguuuuacccccucgccaucgggauuuauaaagugcagcggaaggaaauggagccuaaguaccuggagaaaacaaugcgccaaagauacaugggacuugaagccucuaccuggacagucuccaaggugaacgaaguucagagcgcucugaccguggucucuggccucggguggaaaaagacgaauguguccgccgcugcccgggaguuccuggcgaaauuuggaaucaacauguga

SEQ ID NO: 7441 - RNA, 702 nt, Artificial Sequence
  derived and/or modified CDS sequence (opt5) from BUNV(AMH001130)__JF961342.1__N
augaucgagcuggaguuccacgacguggccgcuaacaccagcuccacauuugaucccgaagucgccuacgcgaauuucaagagaguucauacgaccggccucucuuaugaccacauucggaucuuuuacauuaaagggcgcgaagugaagacaagccuggcuaaaagauccgagugggaagugacccuuaaccugggaggcuggaagaucacagucuauaauaccaacuucccugggaaucggaacaauccggugcccgaugacggacucacacugcaucgccuuucuggcuuucuggccagauaccuccuggagaaaaugcugaagguuagcgagccugaaaagcucauuaucaaauccaagaucauuaacccccuggccgagaaaaaugggaucaccuggaacgauggagaagagguguaucuuucuuucuuuccuggcagcgagauguuccugggcacguuucgguucuacccccucgcuauugggaucuauaagguccagcgcaaagaaauggagccuaaguaccuggaaaagaccaugagacaacgguacaugggacuugaggccgcuacauggaccguguccaaacugacagaaguucagagcgcccucaccguggucucuucccugggcuggaagaaaacgaaugugagcgcggccgcucgcgacuuucuggccaaguucgggauuaacauguga

SEQ ID NO: 7442 - RNA, 702 nt, Artificial Sequence
  derived and/or modified CDS sequence (opt5) from BUNV(ArB29051)__AM709778.1__N
augaucgagcuggaguuccacgacguggccgcuaacaccagcuccacauuugaucccgaagucgccuacgcgaauuucaagagaguucauacgaccggccucucuuaugaccacauucggaucuuuuacauuaaagggcgcgaaaucaagacaagccuggcuaaaagauccgagugggaagugacccuuaaccugggaggcuggaagauuacaguguauaauaccaacuucccugggaaucggaacaauccgguccccgaugacggacucacacugcaucgccuuucuggcuuucuggccagauaccuccuggagaaaaugcugaagcucagcgagccugaaaagcugaucaucaaauccaagauuaucaacccccuugccgagaaaaaugggauuaccuggaacgauggagaagagguguaucugucuuucuuuccuggcagcgagauguuccucggcacguuucgguucuacccccuggcuaucgggauuuauaagguucagcgcaaagaaauggagccuaaguaccuugaaaagaccaugagacaacgguacaugggacuggaggccgcuacauggaccguguccaaacucacagaaguccagagcgcccugaccgugguuucuucccugggcuggaagaaaacgaaugugagcgcggccgcucgcgacuuucucgccaaguucgggaucaacauguga

SEQ ID NO: 7443 - RNA, 702 nt, Artificial Sequence
  derived and/or modified CDS sequence (opt5) from BUNV(ArB28215)__AM711130.1__N
augaucgagcuggaguucaacgacguggccgucaauaccagcuccucuuuugaucccgaagcugccuacgcgaacuucaagagaguucacacaacgggccucagcuaugaccauauucggaucuuuuacauuaaagggcgcgaaaucaaggugucccugucuaaaagaagcgagugggaagugaccauuaaucuuggaggcuggaagaucgcugucuauaacacaaauuucccugggaaccgcaauuccccggugcccgaugacggacugacccuccaccggcugucuggcuuucuugccagauuccugcucgagaaaaugcugaagaugagcgagccugaaaagcugaucauuaaagccaagaucauuaacccccucgcugagaaaaaucggaucacauggaacgauggggaagagguuuaccuguccuuuuucccuggaagcgagauguuucuuggcaccuucaaguuuuauccccuggccauuggcaucuacaaagugcagcgcaaggaaauggagccuaaguauuucgaaaagacaaugagacaacgguacauggggcucgaggcuucuuccuggaccgucagcaaacugacggacgugcagucugcccuuaccguuguguccggacugggcuggaaaaagacaaaugucagcgcggccgcucgcgauuuucucgccaaauucgggauuaacauguga

SEQ ID NO: 7444 - RNA, 702 nt, Artificial Sequence
  derived and/or modified CDS sequence (opt5) from BUNV(Peurto Almendras)__AJ697960.1__N
augagcgagaucgccuucgacgauauuggccagaucgcugccuccaccuuuaaccccgacaaucaauacauuggguucaagaaaguguuuacaaucggacugacguaugaucagauuagaaucuucuuucucaacggcaagaaagcgaaggaaacccugucuaaacggagcgaggaaacagucacccuuaauuucgggggauggcgcaucccuauuguuaacacacacuuuccgggcaauagaaacaucgaccuggcugaugacgcccucacccugcaucggguguccggguaccuugcccgcuaucugcucgagaaggugcugucugcucaggaacccgagaaggucauuaucaaaacaagaauuaucaauccuauugccgcuagcaacggaaucaccugggaugacggcuacgagguguaucuguccuucuuucccggcucugaaugcuuccucgaggccuuuaaguucuacccucuggcgaucgggauuuauaaaguucagaagggaaugauggaugugaaauuucuugaaaagacgaugcggcaaaaguacgccggccuggacgcuaccgucuggacacagcagaaauacaccgaugugaucaaugcccuccugguugugaacgggcuuggauggaagaaaagcaaugucuccgcugccgcgaaggacuuccugagcaaauucggcauucagaucuga

SEQ ID NO: 7445 - RNA, 702 nt, Artificial Sequence
  derived and/or modified CDS sequence (opt5) from BUNV__AF325122.1__N
augaucgagcuggaauuuaacgacguggccgcuaauaccagcuccacauuugaucccgaggucgccuacauuaacuucaagagacucuauacgaccggccugucuuacgaccacauccggauuuucuauaucaaagggcgcgaaauuaagacaagccuugcgaaaagauccgagugggaaguuacccugaaucucggaggcuggaaggugacaguguucaacaccaauuuuccugggaaccgcaauucuccgguccccgaugacggacugacacuucaucggcugagcggcuaccucgcuagauaucugcuggagaaaauccucaagguguccgauccugagaagcugaucauuaaaucuaagaucauuaacccccuugccgagaaaaaugggaucaccuggagcgacggagaagaaguuuaccuguccuucuuuccuggcagcgagauguuccucggcacguuucgguucuauccccuggccauugggaucuacaaggugcagcgcaaagagauggaaccuaaguaccuugagaagaccaugagacaacgguauaugggacuggaggcuucuacauggaccgucuccaaacucaacgaagugcagagcgcccugacaguugugucuggccugggguggaagaaaaccaaugucuccagcgcugcccgcgaauuucucgcgaaguucggaauuucuauguga

SEQ ID NO: 7446 - RNA, 702 nt, Artificial Sequence
  derived and/or modified CDS sequence (opt5) from Ab-BUNV(Cu20-XJ)__KJ710424.1__N
augcuggagcucgaauuugaggacgugcccaccaacaucggcagcacauuugauccugaauccggguacauuaauuuccagagaaacuaucugccgggagucacgcuugaccaaauccggauuuucuacaucaagggccgcgagauuaaaaauucucuggccaagagaagcgaaugggagguuacccucaaccuugggggauggaaagugcccgugcugaauacaaacuucccuggcaaucgguccaacgcuguccccgauuaugggcugaccuuucaccgcaucucuggauaccucgccagauaucugcugggcaaguaccucgcggagacagaaccugagaaacugaucaugcggaccaagauuaucaauccccuugcugaaaagaacggcauuacaugggagagcgggccugagguguaucuguccuucuuuccgggagccgaaauguuccucggcaccuuuaaauucuacccccuggccaucgggauuuacaagguucagcgcaaagagauggacccuaaguuucuugagaaaacgaugagacagcgguaucugggacucgaugcucagaccuggacaaccacaaagcuggacgaaguggaacgcgcccugaaggucgugucuggccucggguggaaaaagaccaauguuagcaacgcugccagagaguuccuguccaaauuuggaauccggauguga

SEQ ID NO: 7447 - RNA, 702 nt, Artificial Sequence
  derived and/or modified CDS sequence (opt5) from ANADV(2513 Irkutsk)__KT313716.1__N
augaucgaacuggaguucaacgacguggccgcuaauaccagcuccacauuugaucccgaagucgccuacauuaacuucaagagaaucuauacgaccggccucucuuacgaccacauucggaucuuuuauauuaaagggcgcgaaaucaagacaagccuggcgaaaagauccgagugggaaguuacccuuaaucugggaggcuggaaggugacaguguucaacaccaauuuuccugggaaccgcaauucuccgguccccgaugacggacucacacugcaucggcuuagcggcuuccuggcuagauaccuccuggagaaaauccugaagguguccgauccugagaagcucauuaucaaaucuaagauuaucaacccccuggccgagaaaaaugggauuaccugggccgacggagaagaaguuuaucuuagcuuuuucccuggcuccgagauguuucugggcacguuccgguuuuacccccucgcuaucgggauuuauaaggugcagcgcaaagagauggaaccuaaguaccuggagaagaccaugagacaacgguacaugggacuugaagccagcacauggaccgucucuaaacugaacgaggugcaguccgcucucacaguugugagcggccugggguggaagaaaaccaaugucucuuccgccgcgcgcgaguuccuggccagauuuggaaucaacauguga

SEQ ID NO: 7448 - RNA, 702 nt, Artificial Sequence
  derived and/or modified CDS sequence (opt5) from ANADV(EIV-23263Tyum)__KT313761.1__N
augaucgaacuggaguucaacgacguggccgcuaauaccagcuccacauuugaucccgaagucgccuacauuaacuucaagagaaucuauacgaccggccucucuuacgaccacauucggaucuuuuauauuaaagggcgcgaaaucaagacaagccuggcgaaaagauccgagugggaaguuacccuuaaucugggaggcuggaagaucacaguguucaacaccaauuuuccugggaaccgcaauucuccggugcccgaugacggacucacacugcaucggcuuagcggcuuccuggcuagauaccuccuggagaaaauucugaaggucuccgauccugagaagcucaucauuaaaucuaagaucauuaacccccuggccgagaaaaaugggaucaccugggccgacggagaagaaguguaucuuagcuuuuucccuggcuccgagauguuucugggcacguuccgguuuuacccccucgcuauugggaucuauaagguucagcgcaaagagauggaaccuaaguaccuggagaagaccaugagacaacgguacaugggacuugaagccagcacauggaccgugucuaaacugaacgagguccaguccgcucucacagugguuagcggccugggguggaagaaaaccaaugugucuuccgccgcgcgcgaguuccuggccagauuuggaaucaacauguga

SEQ ID NO: 7449 - RNA, 702 nt, Artificial Sequence
  derived and/or modified CDS sequence (opt5) from BATV__X73464.1__N
augaucgaacuggaguucaacgacguggccgcuaauaccagcuccacauuugaucccgaagucgccuacauuaacuucaagagaaucuauacgaccggccucucuuacgacaauauucggaucuuuuauauuaaagggcgcgaaaucaagacaagccuguccaaaagaucugagugggaaguuacccuuaaccugggaggcuggaaggugacaguguucaauaccaacuuuccugggaaucggaacagcccgguccccgaugacggacucacacugcaccgccuuuccggcuuccuggcgagauaccuccuggagaaaauccugaaggugucugauccugagaagcucauuaucaaaagcaagauuguuaauccccuggcugagaaaaacgggaucaccugggccgacggagaagaaguguaucuuuccuuuuucccuggcagcgagauguuucugggcacguuccgguuuuacccccucgccauugggaucuauaagguccagcgcaaagagauggaaccuaaguaccuggagaagaccaugagacaacgguacaugggacuugaggcuucuacauggaccguguccaaacugaaugaaguucagagcgcccucacaguggucucuggccugggguggaagaaaaccaacguguccagcgcugcccgcgaguuccuggcgaaguuuggaauuucuauguga

SEQ ID NO: 7450 - RNA, 702 nt, Artificial Sequence
  derived and/or modified CDS sequence (opt5) from BATV(668)__KT313687.1__N
augaucgaacuggaauuuaacgacguggccgcuaauaccagcuccacauuugaucccgaggucgccuaccucaacuucaagagaauuuauacgaccggccugucuuacgacaauauccggauuuucuauaucaaagggcgcgaaauuaagguuagccuugcgaaaagauccgagugggaagugacacugaaccucggaggcuggaaggugaccgucuucaauacaaacuuuccugggaaucggaacucuccggugcccgaugacggacugacccuucaccgccugagcggcuuccucgcuagauaccugcuggagaaaauccucaagguuuccgauccugagaagcugaucauuaaaucuaagaucauuaauccccuugccgagaaaaacgggaucacauggagcgacggagaagaaguguaucuguccuuuuucccuggcagcgagauguuucucggcaccuuccgguuuuacccccuggccauugggaucuauaagguccagcgcaaagagauggaaccuaaguaccuugagaagacgaugagacaacgguacaugggacuggaggcuucuaccuggacaguguccaaacucaaugaaguucagagcgcccugaccguggucucuggccugggguggaagaaaacaaacguguccagcgcugcccgcgaguuccucgcgaaguuuggaauuaauauguga

SEQ ID NO: 7451 - RNA, 702 nt, Artificial Sequence
  derived and/or modified CDS sequence (opt5) from BATV(804922)__FJ436805.1__N
augaucgaacuggaguucaacgacguggccgcuaauaccagcuccacauuugaucccgaagucgccuacauuaacuucaagagaaucuauacgaccggccucucuuacgacaauauucggaucuuuuauauuaaagggcgcgaaaucaagacaagccuggcgaaaagauccgagugggaaguuacccuuaaccugggaggcuggaaggugacaguguucaauaccaacuuuccugggaaucggaacucuccgguccccgaugacggacucacacugcaccgccuuagcggcuuccuggcuagauaccuccuggagaaaauccugaagguguccgauccugagaagcucauuaucaaaucuaagauuguuaauccccuggccgagaaaaacgggaucaccugggccgacggagaagaaguguaucuuagcuuuuucccuggcuccgagauguuucugggcacguuccgguuuuacccccucgcuauugggaucuauaagguccagcgcaaagagauggaaccuaaguaccuggagaagaccaugagacaacgguacaugggacuugaagccagcacauggaccgugucuaaacugaaugagguucaguccgcucucacaguggucagcggccugggguggaagaaaaccaacgugucuuccgccgcgcgcgaguuccuggccaaguuuggaauuagcauguga

SEQ ID NO: 7452 - RNA, 702 nt, Artificial Sequence
  derived and/or modified CDS sequence (opt5) from BATV(8627-11)__FJ436802.1__N
augaucgaacuggaguucaacgacguggccgcuaauaccagcuccacauuugaucccgaagucgccuacauuaacuucaagagaaucuauacgaccggccucucuuacgacaauauucggaucuuuuauauuaaagggcgcgaaaucaagacaagccuggcgaaaagauccgagugggaaguuacccuuaaccugggaggcuggaaggugacaguguucaauaccaacuuuccugggaaucggaacucuccgguccccgaugacggacucacacugcaccgccuuagcggcuuccuggcuagauaccuccuggagaaaauccugaagguguccgauccugagaagcucauuaucaaaucuaagauuguuaauccccuggccgagaaaaacgggaucaccugggccgacggagaagaaguguaucuuagcuuuuucccuggcuccgagauguuucugggcacguuccgguuuuacccccucgcuauugggaucuauaagguccagcgcaaagagauggaaccuaaguaccuggagaagaccaugagacaucgguacaugggacuugaagccagcacauggaccgugucuaaacugaaugagguucaauccgcucucacaguggucagcggccugggguggaagaaaaccaacgugucuuccgccgcgcgcgaguuccuggccaaguuuggaauuagcauguga

SEQ ID NO: 7453 - RNA, 702 nt, Artificial Sequence
  derived and/or modified CDS sequence (opt5) from BATV(G-20217)__FJ436806.1__N
augaucgaacuggaguucaacgacguggccgcuaauaccagcuccacauuugaucccgaagucgccuacauuaacuucaagagaaucuauacgaccggccucucuuacgacaauauucggaucuuuuauauuaaagggcgcgaaaucaagacaagccuggcgaaaagauccgagugggaaguuacccuuaaccugggaggcuggaaggugacaguguucaauaccaacuuuccugggaaucggaacucuccgguccccgaugacggacucacacugcaccgccuuagcggcuuccuggcuagauaccuccuggagaaaauccugaagguguccgauccugagaagcucauuaucaaaucuaagauuguuaauccccuggccgagaaaaacgggaucaccugggccgacggagaagaaguguaucuuagcuuuuucccuggcuccgagauguuucugggcacguuccgguuuuacccccucagcauugggaucuauaagguccagcgcaaagagauggaaccuaaguaccuggagaagaccaugagacaacgguacaugggacuugaggcuucuacauggaccguguccaaacugaaugaaguucagagcgcccucacaguggucucuggccugggguggaagaaaaccaacguguccagcgcugcccgcgaguuccuggcgaaguuuggaauuucuauguga

SEQ ID NO: 7454 - RNA, 702 nt, Artificial Sequence
  derived and/or modified CDS sequence (opt5) from BATV(MS50)__JX846604.1__N
augaucgagcuggaauuuaacgacguggccgcuaauaccagcuccacauuugaucccgaggucgccuacgcgaacuucaagagaguucacacgaccggccucucuuaugaccaugugcggauuuucuacaucaaagggcgcgaaauuaagacaagccuguccaaaagaucugagugggaagugacccuuaaucugggaggcuggaagaucgcugucuauaacacaaauuucccuagcaaccggaauaacccggugcccgaugacgggcucacccugcaccgccuuuccggauaccuggccagauaucucuuugagaaaauuguuaaggugucugagccugaaaagcugcugaucaaaagcaagaucauuaauccccucgccgagaaaaacggcaucacaugggcugauggggaagagauuuaccuguccuucuuuccuggaagcgagauguuccuuggcaccuuuaaguucuauccccuggccaucggcauuuacaaaguccagcggaaggaaauggagccuaaguaccucgagaaaacgaugcgccaaagauauauggggcuggaagcuggaaccuggacagugucuaagguuaaugaagugcaggccgcggucaacgugguguccacccuuggcuggaaaaagacaaaugucagcgccgcugcccgggaguuucuggcuaaauucgggaucgccauguga

SEQ ID NO: 7455 - RNA, 702 nt, Artificial Sequence
  derived and/or modified CDS sequence (opt5) from BATV(ON-1/E/94)__AB257761.1__N
augaucgaacuggaauuuaacgacguggccgcuaauaccagcuccacauuugaucccgaggucgccuacauuaacuucaagagaguuuauacgaccggccucucuuacgacaauauccggauuuucuauaucaaagggcgcgaaauuaagacaagccuggcgaaaagauccgagugggaagugacccuuaaccugggaggcuggaaggugacagucuucaauaccaacuuuccugggaaucggaacucuccggugcccgaugacggacucacacugcaccgccuuagcggcuuccuggcuagauaccuccuggagaaaauccugaagguuuccgauccugagaagcucaucauuaaaucuaagaucgugaauccccuggccgagaaaaacgggauuaccugggccgacggagaagaagucuaucuuagcuuuuucccuggcuccgagauguuucugggcacguuccgguuuuacccccucgcuaucgggauuuauaaggugcagcgcaaagagauggaaccuaaguaccuggagaagaccaugagacaacgguacaugggacuugaagccagcacauggaccguuucuaaacugaaugaggugcaguccgcucucacagucgugagcggccugggguggaagaaaaccaacgugucuuccgccgcgcgcgaguuccuggccaaguuuggaaucagcauguga

SEQ ID NO: 7456 - RNA, 702 nt, Artificial Sequence
  derived and/or modified CDS sequence (opt5) from BATV(UgMP-6830)__JX846601.1__N
augaucgaacuggaguucaacgacguggccgcuaauaccagcuccacauuugaucccgaagucgccuacauuaacuucaagagaaucuauacgaccggccucucuuacgacaauauucggaucuuuuauauuaaagggcgcgaaaucaagacaagccuggcgaaaagauccgagugggaaguuacccuuaaccugggaggcuggaaggugacaguguucaauaccaacuuuccugggaaucggaacucuccgguccccgaugacggacucacacugcaccgccuuagcggcuuccuggcuagauaccuccuggagaaaauccugaagguguccgauccugagaagcucauuaucaaaucuaagauuaucaauccccuggccgagaaaaacgggauuaccugggccgacggagaagaaguuuaucuuagcuuuuucccuggcuccgagauguuucugggcacguuccgguuuuacccccucgcuaucgggauuuauaaggugcagcgcaaagagauggaaccuaaguaccuggagaagaccaugagacaacgguacaugggacuugaagccagcacauggaccgucucuaaacugaaugaggugcaguccgcucucacaguugugagcggccugggguggaagaaaaccaacgucucuuccgccgcgcgcgaguuccuggccaaguuuggaaucagcauguga

SEQ ID NO: 7457 - RNA, 702 nt, Artificial Sequence
  derived and/or modified CDS sequence (opt5) from BIRV(ArB2198)__AM711131.1__N
augaucgagcuggaauuucaccauguggccgcuaacaccagcuccacauuugaccccgaggucgccuacgcgaauuucaagcggauucacacgaacggccucucuuaugauaauaucagaauuuucuacaucaaagggcgcgaaauuaagaccagccuggcuaaaagauccgagugggaaguuacacuuaaccugggaggcuggaagguggccguguauaauaccaacuucccugggaaucggaacaauccgguccccgacgauggacucacacugcaucgccuuucuggcuuucuggccagauaccuccuggagaaaaugcugaaggugagcgagccugaaaagcucaucaucaaaaccaagauuaucaacccccuggcugagaaaaaugggauuacauggaaggacggagaagagguuuaucuuuccuucuuuccuggcucugagauguuccugggcaccuuuaaauucuacccccucgccaucgggauuuauaaggugcagaagaaagaaauggauccuaaguaccuggagaaaacgaugcggcaacgcuacaugggacuugaagcuagcaccuggacagucuccaaggugagcgagguucagucugcccugaccguggucuccagccucggcuggaaaaagacaaacgugaccgcggccgcuagagacuuuuucgccaaauuugggaucaauauguga

SEQ ID NO: 7458 - RNA, 702 nt, Artificial Sequence
  derived and/or modified CDS sequence (opt5) from BOZOV(ArB13529)__AM711132.1__N
augaucgagcuggaguucaacgacguggccgcuaauaccagcuccacauuugaucccgaagccgcguacgcuaacuucaagagaguccacacgaccggccucacauaugaccauauucggaucuuuuacauuaaagggucugaaaucaagaccagccuggccaaacgcuccgagugggaaguuacacuuaaucugggaggcuggaagauuaccguguauaacacaaauuucccugggaacagaaauaacccgucucccgaugacggacucacccugcacuuuuucugcggcuuucuugccaaaagccugcucgagaagaugcugaagguguccgcuccugagaaacugaucaucaagucuaaaauuacgagcccccucgccgaaaagaaugggaucaccuggaacgauggagaggaagucuaccuguccuucuuuccuggcagcgagauguuccuuggcacauuucauuucuauccccugccuauugggaucuaccagggacuccggcgcgaccuggagccgaaauauuuuggcaagacccuuagacugauguacauggggcucgaggcuucuuccuggacagugagcaagcugaccgaaggacaaucugcccugacgguuguguccggccucggguggaaaaagacaaaugucagcgcggccgcucgggauuuccuggccaaauucggaauuaacauguga

SEQ ID NO: 7459 - RNA, 702 nt, Artificial Sequence
  derived and/or modified CDS sequence (opt5) from CVV__X73465.1__N
augaucgagcuggaguucaacgacguggccgcuaauaccagcuccacauuugaucccgaaauugccuacgucaacuucaagagaauccacacgaccggccucucuuaugaccauauucggaucuuuuacauuaaagggcgcgaaaucaagacaagccugaccaaaagauccgagugggaaguuacacuuaaucugggaggcuggaaggugaccguguucaacacaaauuuuccugggaaccgcaauucuccgguccccgaugacggacucacccugcaccggcuuagcggcuaucuggcgagauaccuccuggagaaaauccugaagguguccgauccugagaagguuauuaucaaaucuaagauuaucaacccccucgcugagaaaaaugggauuacguggagcgacggagaagaaguguaucuguccuucuuuccuggcagcgagauguuccuuggcaccuuuaaguucuacccccuggccaucgggauuuauaaaguccagcggaaggagauggaaccuaaguaccucgagaaaacaaugcgccaaagauacaugggacuggaagccucuaccuggacaaucuccaaggugaacgagguucaggcugcccuuaccguggucagcggccugggguggaaaaagacgaaugugucugcugccgcgcgggaauuucucgccaaauucggaaucuccauguga

SEQ ID NO: 7460 - RNA, 702 nt, Artificial Sequence
  derived and/or modified CDS sequence (opt5) from CVV(10081)__KP835932.1__N
augaucgagcuggaguucaacgacguggccgcuaauaccagcuccacauuugaucccgaaauugccuacgucaacuucaagagaaucuauacgaccggccucucuuacgaccacauucggaucuuuuauauuaaagggcgcgaaaucaagacaagccugaccaaaagauccgagugggaaguuacacuuaaucugggaggcuggaagaucaccguguucaacacaaauuuuccugggaaccgcaauucuccggugcccgaugacggacucacccugcaucggcuuagcggcuaccuggcgagauaucuccuggagaaaauucugaaggucuccgauccugagaaggugaucauuaaaucuaagaucauuaacccccucgcugagaaaaaugggaucacguggagcgacggagaagaaguuuaccuguccuucuuuccuggcagcgagauguuccuuggcaccuuuaaguucuauccccuggccauugggaucuacaaagugcagcggaaggagauggaaccuaaguaccucgagaaaacaaugcgccaaagauauaugggacuggaagccucuaccuggacaaucuccaaggucaacgaggugcaggcugcccuuaccguugugagcggccugggguggaaaaagacgaaugucucugcugccgcgcgggaauuucucgccaaauucggaauuuccauguga

SEQ ID NO: 7461 - RNA, 702 nt, Artificial Sequence
  derived and/or modified CDS sequence (opt5) from CHLV(CHLV-Mex07)__EU879062.3__N
augaucgagcuggaguucaacgacguggccgcuaauaccagcuccacauuugaucccgaaauugccuacgucaacuucaagagaaucuauacgaccggccucucuuacgaccacauucggaucuuuuauauuaaagggcgcgaaaucaagacaagccugaccaaaagauccgagugggaaguuacacuuaaucugggaggcuggaaggugaccguguucaacacaaauuuuccugggaaccgcaauucuccgguccccgaugacggacucacccugcaucggcuuagcggcuaccuggcgagauaucuccuggagaaaauccugaagguguccgauccugagaagguuauuaucaaaucuaagauuaucaacccccucgcugagaaaaaugggauuacguggagcgacggagaagaaguguaccuguccuucuuuccuggcagcgagauguuccuuggcaccuuuaaguucuauccccuggccaucgggauuuacaaaguccagcggaaggagauggaaccuaaguaccucgagaaaacaaugcgccaaagauauaugggacuggaagccucuaccuggacaguguccaagguuaacgaggugcaggcugcccuuaccgucgugagcggccugggguggaaaaagacgaaugugucugcugccgcgcgggaauuucucgccaaauucggaaucuccauguga

SEQ ID NO: 7462 - RNA, 702 nt, Artificial Sequence
  derived and/or modified CDS sequence (opt5) from GERV__M19420.1__N
augcuggagcucgaguucgaagacgugcccaacaauaucggcagcaccuuugauccugaauccggguacacaaacuuccagagaaauuaucugccgggagucacgcuugaccaaauucggaucuuuuacauuaagggccgcgagaucaaaaacucucugagcaagagauccgaaugggagguuacccucaaucuugggggauggaaagugcccgugcugaacacaaauuucccuggcaaccggaauaacgccguccccgauuaugggcugaccuuucaccgcauuucuggauaccucgcuagauaucugcugggcaaguaccucgccgagacagaaccugagaaacugaucaugcggaccaagaucgugaauccccuugcggaaaagaacggcauuacaugggagagcgggccugagguuuaucuguccuucuuuccgggagcugaaauguuccucggcaccuuucgcuucuacccccuggccaucgggauuuacaaagugcagagaaaggagauggacccuaaauuucuugaaaagacgaugcggcagcgcuaucugggaaucgaugcccagaccuggacaaccacaaaacucggcgaggucgaagcugcccugaaggugguuucugggcugggauggaagaaaaccaaugugagcuccgcugccagagaguuccucagcaaguuuggcauucggauguga

SEQ ID NO: 7463 - RNA, 702 nt, Artificial Sequence
  derived and/or modified CDS sequence (opt5) from IACOV(BeAn314206)__JN572067.1__N
augagcgagaucauuuucgacgaugugggccagaucaccuccucuacauuuaaccccgacguccaauacauuaauuucaagaaaaaccacacgaccgggcugaauuaugaucagaucagaguguuuuuccucaacggaaagaaagccaaggaaacacuggcuaaacggagcgaggaaucccuucagcugaauuuuggcggguggcgcguuguggucaugaacacccauuucccuggaaauagaaacaugcucauuccggacgaggccaugacacugcaccggcuuucuggcuaccuggcgcgcuaucuccuggaaagaauccugagcgggcccgagcaugagaaggugguuaucaccuccaagauugugaauccuaucgcugccucuaacggaauuacauggaccgauggccccgaagucuaccucagcuuuuucccuggcacggagauguuucuggaauccuucaaauuuuauccccuugccaucgggauuuacaaggugcagaaaaagaugauggagagcaaauaucuggagaaggcuaugcggcaaaaguacucuggaauggacgccacccucuggacacagcagaaauacgcugaaguuaccaaugcccuggcgguggucuccaaccuuggcuggaagaaaagcaaugugucugccgcugcccgcgauuuccuggcuaaguuugggauccagcucuga

SEQ ID NO: 7464 - RNA, 702 nt, Artificial Sequence
  derived and/or modified CDS sequence (opt5) from ILEV(ArB16282)__AM709780.1__N
augaucgagcuggaauuucacgacgugaccgccaacacaagcuccacguuugaucccgaggucgcuuacgccaauuucaagcggauucauaccaacggccucaauuaugaccacaucagaauuuucuacaucaaagggcgcgaaauuaagacaucucuggcgaaaagaagcgagugggaaguuacccuuaaccugggaggcuggaagaucuccguguauaauacaaaauucccugggaaccggaauaacccggugcccgaugacggacucacccugcaucgccuuucuggcuuucuggcuagauaccuccuggagaagaugcugaaggucagcgagccugaaaaacucaucauuaaguccaaaaucauuaauccccuggccgagaagaacgggaucacaugguaugauggagaagagguguaccuuucuuucuuuccuggcagcgagaugugccugggcacccaggacuucuaucccauggccauugaauuuuaccaaguucagcggaaagagauggaaccuaaguuccucgagaagacgcugaaacagcgcucccuugggcuggaaccgagcaccuggacaaucucucagcucgugaagcugcaauccgcucugaccgucgugagcggacucggcuggaaaaagacaaauguuggggccgcugccagaaacuuucuggcgaaauucggaauuaauauguga

SEQ ID NO: 7465 - RNA, 702 nt, Artificial Sequence
  derived and/or modified CDS sequence (opt5) from ILEV(HB80P125)__AM709779.1__N
augaucgagcuggaauuucacgacgugaccgccaacacaagcuccacguuugaucccgaggucgcuuacgccaauuucaagcggauucauaccaacggccucaauuaugaccacaucagaauuuucuacaucaaagggcgcgaaauuaagacaucucuggcgaaaagaagcgagugggaaguuacccuuaaccugggaggcuggaagaucgcuguguauaauacaaacuucccugggaaucggaacaauccggugcccgaugacggacucacccugcaucgccuuuccggcuaccuggccagaugccuccuggagaaaaugcugaaggucucugagccugaaaagcagaucauuaaaagcaagaucauuaacccccucgccgagaaaaaugggaucacaugggaugacggagaagagguguaucuguccuuuuucccuggcucugagauguuucuuggcaccuuccgguuuuacccccuggcuauugggaucuauaagguucaacgcaaagaaauggagccuaaguaccucgaaaagacgaugagacagcgguacaugggacuggaggccagcaccuggacaauuuccaaacuugcugaagugcagagcgcccugaccgucgugucuggccucggguggaagaaaacaaacguuuccgcggccgcucgcgauuuccuggccaaguuuggaaucaauauguga

SEQ ID NO: 7466 - RNA, 702 nt, Artificial Sequence
  derived and/or modified CDS sequence (opt5) from ILEV(ILESHA/8e)__KC608151.1__N
augaucgagcuggaauuucacgacgugaccgccaacacaagcuccacguuugaucccgaggucgcuuacgccaauuucaagcggauucauaccaacggccucaauuaugaccacaucagaauuuucuacaucaaagggcgcgaaauuaagacaucucuggcgaaaagaagcgagugggaaguuacccuuaaccugggaggcuggaagaucgcuguguauaauacaaacuucccugggaaucggaacaauccgauccccgaugacggacucacccugcaucgccuuuccggcuaccuggccagauaucuccuggagaaaaugcugaaggugucugagccugaaaagcagauuaucaaaagcaagauuaucaacccccucgccgagaaaaaugggauuacaugggaugacggagaagaggucuaccuguccuuuuucccuggcucugagauguuucuuggcaccuuccgguuuuauccccuggcuaucgggauuuacaaggugcaacgcaaagaaauggagccuaaguaccucgaaaagacgaugagacagcgguauaugggacuggaggccagcaccuggacaaucuccaaacuugcugaaguucagagcgcccugaccguggucucuggccucggguggaagaaaacaaacguguccgcggccgcucgcgauuuccuggccaaguuuggaaucaauauguga

SEQ ID NO: 7467 - RNA, 702 nt, Artificial Sequence
  derived and/or modified CDS sequence (opt5) from ILEV(R5964)__AY729651.1__N
augaucgagcuggaauuucacgacgugaccgccaacacaagcuccacguuugaucccgaggucgcuuacgccaauuucaagcggauucauaccaacggccucaauuaugaccacaucagaauuuucuacaucaaagggcgcgaaauuaagacaucucuggcgaaaagaagcgagugggaaguuacccuuaaccugggaggcuggaagaucgcuguguauaauacaaacuucccugggaaucggaacaauccgauccccgaugacggacucacccugcaucgccuuuccggcuaccuggccagauaucuccuggagaaaaugcugaaggugucugagccugaaaagcagauuaucaaaagcaagauuaucaacccccucgccgagaaaaaugggauuacaugggaugacggagaagaggucuaccuguccuuuuucccuggcucugagauguuucuuggcaccuuccgguuuuauccccuggcuaucgggauuuacaaggugcaacgcaaagaaauggagccuaaguaccucgaaaagacgaugagacagcgguauaugggacuggaggccagcaccuggacaaucuccaaacuugcugaaguucagagcgcccugaccguggucucuggccucggguggaagaaaacaaacguguccgcgccggcccgcgauuuccuggcuaaguuuggaaucaauauguga

SEQ ID NO: 7468 - RNA, 702 nt, Artificial Sequence
  derived and/or modified CDS sequence (opt5) from MAGV__D13783.1__N
augaucgagcuggaguucaacgacguggccgcuaauaccagcuccacauuugaucccgaaauugccuacgucaacuucaagagaauccacacgaccggccucucuuaugaccauauucggguucuguacaucaaagggcgcgaaauuaagacaagccuuaccaaaagauccgagugggaagugacacugaaucucggaggcuggaagguggcggucuuuaacaccaauuucccugggaaccgcaauucuccggugcccgaugacggacugacacuucaccggcugagcggcuuucucgcuagauaucugcuggagaaaauccucaagguuuccgauccugagaagcugaucauuaaaucuaagaucauuaacccccuugccgagaaaaaugggaucaccugggccgacggagaagaaguguaccugagcuucuuuccuggcuccgagauguuccucggcacguuuaaguucuauccccuggcuauugggaucuacaaaguccagaagaaggagauggaaccuaaauaucuugagaagaccaugcggcaacgcuacaugggacuggaagccgcuacauggaccgugagcaaaguuaacgaggugcaggccgcgcucacagucgugucuggccugggguggaagaaaaccaauguguccgccgcugccagagaauuucuggcuaaguucggaauuaacauguga

SEQ ID NO: 7469 - RNA, 702 nt, Artificial Sequence
  derived and/or modified CDS sequence (opt5) from MAGV(7272)__KX100103.1__N
augaucgagcuggaguucaacgacguggccgcuaauaccagcuccacauuugaucccgaaauugccuacgucaacuucaagagaauccacacgaccggccucucuuaugaccauauucggguucuguacaucaaagggcgcgaaauuaagacaagccuuaccaaaagauccgagugggaagugacacugaaucucggaggcuggaagguggcggucuuuaacaccaauuucccugggaaccgcaauucuccggugcccgaugacggacugacacuucaccggcugagcggcuuucucgcuagauaucugcuggagaaaauccucaagguuuccgauccugagaagcugaucauuaaaucuaagaucauuaacccccuugccgagaaaaaugggaucaccugggccgacggagaagaaguguaccugagcuucuuuccuggcuccgagauguuccucggcacguuuaaguucuauccccuggcuauugggaucuacaaaguccagcggaaggagauggaaccuaaguaucuugagaaaaccaugcgccaaagauacaugggacuggaagccgcuacauggaccgugagcaagguuaacgaggugcaggccgcgcucacagucgugucuggccugggguggaaaaagaccaauguguccgccgcugcccgggaauuucuggcuaaauucggaauuaacauguga

SEQ ID NO: 7470 - RNA, 702 nt, Artificial Sequence
  derived and/or modified CDS sequence (opt5) from MAGV(3363)__KX100106.1__N
augaucgagcuggaguucaacgacguggccgcuaauaccagcuccacauuugaucccgaaauugccuacgucaacuucaagagaaucuauacgaccggccucucuuacgaccacauucggaucuuuuauauuaaagggcgcgaaaucaagacaagccugaccaaaagauccgagugggaaguuacacuuaaucugggaggcuggaaggugaccguguucaacacaaauuuuccugggaaccgcaauucuccgguccccgaugacggacucacccugcaucggcuuagcggcuaccuggcgagauaucuccuggagaaaauccugaagguguccgauccugagaagguuauuaucaaaucuaagauuaucaacccccucgcugagaaaaaugggauuacguggagcgacggagaagaaguguaccuguccuucuuuccuggcagcgagauguuccuuggcaccuuuaaguucuauccccuggccaucgggauuuacaaaguccagcggaaggagauggaaccuaaguaccucgagaaaacaaugcgccaaagauauaugggacuggaagccucuaccuggacaaucuccaaggugaacgagguucaggcugcccuuaccguggucagcggccugggguggaaaaagacgaaugugucugcugccgcgcgggaauuucucgccaaauucggaaucuccauguga

SEQ ID NO: 7471 - RNA, 702 nt, Artificial Sequence
  derived and/or modified CDS sequence (opt5) from NRIV(DakArY357/6e)__AY593727.1__N
augaucgagcuggaauuucacgacgugaccgccaacacaagcuccacguuugaucccgaggucgcuuacgccaauuucaagcggauucauaccaacggccucaauuaugacuacaucagaauuuucuauaucaaagggcgcgaaauuaagacaucucuggcgaaaagaagcgagugggaaguuacccuuaaccugggaggcuggaagaucgcuguguacaauacaaacuucccugggaaucggaacaauccgauccccgaugacggacucacccugcaccgccuuuccggcuaucuggccagauaccuccuggagaaaaugcugaaggugucugagccugaaaagcagauuaucaaaagcaagauuaucaacccccucgccgagaaaaaugggauuacaugggaugacggagaagaggucuaucuguccuuuuucccuggcucugagauguuucuuggcaccuuccgguuuuacccccuggcuaucgggauuuacaaggugcaacgcaaagaaauggagccuaaguaucucgaaaagacgaugagacagcgguacaugggacuggaggccagcaccuggacaaucuccaaacuugcugaaguucagagcgcccugaccguggucucuggccucggguggaagaaaacaaacguguccgcggccgcucgcgauuuccuggccaaguuuggaaucaauauguga

SEQ ID NO: 7472 - RNA, 702 nt, Artificial Sequence
  derived and/or modified CDS sequence (opt5) from NORV__X73470.1__N
augaucgagcuggaauuuaacgacguggccgcuaauaccagcuccacauuugaucccgaggucgccuacauuaacuucaagagaguuuauacgaccggccucucuuacgaccacauccggauuuucuauaucaaagggcgcgaaauuaagacaagccugaccaaaagauccgagugggaagugacacuuaaucugggaggcuggaaggugaccgucuucaacacaaauuuuccugggaaccgcaauucuccggugcccgaugacggacucacccugcaucggcuuagcggcuuccuggcgagauaccuccuggagaaaauccugaagguuuccgagccugaaaagcucaucauuaaaucuaagaucauuaacccccuggcugagaaaaaugggaucacguggaccgauggagaagagguguaucuuagcuuuuucccuggcuccgagauguuucugggcacauucaaguuuuacccccucgccauugggaucuauaaaguccagcggaaggaaauggagccuaaguaccuggagaaaaccaugcgccaaagauacaugggacuugaagccagcacauggaccauuucuaaggugaacgaaguucaggcugcccugacgguggucuccggccucggguggaaaaagacaaaugugagcgcugccgcgcgggaguuccuggccaaauuuggaaucaacauguga

SEQ ID NO: 7473 - RNA, 702 nt, Artificial Sequence
  derived and/or modified CDS sequence (opt5) from POTV(89-3380)__AY729652.1__N
augaucgagcuggaguucaacgacguggccgcugauaccagcuccacauuugaccccgaaauugccuacgucaauuucaagagaauccacacgaccggccucucuuaugaucauauucggaucuuuuacauuaaagggcgcgaaaucaagacaagccugaccaaaagauccgagugggaaguuacacuuaaccugggaggcuggaagaucaccguguucaauacaaacuuuccugggaaucggaacucuccggugcccgacgauggacucacccugcaccgccuuagcggcuaucuggcgagauaccuccuggagaaaauucugaaggucuccgacccugagaaggugaucauuaaaucuaagaucauuaauccccucgcugagaaaaacgggaucacguggagcgauggagaagaaguuuaucuguccuucuuuccuggcagcgagauguuccuuggcaccuuuaaguucuacccccuggccauugggaucuauaaagugcagcggaaggagauggaaccuaaguaccucgagaaaacaaugcgccaaagauacaugggacuggaagccucuaccuggacagucuccaaggugaaugagguucaggcugcccuuaccguggucagcggccugggguggaaaaagacgaacgugucugcugccgcgcgggaauuucucgccaaauucggaaucuccauguga

SEQ ID NO: 7474 - RNA, 702 nt, Artificial Sequence
  derived and/or modified CDS sequence (opt5) from SHOV(4042)__EU564831.1__N
augaucgagcuggaguuccacgacguggccgcuaacaccagcuccacauuugaucccgaagucgccuacgcgaauuucaagagaguucauacgaccggccucucuuaugaccacauucggaucuuuuacauuaaagggcgcgaaaucaagacaagccuggcuaaaagauccgagugggaagugacccuuaaccugggaggcuggaagauuacaguguauaauaccaacuucccugggaaucggaacaauccgguccccgaugacggacucacacugcaucgccuuucuggcuuucuggccagauaccuccuggagaaaaugcugaaggugagcgagccugaaaagcucaucaucaaauccaagauuaucaacccccuggccgagaaaaaugggauuaccuggacggauggagaagagguuuaucuuucuuucuuuccuggcgcugagauguuccugggcaccuuuaaguucuacccccucgccaucgggauuuauaaagugcagcggaaggaaauggagccuaaguaccuggagaaaacaaugcgccaaagauacaugggacuugaagcugccaccuggacagucagcaagcugaccgaagugcaggcggcccucacgguuguguccggccugggguggaaaaagacaaacgucagcgcugccgcucgggacuuucuggccaaauucggaaucucuauguga

SEQ ID NO: 7475 - RNA, 702 nt, Artificial Sequence
  derived and/or modified CDS sequence (opt5) from TENV(TSV-FE3-66FB)__FJ943505.1__N
augaucgaacuggaguucaacgacguggccgcuaauaccagcuccacauuugaucccgaagucggcuacguuaacuucaagagagugcacacgaccgggcucucuuaugaccauauucggaucuuuuacauuaaaggacgcgaaaucaagacaagccugaccaaaagauccgagugggaagugacacuuaaucugggcggguggaaggucaccguguucaacacaaauuuuccuggaaaccgcaauucuccgguucccgaugacggccucacccugcaccggcuuagcggguuccuggccagauaucuccuggagaaaauucugaagguguccgauccugagaagcucaucaucaaaucuaagauuaucaacccccuggcggagaaaaauggaauuacgugggcugacggcgaagaagucuaccuuagcuuuuucccuggcuccgagauguuucuggggaccuucaaguuuuauccccucgccaucggaauuuacaaagugcagcggaaggagauggaaccuaaguaucuggagaaaacaaugcgccaaagauacaugggccuugaagccgcuaccuggacaaucagcaagguuaacgaggugcagucugcccugaccgucguguccgggcucggauggaaaaagacgaaugugagcgcugccgcgcgggaguuccuggccaaauuuggcauuaacauguga

SEQ ID NO: 7476 - RNA, 702 nt, Artificial Sequence
  derived and/or modified CDS sequence (opt5) from XINV(BeH388464)__EU564830.1__N
augcuggaacucgaguucaacgacguggccgcuaauaccagcuccacauuugaucccgaagucggcuacgccaacuucaagagaauccacacgaaugggcugucuuaugacaacauucggaucuuuuacauuaaaggacgcgaaaucaagaccagccuugcgaaaagauccgagugggaaguuacacugaaucucggcggguggaagauuaccguguauaacacaaauuucccuggaaaccggaaucauccgauccccgaugacggccugaccauccaccgccuuucuggguaccuggcuagauaucuccuggagaaaauucugaaggugagcgauccugagaagcuccugaucaaaacaaagauuaucaacccccuugccgagaaaaauggaauuaccuggaacgacggcgaagaagucuaccuguccuuuuucccuggcucugagauguuucucgggacguucaaguuuuauccccuggccaucggaauuuacaaagugcagcggaaggagauggaaccuaaguaccuugagaaagcuaugcgccaaagauauaugggccuggaaagcgccaccuggacaguuuccaagcucaaugaggugcagagcgcucugaccgucgugucugggcugggauggaaaaagacaaacguuuccgccgcggcccgggaguuccucgcuaaauuuggcaucaauauguga

SEQ ID NO: 7477 - RNA, 702 nt, Artificial Sequence; identical to SEQ ID NO: 7439
  derived and/or modified CDS sequence (opt5) from NRIV(9800535)__JX857328.1__N

SEQ ID NO: 7478 - RNA, 702 nt, Artificial Sequence
  derived and/or modified CDS sequence (opt5) from NRIV(Adrar)__KJ716848.1__N
augaucgagcuggaauuucacgacguggccgcuaacaccagcuccacauuugaucccgaggucgccuacgcgaauuucaagagaauuuauacgaccggccucucuuacgaccauauccggauuuucuauaucaaagggcgcgaaauuaagacaagccuggcuaaaagauccgagugggaaguuacccuuaaccugggaggcuggaagaucacaguguacaauaccaacuucccugggaaucggaacaauccggugcccgaugacggacucacacugcaccgccuuucuggcuuucuggccagauaucuccuggagaaaaugcugaaggucagcgagccugaaaagcucaucauuaaauccaagaucauuaacccccuggccgagaaaaaugggaucaccuggaacgauggagaagagguguaccuuucuuucuuuccuggcagcgagauguuccugggcacguuucgguucuauccccucgcuauugggaucuacaagguucagcgcaaagaaauggagccuaaguaccuggaaaagaccaugagacaacgguauaugggacuugaggccgcuacauggaccguguccaaacugacagaaguccagagcgcccucaccgugguuucuucccugggcuggaagaaaacgaaugugagcgcggccgcucgcgacuuucuggccaaguucgggauuaacauguga

SEQ ID NO: 7479 - RNA, 702 nt, Artificial Sequence
  derived and/or modified CDS sequence (opt5) from NRIV(D28542/4e)__KC608154.1__N
augaucgagcuggaguuccacgacguggccgcuaacaccagcuccacauuugaucccgaagucgccuacgcgaauuucaagagaguuuauacgaccggccucucuuacgaccauauucggaucuuuuauauuaaagggcgcgaaaucaagacaagccuggcuaaaagauccgagugggaagugacccuuaaccugggaggcuggaagauuacaguguacaauaccaacuucccugggaaucggaacaauccgguccccgaugacggacucacacugcaccgccuuucuggcuuucuggccagauaucuccuggagaaaaugcugaaggugagcgagccugaaaagcucaucaucaaauccaagauuaucaacccccuggccgagaaaaaugggauuaccuggaacgauggagaagagguuuaccuuucuuucuuuccuggcagcgagauguuccugggcacguuucgguucuauccccucgcuaucgggauuuacaaggugcagcgcaaagaaauggagccuaaguaccuggaaaagaccaugagacaacgguauaugggacuugaggccgcuacauggaccgucuccaaacugacagaagugcagagcgcccucaccguugugucuucccugggcuggaagaaaacgaaugucagcgcggccgcucgcgacuuucuggccaaguucgggaucaacauguga

SEQ ID NO: 7480 - RNA, 702 nt, Artificial Sequence
  derived and/or modified CDS sequence (opt5) from NRIV(SUD-HKV141)__JX857322.1__N
augaucgagcuggaguuccacgacguggccgcuaacaccagcuccacauuugaucccgaagucgccuacgcgaauuucaagagaguucauacgaccggccucucuuaugaccacauucggaucuuuuacauuaaagggcgcgaaaucaagacaagccuggcuaaaagauccgagugggaagugacccuuaaccugggaggcuggaaggugacagucuauaauaccaacuucccugggaaucggaacaauccggugcccgaugacggacucacacugcaucgccuuucuggcuuucuggccagauaccuccuggagaaaaugcugaagguuagcgagccugaaaagcucauuaucaaauccaagaucauuaacccccuggccgagaaaaaugggaucaccuggaacgauggagaagagguguaucuuucuuucuuuccuggcagcgagauguuccugggcacguuucgguucuacccccucgcuauugggaucuauaagguccagcgcaaagaaauggagccuaaguaccuggaaaagaccaugagacaacgguacaugggacuugaggccgcuacauggaccguguccaaacugacagaaguucagagcgcccucaccguggucucuucccugggcuggaagaaaacgaaugugagcgcggccgcucgcgacuuucuggccaaguucgggauuaacauguga

SEQ ID NO: 7481 - RNA, 705 nt, Artificial Sequence
  derived and/or modified CDS sequence (opt5) from BWAV(M459)__NC_034480.1__N
augagcgaccugaucuucuacgauguggacuccgucaacgccaaugaguuugaucccgacaccggcuaucucgauuucaagaacaauuacccuggggcucugaacacaaauacggccagaaccuuuuuccuuaacgcggcuaaagccaagaauguucugcggaacaaaccggacaagaaagugaaucccaaguuuggaaacugggaaguggaggucgugaauaaccacuucccuggcaaucgcaacaaucccauugggaaggaugaccucacacugcauagaaucucuggauaucuugcccgguggauucuggaagaguacaaacgcgaugacgaaagcgagaaggagaucauugaauccaccguuaucaacccuaucgcugagucuaacggcauuagauggagcgauggggccgaaaucuaucucuccuuuuuccccggaacagagauguuucuggagccuuucaaauuuuacccgcuggcuauuggcaucuaucgggugaagcacaaaaugauggacgcccaguuccucaagaaggcgcugcgccaaagauacggcaaaaugaccgccgaaaaguggaugucuacaaaagucaagaccauuggggaggcugugcggaauguugaaaaacuuaaguggggaaaaggcgggcugagcgaugccgcucgcaacuuucucaagaaguucgacaucgccaugauuuga

SEQ ID NO: 7482 - RNA, 705 nt, Artificial Sequence
  derived and/or modified CDS sequence (opt5) from BWAV(M459)__EU564827.1__N
augagcgaccugaucuucuacgauguggacuccgucaacgccaaugaguuugaucccgacaccggcuaucucgauuucaagaacaauuacccuggggcucugaacacaaauacggccagaaccuuuuuccuuaacgcggcuaaagccaagaauguucugcggaacaaaccggacaagaaagugaaucccaaguuuggaaacugggaaguggaggucgugaauaaccacuucccuggcaaucgcaacaaucccauugggaaggaugaccucacacugcauagaaucucuggauaucuugcccgguggauucuggaagaguacaaacgcgaugacgaaagcgagaaggagaucauugaauccaccguuaucaacccuaucgcugagucuaacggcauuagauggagcgauggggccgaaaucuaucucuccuuuuuccccggaacagagauguuucuggagccuuucaaauuuuacccgcuggcuauuggcaucuaucgggugaagcacaaaaugauggacgcccaguuccucaagaaggcgcugcgccaaagauacggcaaaaugaccgccgaaaaguggaugucuacaaaagucaaggcuauuggggaggccgugcggaauguugaaaaacuuaaguggggaaaaggcgggcugagcgaugcugcccgcaacuuucucaagaaguucgacaucgcgaugauuuga

SEQ ID NO: 7483 - RNA, 705 nt, Artificial Sequence
  derived and/or modified CDS sequence (opt5) from BWAV(UgAr1888)__KJ867185.1__N
augagcgaccugaucuucuacgauguggacuccgucaacgccaaugaguuugaucccgacaccggcuaucucgauuucaagaacaauuacccuggggcucugaacacaaauacggccagaaccuuuuuccuuaacgcggcuaaagccaagaauguucugcggaacaaaccggacaagaaagugaaucccaaguuuggaaacugggaaguggagauugucaauaaccacuucccuggcaaucgcaacaaucccaucgggaaggaugaccucacacugcauagaauuucuggauaucuugcccgguggauccuggaagaguacaaacgcgaugacgaaagcgagaaggagauuaucgaauccaccgugaucaacccuauugcugagucuaacggcaucagauggagcgauggggccgaaauuuaucucuccuuuuuccccggaacagagauguuucuggagccuuucaaauuuuacccgcuggcuaucggcauuuaucggguuaagcacaaaaugauggacgcccaguuccucaagaaggcgcugcgccaaagauacggcaaaaugaccgccgaaaaguggaugucuacaaaagugaaggcuaucggggaggccguccggaauguggaaaaacuuaaguggggaaaaggcgggcugagcgaugcugcccgcaacuuucucaagaaguucgacauugcgaugaucuga

SEQ ID NO: 7484 - RNA, 708 nt, Artificial Sequence
  derived and/or modified CDS sequence (opt5) from BWAV/PGAV(SAAr1)__EU564828.1__N
augagcggcgaccugguguucuacgaugucgacuccguuaacucuaaugccuuugaucccgacgcuggguauguggccuucagcaacaaucacccuggagcgcucaacaucaccacagcuagaacguuuuuccugaaugccgccaaggcuaaaggcgugcuucggaacaagccggauaaaaaggucaaacccaaguuuggggacugggagguggaaauuguuaauaaccauuucccuggaaaucgcaacaauaccaucggcgaggaugaccugacacuccacagaauuuccggguaccuggcccggugggugcuugaggaacauucuaaggaugacgaaagcgagaaagagcugaucgaauccaccauugucaaccccaucgcugagucuaauggaaucaaguggagcgauggcgccgcgauuuaucucuccuuuuucccuggcacagaaauguuucuggagcccuucaaauuuuucccucuggccaucgggauuuaccgcgugaagcacaaaaugauggacgcucaguuucucaagaaggcccugagacaacgguauggaaaacuuaccgcugagaaguggauggccacaaaaguuaagagcaucggcgaagcggugcgcgccgucgagaaacugaagugggggaaaggaggcauuucugaugcugccagaaccuuccucaagaaguucgacaucgcucugauuuga

SEQ ID NO: 7485 - RNA, 708 nt, Artificial Sequence; identical to SEQ ID NO: 7484
  derived and/or modified CDS sequence (opt5) from BWAV/PGAV(191B-07)__KJ867179.1__N

SEQ ID NO: 7486 - RNA, 708 nt, Artificial Sequence
  derived and/or modified CDS sequence (opt5) from CEV(283)__KX817314.1__N
augagcgaccugguguucuacgaugucgccuccaccggcgcuaacggguuugaccccgaugccggauauguugacuucugcgcgaaguacggcgagucuaucaaucucgcugccgugagaaucuuuuuccugaacgccgcuaaggccaaggcugcccuuagccggaaaccugaacgcaaggcgaauccgaaauuuggggaguggcaaguggaagucgugaacaaucacuuccccgccaacagaaauaacccuauuggaaauaacgaucugacaauucaucggaucuccggcuaucucgcucgcuggguucuggagcaguacaaggaaaaugaggacgagucucagagagaacuugugaagacgaccgucauuaaccccaucgccgagagcaaugggauccggugggaaaacggagcugagauuuaucuggccuuuuucccuggcacagagauguuucucgaaaccuucaaauuuuacccccugacaaucggcauuuaucgcgugaagaaugggaugauggauucccaguaccugaaaaaggcgcucagacagcgguacggaucucugaccgccgagaaauggaugagccaaaagacaggcaugaucgcuaagucccuuaaagaaguugagcagcugaagugggggcgcggaggccucagcgacaccgccagaacguuccugcagaaauuugggauuaaacuuccuuga

SEQ ID NO: 7487 - RNA, 708 nt, Artificial Sequence
  derived and/or modified CDS sequence (opt5) from CEV(BFS-283)__U12797.1__N
augagcgaccugguguucuacgaugucgccuccaccggcgcuaacggguuugaccccgaugccggauauguugacuucugcgcgaagcacggcgagucuaucaaucucgcugccgugagaaucuuuuuccugaacgccgcuaaggccaaggcugcccuuagccggaaaccugaacgcaaggcgaauccgaaauuuggggaguggcaaguggaagucgugaacaaucauuuccccgccaacagaaauaacccuauuggaaauaacgaucugacaauucaccggaucuccggcuaccucgcucgcuggguucuggagcaguauaaggaaaaugaggacgagucucagagagaacuugugaagacgaccgucauuaaccccaucgccgagagcaaugggauccggugggaaaacggagcugagauuuaccuggccuuuuucccuggcacagagauguuucucgaaaccuucaaauuuuauccccugacaaucggcauuuaccgcgugaagaaugggaugauggauucccaguaucugaaaaaggcgcucagacagcgguacggaucucugaccgccgagaaauggaugagccaaaagacaggcaugaucgcuaagucccuuaaagaaguugagcagcugaagugggggcgcggaggccucagcgacaccgccagaacguuccugcagaaauuugggauuaaacuuccuuga

SEQ ID NO: 7488 - RNA, 708 nt, Artificial Sequence
  derived and/or modified CDS sequence (opt5) from CHATV(Mohko ILO8-3)__KF719221.1__N
augagcgaccugguguucuacgaugucgccuccaccggcgcuaacggguuugaccccgaugagggauauauggccuucugcguuaagcacgcggaaucuaucagccucgcugccgugagaaucuuuuuccugaaugccgcuaaagccaaggcugcccuugcgcggaaaccugagaagaaagccuccccgaaguuuggcgaauggcaaguggagauugucaacaaucauuuccccgggaaccgcaauaacccuauuggaaauaacgaccugacagugcacagacucucuggcuaccuggcucgguggguucuugaacaguauaaggagaaugaggaugaaagccagcgcgagcugaucaaaacgaccgugauuaaccccaucgccgaauccaauggggucagaugggacucuggaccugagaucuaccucagcuuuuuccccggcacagagauguuucuggaaaccuucaaguuuuauccucugacaauuggcaucuaccgggugaaacaggggaugauggauccgcaguaucucaagaaagcucugcgccaaagauacggaacccuuacagccgacaaguggaugucccagaagguuaccgcgauugccaaaagccugaaggagguggaacagcucaaauggggccgcgggggacugucugauacggcucggaccuuccuucagaaguuuggcaucagacugcccuga

SEQ ID NO: 7489 - RNA, 708 nt, Artificial Sequence
  derived and/or modified CDS sequence (opt5) from CHATV(Mohko M07-1)__KF719224.1__N
augagcgaccugguguucuacgaugucgccuccaccggcgcuaacggguuugaccccgaugagggauauauggccuucugcguuaagcacgcggaaucuaucaaucucgcugccgugagaaucuuuuuccugaacgccgcuaaagccaaggcugcccuugcgcggaaaccugagaagaaagccagcccgaaguuuggcgaauggcaaguggagauugucaauaaccauuuccccgggaaucgcaacaauccuauuggaaacaaugaccugacagugcacagacucuccggcuaccuggcucgguggguucuugaacaguauaaggagaacgaggaugaaucucagcgcgagcugaucaaaacgaccgugauuaaucccaucgccgaaagcaacggggucagaugggacuccggaccugagaucuaccucagcuuuuuccccggcacagagauguuucuggaaaccuucaaguuuuauccucugacaauuggcaucuaccgggugaaacaggggaugauggauccgcaguaucucaagaaagcucugcgccaaagauacggaacccuuacagccgacaaguggaugucucagaagguuaccgcgauugccaaaucccugaaggagguggaacagcucaaauggggccgcgggggacugagcgauacggcucggaccuuccuucagaaguuuggcaucagacugcccuga

SEQ ID NO: 7490 - RNA, 708 nt, Artificial Sequence
  derived and/or modified CDS sequence (opt5) from CHATV(Mohko S07-2)__KF719233.1__N
augagcgaccugguguucuacgaugucgccuccaccggcgcuaacggguuugaccccgaugagggauauauggccuucugcguuaagcacgcggaaucuaucaaucucgcugccgugagaaucuuuuuccugaacgccgcuaaagccaaggcugcccuugcgcggaaaccugagaagaaagccagcccgaaguuuggcgaauggcaaguggagauugucaauaaccauuuccccgggaaucgcaacaauccuauuggaaacaaugaccugacagugcacagacucuccggcuaccuggcucgguggguucuugaacaguauaaggagaacgaggaugaaucucagcgcgagcugaucaaaacgaccgugauuaaucccaucgccgaaagcaacggggucagaugggacuccggaccugagaucuaccucagcuuuuuccccggcacagagauguuucuggaaaccuucaagguguauccucugacaaccggcauuuaccggguuaaacaggggaugauggauccgcaguaucucaagaaagcucugcgccaaagauacggaacacuuaccgccgacaaguggaugucucagaaggugacggcgaucgccaaaucccugaaggaggucgaacagcucaaauggggccgcgggggacugagcgauaccgcucggacauuucuucagaaguucggcauuagacugcccuga

SEQ ID NO: 7491 - RNA, 708 nt, Artificial Sequence
  derived and/or modified CDS sequence (opt5) from CHATV(LEIV-11483)__FJ853592.1__N
augagcgaccugguguucuacgaugucgccuccaccggcgcuaacggguuugaccccgaugagggauauauggccuucugcguuaagcacggccagucugugaaucucgcggcugugagaaucuuuuuccugaacgccgccaaagcuaaggccgcucuugcccggaaaccugaaaagaaagcgagcccgaaguuuggggaguggcaagucgaaauugugaauaaccauuuccccggaaaucgcaacaauccuaucggcaacaaugaccugacaauucacagacucuccggguaccuggcccgguggguucuugagcaguauaaggaaaacgaggaugagucucagcgcgaacugaucaaaacgaccgugauuaaucccaucgcugagagcaacggagucagaugggacuccggcgccgaaaucuaccucagcuuuuucccuggcacagagauguuucuggagaccuucaaguuuuauccccugacaauugggaucuaccgggugaaacagggaaugauggauccucaauaucucaagaaagcucugcgccagagauacggcacccuuacagccgacaaguggaugucucagaagguuaccgcgauugccaaaucccugaaggaaguggagcagcucaaaugggggcggggaggccugagcgauacggcucgcaccuuccuucaaaaguuugggaucagacugccguga

SEQ ID NO: 7492 - RNA, 708 nt, Artificial Sequence
  derived and/or modified CDS sequence (opt5) from CHATV(LEIV-11552)__EU479702.1__N
augagcgaccugguguucuacgaugucgccuccaccggcgcuaacggguuugaccccgaugagggauauauggccuucugcguuaagcacggccagucugugaaucucgcggcugugagaaucuuuuuccugaacgccgccaaagcuaaggccgcucuugcccggaaaccugaaaagaaagcgagcccgaaguuuggggaguggcaagucgaaauugugaauaaccauuuccccggaaaucgcaacaauccuaucggcaacaaugaccugacaauucacagacucuccggguaccuggcccgguggauccuugagcaguauaaggaaaacgaggaugagucucagcgcgaacugauuaaaacgaccguuaucaaucccaucgcugagagcaacggagugagaugggacuccggcgccgaaauuuaccucagcuuuuucccuggcacagagauguuucuggagaccuucaaguuuuauccccugacaaucgggauuuaccgggucaaacagggaaugauggauccucaauaucucaagaaagcucugcgccagagauacggcacccuuacagccgacaaguggaugucucagaaggugaccgcgaucgccaaaucccugaaggaaguugagcagcucaaaugggggcggggaggccugagcgauacggcucgcaccuuccuucaaaaguuugggauuagacugccguga

SEQ ID NO: 7493 - RNA, 708 nt, Artificial Sequence
  derived and/or modified CDS sequence (opt5) from CHATV(LEIV-13107)__FJ946829.1__N
augagcgaccugguguucuacgaugucgccuccaccggcgcuaacggguuugaccccgaugagggauauauggccuucugcguuaagcacggccagucugugaaucucgcggcugugagaaucuuuuuccugaacgccgccaaagcuaaggccgcucuugcccggaaaccugaaaagaaagcgaauccgaaguuuggggaguggcaagucgaaauugugaacaaucauuuccccggaaaccgcaauaacccuaucggcaauaacgaccugacaauucacagacucagcggguaccuggcccgguggguucuugagcaguauaaggaaaaugaggaugagucccagcgcgaacugaucaaaacgaccgugauuaaccccaucgcugagucuaauggagucagaugggacagcggcgccgaaguguaccucuccuuuuucccuggcacagagauguuucuggagaccuucaaguuuuauccccugacaaucgggauuuaccggguuaaacagggaaugauggauccucaauaucucaagaaagcucugcgccagagauacggcacccuuacagccgacaaguggaugucucagaaggugaccgcgaucgccaaaagccugaaggaagucgagcagcucaaaugggggcggggaggccuguccgauacggcucgcaccuuccuucaaaaguuugggauuagacugccguga

SEQ ID NO: 7494 - RNA, 708 nt, Artificial Sequence
  derived and/or modified CDS sequence (opt5) from CHATV(LEIV-17794)__FJ913879.1__N
augagcgaccugguguucuacgaugucgccuccaccggcgcuaacggguuugaccccgaugagggauauauggccuucugcguuaagcacggccagucugugaaucucgcggcugugagaaucuuuuuccugaacgccgccaaagcuaaggccgcucuugcccggaaaccugaacgcaaggcgagcccgaaauuuggggaguggcaagucgaaauugugaauaaccauuuccccggaaauagaaacaauccuaucggcaacaaugaccugacaauucaccggcucuccggguaccuggcccgcuggguucuugagcaguauaaggaaaacgaggaugagucucagagagaacugaucaagacgaccgugauuaaucccaucgcugagagcaacggaguccggugggacuccggcgccgaaaucuaccucagcuuuuucccuggcacagagauguuucuggagaccuucaaauuuuauccccugacaauugggaucuaccgcgugaagcagggaaugauggauccucaauaucucaaaaaggcucugagacagcgguacggcacccuuacagccgacaaauggaugucucagaagguuaccgcgauugccaagucccugaaagaaguggagcagcucaagugggggcgcggaggccugagcgauacggcuagaaccuuccuucaaaaauuugggauccggcugccguga

SEQ ID NO: 7495 - RNA, 708 nt, Artificial Sequence
  derived and/or modified CDS sequence (opt5) from CHATV(LEIV-17827)__GQ330475.1__N
augagcgaccugguguucuacgaugucgccuccaccggcgcuaacggguuugaccccgaugagggauauauggccuucugcguuaaguacggcgaaucuaucaaucucgcggcugugagaaucuuuuuccugaacgccgccaaagcuaaggccgcucuugcccggaaaccugagaagaaagcgaauccgaaguuuggggaauggcaaguggagauugucaacaaucacuuccccggaaaccgcaauaacccuauuggcaauaacgaccugacaauccauagacucagcggguaucuggcccggugggugcuugaacaguacaaggagaaugaggaugaaucccagcgcgagcugauuaaaacgaccaucaucaaccccauugcugaaucuaauggaguuagaugggagagcggcgccgagguguaucucuccuuuuucccuggcacagaaauguuucuggagaucuucaaguuuuacccccugaccauugggaucuaucgggucaaacagggaaugauggacccucaguaccucaagaaagcucugcgccaaagauacggcacacuuaccgccgauaaguggaugucucagaaggugacagcgauugccaaaagccugaaggaaguugagcagcucaaaugggggcggggaggccuguccgacaccgcucgcacguuccuucagaaguuugggaucagacugccguga

SEQ ID NO: 7496 - RNA, 708 nt, Artificial Sequence
  derived and/or modified CDS sequence (opt5) from CHATV(LEIV-17829)__GQ330476.1__N
augagcgaccugguguucuacgaugucgccuccaccggcgcuaacggguuugaccccgaugagggauauauggccuucugcguuaaguacggcgaaucuaucaaucucgcggcugugagaaucuuuuuccugaacgccgccaaagcuaaggccgcucuugcccggaaaccugagaagaaagcgaauccgaaguuuggggaauggcaaguggagauugucaacaaucacuuccccggaaaccgcaauaacccuauuggcaauaacgaccugacaauccauagacucagcggguaucuggcccggugggugcuugaacaguacaaggagaaugaggaugaaucccagcgcgagcugauuaaaacgaccaucaucaaccccauugcugaaucuaauggaguuagaugggacagcggcgccgagguguaucucuccuuuuucccuggcacagagauguuucuggaaaucuucaaguuuuacccccugaccauugggaucuaucgggucaaacagggaaugauggauccucaguaccucaagaaagcucugcgccaaagauacggcacacuuaccgccgacaaguggaugucucagaaggugacagcgauugccaaaagccugaaggagguugaacagcucaaaugggggcggggaggccuguccgauaccgcucgcacguuccuucagaaguuugggaucagacugccguga

SEQ ID NO: 7497 - RNA, 708 nt, Artificial Sequence
  derived and/or modified CDS sequence (opt5) from CHATV(LEIV-18733)__HQ734824.1__N
augagcgaccugguguucuacgaugucgccuccaccggcgcuaacggguuugaccccgaugagggauauauggccuucugcguuaaguacggcgaaucuaucaaucucgcggcugugagaaucuuuuuccugaacgccgccaaagcuaaggccgcucuugcccggaaaccugagaagaaagcgaauccgaaguuuggggaauggcaaguggagauuauuaacaaucacuuccccggaaaccgcaauaacccuaucggcaauaacgaccugacaauucauagacucagcggguaucuggcccgguggguccuugaacaguacaaggagaaugaggaugaaucccagcgcgagcugaucaaaacgaccaucauuaaccccaucgcugaaucuaauggagugagaugggacagcggcgccgagguuuaucucuccuuuuucccuggcacagagauguuucuggaaauuuucaaguuuuacccccugaccaucgggauuuaucgggugaaacagggaaugauggauccucaguaccucaagaaagcucugcgccaaagauacggcacacuuaccgccgacaaguggaugucucagaaggucacagcgaucgccaaaagccugaaggagguggaacagcucaaaugggggcggggaggccuguccgauaccgcucgcacguuccuucagaaguuugggauuagacugccguga

SEQ ID NO: 7498 - RNA, 708 nt, Artificial Sequence
  derived and/or modified CDS sequence (opt5) from CHATV(LEIV-18895)__GQ330482.1__N
augagcgaccugguguucuacgaugucgccuccaccggcgcuaacggguuugaccccgaugagggauauauggccuucugcguuaaguacggcgaaucuaucaaucucgcggcugugagaaucuuuuuccugaacgccgccaaagcuaaggccgcucuugcccggaaaccugagcgcaaggcgaauccgaaauuuggggaauggcaaguggagauugucaacaaucacuuccccggaaacagaaauaacccuauuggcaauaacgaccugacaauccaucggcucagcggguaucuggcccgcugggugcuugaacaguacaaggagaaugaggaugaaucccagagagagcugauuaagacgaccaucaucaaccccauugcugaaucuaauggaguucggugggacagcggcgccgagguguaucucuccuuuuucccuggcacagagauguuucuggaaaucuucaaauuuuacccccugaccauugggaucuaucgcgucaagcagggacucauggauccucaguaccugaaaaaggcucuuagacaacgguacggcacacugaccgccgacaaauggaugucucagaaggugacagcgauugccaagagccucaaagagguugaacagcugaagugggggcgcggaggccuuuccgauaccgcuagaacguuccugcagaaauuugggauccggcucccguga

SEQ ID NO: 7499 - RNA, 708 nt, Artificial Sequence
  derived and/or modified CDS sequence (opt5) from CHATV(LEIV-22712)__HQ734825.1__N
augagcgaccugguguucuacgaugucgccuccaccggcgcuaacggguuugaccccgaugagggauauauggccuucugcguuaagcacggcgaaucuaucaaucucgcggcugugagaaucuuuuuccugaacgccgccaaagcuaaggccgcucuugcccggaaaccugagaagaaagcgagcccgaaguuuggggaauggcaaguggagauuauuaauaaccauuuccccggaaaucgcaacaauccuaucggcaacaaugaccugacaauucacagacucuccggguaccuggcccgguggguccuugaacaguauaaggagaacgaggaugaaucucagcgcgagcugaucaaaacgaccgugaucaaucccauugcugaaagcaacggaguuagaugggacuccggcgccgagaucuaccucagcuuuuucccuggcacagagauguuucuggaaaccuucaaguuuuauccccugacaauugggaucuaccgggugaaacagggaaugauggauccucaguaucucaagaaagcucugcgccaaagauacggcacccuuacagccgacaaguggaugucucagaaggucaccgcgauugccaaaucccugaaggagguggaacagcucaaaugggggcggggaggccugagcgauacggcucgcaccuuccuucagaaguuugggaucagacugccguga

SEQ ID NO: 7500 - RNA, 708 nt, Artificial Sequence
  derived and/or modified CDS sequence (opt5) from CHATV(LEIV-23500)__EU479701.1__N
augagcgaccugguguucuacgaugucgccuccaccggcgcuaacggguuugaccccgaugccggauauauggcguucugcguuaagcacggcgagucuaucaaucucgcugccgugagaaucuuuuuccugaacgccgcuaaagccaaggcugcccuugcgcggaaaccugaaaagaaagccaauccgaaguuuggggaguggcaaguggaaauugucaacaaucauuuccccggaaaccgcaauaacccuauuggcaauaacgaccugacaauccacagacucagcggguaccuggcucggugggugcuugagcaguauaaggaaaaugaggaugagucccagcgcgaacugauuaaaacgaccguuaucaaccccaucgccgagucuaauggagugagaugggaaaacggcgcugaggucuaccucagcuuuuucccuggcacagagauguuucuggaaaccuucaaguuuuauccccugacaauugggaucuaccgggugaaacagggaaugauggacccucaguaucucaagaaagcccugcgccaaagauacggcacccuuacagcggauaaguggaugucccagaagguuaccgccauugcuaaaucucugaaggagguggaacagcucaaaugggggcggggaggccugagcgacacggcccgcaccuuccuucagaaguuugggaucagacugccguga

SEQ ID NO: 7501 - RNA, 708 nt, Artificial Sequence
  derived and/or modified CDS sequence (opt5) from INKV__Z68496.1__N
augggcgaccugguguucuacgaugaggccagcaccggggcuaacggauuugaccccgaugccggcuucgucgcguuuauggcugaccacggggaauccaucaaucucgccgccguuagaauuuucuuucugaacgcugccaaggcuaaagccgcgcuugcccggaagccugagcgcaaagcuacaccgaaguucggagaauggcaaguggagaucgugaauaaccauuuucccggcaauagaaacaauccuauugggaacaaugaucugacgauccaccggcucucuggauaucuggcccgcuggguccuugaacauuucaccgaggacgaugacgagagccagagagaacugauucgguccacaaucaucaaccccauugcugagucuaauggcauccacuggaacaauggcccugaaauuuaccucagcuuuuuccccgggaccgagauguuucuggagguguucaaauuuuauccucugacaaucggaauuuaccgcguuaagcauggcaugauggauccgcaguaucucaagaaagcccugagacagcgguacgggacccuuacagcggaaaaguggauggcccagaaaaccgugcugaucgcuaagucccucaaagacgucgagcaacugaaguggggacgcggcgggcuuucugaugccgcuagaacguuccugauuaaguucggagugaaacuccccuga

SEQ ID NO: 7502 - RNA, 708 nt, Artificial Sequence
  derived and/or modified CDS sequence (opt5) from INKV(KN3641)__U47137.1__N
augggcgaccugguguucuacgaugucgccagcaccggggcuaacggauuugaccccgaugccggcuucguugcguuuauggcugaccacggggaguccaucaaucucgccgccgugagaauuuucuuucugaacgcugccaaggcuaaagccgcgcuugcccggaagccugaacgcaaagcuacaccgaaguucggagaguggcaaguggaaaucgucaauaaccauuuucccggcaauagaaacaauccuauugggaacaaugaucugacgauccaccggcucucuggauaucuggcccgcugggugcuugagcauuucaccgaagacgaugacgagagccagagagagcugauucgguccacaaucaucaaccccauugcugaaucuaauggcauccacuggaacaauggcccugagauuuaccucagcuuuuuccccgggaccgaaauguuucuggagguuuucaaauuuuauccucugacaaucggaauuuaccgcgugaagcauggcaugauggauccgcaguaucucaagaaagcccugagacagcgguacgggacccuuacagcggagaaguggauggcccagaaaaccguccugaucgcuaagucccucaaagacguggaacaacugaaguggggacgcggcgggcuuucugaugccgcuagaacguuccugauuaaguucggaguuaaacuccccuga

SEQ ID NO: 7503 - RNA, 708 nt, Artificial Sequence
  derived and/or modified CDS sequence (opt5) from INKV(Lovanger)__KU302751.1__N
augggcgaccugguguucuacgaugucgccagcaccggggcuaacggauuugaccccgaugccggcuucguugcguuuauggcugaccacggggaguccaucaaucucgccgccgugagaauuuucuuucugaacgcugccaaggcuaaagccgcgcuugcccggaagccugaacgcaaagcuacaccgaaguucggagaguggcaaguggaaaucgucaauaaccauuuucccggcaauagaaacaauccuauugggaacaaugaucugacgauccaccggcucucuggauaucuggcccgcugggugcuugagcauuucaccgaagacgaugacgagagccagagagagcugauucgguccacaaucaucaaccccauugcugaaucuaauggcauccacuggaacaauggcccugagauuuaccucagcuuuuuccccgggaccgaaauguuucuggagguuuucaaauuuuauccucugacaaucggaauuuaccgcgugaagcauggcaugauggauccgcaguaucucaagaaagcccugagacagcgguacgggacccuuacagcggagaaguggaugacccagaaaacgguccugaucgccaagucccucaaagacguggaacaacugaaguggggacgcggcgggcuuucugaugcugccagaaccuuccugauuaaguucggaguuaaacuccccuga

SEQ ID NO: 7504 - RNA, 708 nt, Artificial Sequence
  derived and/or modified CDS sequence (opt5) from INKV(SW AR 83-161)__U47138.1__N
augggcgaccugguguucuacgaugucgccagcaccggggcuaacggauuugaccccgaugccggcuucguugcguuuauggcugaccacggggaguccaucaaucucgccgccgugagaauuuucuuucugaacgcugccaaggcuaaagccgcgcuugcccggaagccugaacgcaaagcuacaccgaaguucggagaguggcaaguggaaaucgucaauaaccauuuucccggcaauagaaacaauccuauugggaacaaugaucugacgauccaccggcucucuggauaucuggcccgcugggugcuugagcauuucaccgaagacgaugacgagagccagagagagcugauucgguccacaaucaucaaccccauugcugaaucuaauggcauccacuggaacaauggcccugagauuuaccucagcuuucugcccgggaccgaaauguuccuggagguuuuuaaauucuauccucucacaaucggaauuuaccgcgugaagcauggcaugauggauccgcaguaucugaagaaagcccuuagacagcgguacgggacccugacagcggagaaguggauggcccagaaaaccguccucaucgcuaagucccugaaagacguggaacaacuuaaguggggacgcggcgggcugucugaugccgcuagaacguuucucauuaaguucggaguuaaacugcccuga

SEQ ID NO: 7505 - RNA, 708 nt, Artificial Sequence
  derived and/or modified CDS sequence (opt5) from LUMV__X73468.1__N
augagcgaccugguguucuacgaugucgccuccaccggcgcuaacggguuugaccccgaugccggauauguugacuucugcgugaagcacggcgagucuaucaaucuccauagcgugagaaucuuuuuccugaacgcggcuaaagccaaggccgcucuugcccggaaaccugaacgcaaggcuuccccgaaauuuggggaguggcaggucgaaauugugaauaaccacuuccccggaaauagaaacaauccuauugauaacaaugaccugacaauccaucggcucucuggcuaccuggcccgcuggguucuugagcaauuuaaggaaaacgaggaugcggcccagagagagcugauuaagacgaccgugaucaaucccaucgcugaaagcaacgggauucggugggacaauggagccgagaucuaucucgcuuucuuuccuggcacagaaauguuccuggagaccuuuaacuucuacccccugacaauuggcaucuaucgcgucaaacacgggaugauggauccucaguaccucaagaaagcccugagacggcgcuauggaucccuuaccgcggacaaguggaugucucagaaaacaguggccauugcuaagagccugaaggauguugagcaacucaaauggggcagagggggacuguccgacaccgcccggguguuucuucagaaguucggcaucaaacugccguga

SEQ ID NO: 7506 - RNA, 708 nt, Artificial Sequence
  derived and/or modified CDS sequence (opt5) from LUMV(SAAr 1881)__KX817326.1__N
augagcgaccugguguucuacgaugucgccuccaccggcgcuaacggguuugaccccgaugccggauauguugacuucugcgugaagcacggcgagucuaucaaucuccauagcgugagaaucuuuuuccugaacgcggcuaaagccaaggccgcucuugcccggaaaccugaacgcaaggcuuccccgaaauuuggggaguggcaggucgaaauugugaauaaccacuuccccggaaauagaaacaauccuauugauaacaaugaccugacaauccaucggcucucuggcuaccuggcccgcuggguucuugagcaauuuaaggaaaacgaggaugcggcccagagagagcugauuaagacgaccgugaucaaucccaucgcugaaagcaacgggauucggugggacaauggagccgagaucuaucucgcuuucuuuccuggcacagaaauguuccuggagaccuuuaacuucuacccccugacaauuggcaucuaucgcgucaaacacgggaugauggauccucaguaccucaagaaagcccugagacagcgguauggaucccuuaccgcggacaaguggaugucucagaaaacaguggccauugcuaagagccugaaggauguugagcaacucaaauggggccgcgggggacuguccgacaccgccagaguguuucuucagaaguucggcaucaaacugccguga

SEQ ID NO: 7507 - RNA, 708 nt, Artificial Sequence
  derived and/or modified CDS sequence (opt5) from MELV(TRVL 9375)__KX817329.1__N
augggcgaccugaucuucuacgauguggccagcaccggggcuaacggauuugaccccgaugccggcuaucucgcguucacaauugcucacggggaggccaucaaucuguccgccgucagaaucuuuuuccuuaacgcugccaaggcuaaagccgcgcugucucggaagccugaacgcaaagccacgccgaaguuuggagacuggcagguugagauugugaauaaccauuuccccggcaauagaaacaauccuauugggaacaaugaucucaccauccaccggcugagcggauaccuugcucgcugggugcuggaccucuuuaaagaaaacgaggaugaaucccaaaaggagcugauccagucuacaauuaucaaucccauugccgagagcaacggcauccauugggcuaauggcgucgaaauuuaucuguccuucuuuccugggaccgagauguuccucgaagccuuuagauucuacccccugacaaucggaauuuaucgggugaagcacggccuuauggacccucaguaccugaaaaaggcgcuccgccagagauaugggacccugacagccgauaaauggauggcucaaaagaccacgaugaucgccaaaucucuuaaggacguugagcagcugaaguggggaaaaggcgggcucagcgaugcugcccggaccuuucugcagaaguucggagugcgccugccguga

SEQ ID NO: 7508 - RNA, 708 nt, Artificial Sequence
  derived and/or modified CDS sequence (opt5) from MBV__U31989.1__N
augagcgaccugguguucuacgaugucgccuccaccggcgcuaacggguuugaccccgaugccggauauguugacuucugcgcgaagcacggcgagucuaucaaucucgcugccgugagaaucuuuuuccugaacgccgcuaaagccaaggcugcccuuagccggaaaccugaacgcaaggcgaauccgaaauuuggggaguggcaaguggaaauugucaacaaucauuuccccgccaacagaaauaacccuauuggaaauaacgaucugacaauccaccggauuuccggcuaccucgcucgcugggugcuggagcaauauagagaaaaugaggacgagucucagcgggaacuuguuaagacgaccgugaucaaccccaucgccgagagcaaugggauucgcugggaaaacggaccugagaucuaccuggccuuuuuccccggcacagagauguuucucgaaaccuucaaguuuuauccucugacaauuggcaucuacagagucaaacaugggaugauggauccgcaguaucugaagaaagcucuccggcagcgcuacggaucccugaccgcggagaaguggaugucucagaaaacaggcaugauugccaagagccuuaaggaaguggagcagcugaaaugggggagaggaggccucuccgacaccgcucggacguuccugcagaaguuugggauccgccuucccuga

SEQ ID NO: 7509 - RNA, 708 nt, Artificial Sequence
  derived and/or modified CDS sequence (opt5) from SAV(VR723)__U47139.1__N
augagcgagcugguguucuacgacgucgccuccaccggcgcuaacggguuugaucccgacgccggauaucucgcguucugcguuaagcacggcgaaucuaucagccuguccucugugagaaucuuuuuccuuaaugcugccaaagccaaggcugcccugagccggaaaccugagcgcaaggcuaacccgaaauuuggggaauggcaaguggagauugucaauaaccauuuccccggaaauagaaacaauccuauugauaaccucgaccugacaauccaccggcuuuccggcuaccuggcccgcugggugcucgaacaguuuauugagaaugaggaugaaucucagagagagcugaucaagacgaccguuaucaaccccauugcggaaagcaaugggaucaagugggagaacggagccgagauuuaucuguccuucuuuccuggcacagaaauguuccucgagaucuuuaaauucuacccccugaccauuggcaucuaucgggugaagcaggggaugauggacccucaguaccuuaaaaaggcucugcgccaaagauauggaagccucacagccgauaaauggaugucucagaaggucggcgcuauugccaagucccugaaagacaucgaacagcuuaagugggggaaaggaggccugagcgauaccgcgcggacauuucuccagaaguucgggaucaaacugccguga

SEQ ID NO: 7510 - RNA, 708 nt, Artificial Sequence
  derived and/or modified CDS sequence (opt5) from SDNV(BeAr 103645)__U47140.1__N
augggcgaccugguguucuacgaugucgccagcaccggggcuaacggauuugaccccgaugccggcuucguugcguuuauggcugggcacggagaguccaucaaucucacagccgugagaauuuucuuucugaacgccgcuaaggccaaagcugcccuuucucggaagccugaacgcaaagcgacgccgaaguucggcgacuggcaaguggagaucgucaauaaccauuuucccgggaauagaaacaauccuauuggaaacaaugaucugaccauccaccggauuagcggcuaucucgcccgcuggacacuggaacauuucagagagggcggggacgaagcucagaaagagcuuauccggaccacaaucauuaaccccaucgccgaguccaauggcauucacugggcuaacggagccgaaaucuaccugagcuuuuucccugggaccgagauguuucucgaagcguucaaguuuuauccccugacaauuggaaucuaccgcgugaagcauggcaugauggaugcccaguaucugaaaaaggcucucagacagcgguacgggacccugacggccgacgaguggauggcucagaaaaccguucuuauuacaaagucucugaaagauguggagcaacucaaguggggacgcggcggccuguccgacgccgccagaaccuuccuuucuaaguucggggucaaacugccuuga

SEQ ID NO: 7511 - RNA, 708 nt, Artificial Sequence
  derived and/or modified CDS sequence (opt5) from SDNV(BeAr 103645)__KX817335.1__N
augggcgaccugguguucuacgaugucgccagcaccggggcuaacggauuugaccccgaugccggcuucguugcguuuauggcugggcacggagaguccaucaaucucacagccgugagaauuuucuuucugaacgccgcuaaggccaaagcugcccuuucucggaagccugaacgcaaagcgacgccgaaguucggcgacuggcaaguggagaucgucaauaaccauuuucccgggaauagaaacaauccuauuggaaacaaugaucugaccauccaccggauuagcggcuaucucgcccgcuggacacuggaacauuucagagagggcgaagacgaggcucagaaagagcuuauccggaccacaaucauuaaccccaucgccgaauccaaugggauucacugggcuaacggagccgagaucuaccugagcuuuuucccuggcaccgaaauguuucucgaggcguucaaguuuuauccccugacaauugggaucuaccgcgugaagcauggaaugauggaugcccaguaucugaaaaaggcucucagacagcgguacggcacccugacggccgacaaauggauggcucagaagaccguucuuauuacaaaaucucugaaggauguggagcaacucaagugggggcgcggaggccuguccgacgccgccagaaccuuccuuucuaaauucggcgucaagcugccuuga

SEQ ID NO: 7512 - RNA, 708 nt, Artificial Sequence
  derived and/or modified CDS sequence (opt5) from SSHV__EU294510.1__N
augagcgaccugguguucuacgaugucgccuccaccggcgcuaacggguuugaccccgaugccggauauauggcguucugcguuaaguacgcugagucugugaaucucgccgccgugagaaucuuuuuccugaacgcugccaaagcuaaggccgcgcuuagccggaaaccugaacgcaaggccaauccgaaauuuggcgaguggcaggucgaagugguuaacaaucacuuccccgggaacagaaauaacccuauuaauuccgacgaucugacaauccaucggcucucuggauaucuggcucgcugggugcuugagcaauacaaggaaaacgaggacgagagcagacgggaacugauuaagacgaccaucauuaaucccaucgccgaguccaacggcguccgcugggauucuggggcugaaaucuaucucagcuuuuucccuggaacagagauguuucuggagaccuucaaauuuuacccccugacaauuggcaucuauagagugaagcagggcaugauggacccucaguaccucaaaaaggcccugcggcagcgcuacgggucccuuaccgcggauaaauggaugagccaaaagguuacagccauugcuaagucucugaaagaaguggagcagcucaaguggggaagaggcgggcuguccgacaccgcccggagcuuccuucagaaauuuggaauccgccugccguga

SEQ ID NO: 7513 - RNA, 708 nt, Artificial Sequence
  derived and/or modified CDS sequence (opt5) from SSHV(F10838)__KM215563.1__N
augagcgaccugguguucuacgaugucgccuccaccggcgcuaacggguuugaccccgaugccggauauauggcguucugcguuaaguacgcugagucugugaaucucgccgccgugagaaucuuuuuccugaacgcugccaaagcuaaggccgcgcuuagccggaaaccugaacgcaaggccaauccgaaauuuggcgaguggcaggucgaagugguuaacaaucacuuccccgggaacagaaauaacccuauuaauuccgacgaucugacaauccaucggcucucuggauaucuggcucgcugggugcuugagcaauacaaggaaaacgaggacgagagcagacgggaacugauuaagacgaccaucauuaaucccaucgccgaguccaacggcguccgcugggauucuggggcugaaaucuaucucagcuuuuucccuggaacagagauguuucuggagaccuucaaauuuuacccccugacaauuggcaucuauagagugaagcagggcaugauggacccucaguaccucaaaaaggcccugcggcagcgcuacgggucccuuaccgcggauaaauggaugagccaaaagguuacagccauugcuaagucucugaaagaaguggagcagcucaaguggggaagaggcgggcuguccgacaccgcccggagccuucugcagaaauucggaauccgccucccguga

SEQ ID NO: 7514 - RNA, 708 nt, Artificial Sequence
  derived and/or modified CDS sequence (opt5) from SORV(SORV-252)__GU018050.2__N
augggcgaccugguguucuacgaugucgccagcaccggggcuaacggauuugaccccgaugccggcuucguugcguuuauggcugaccacggggaguccaucucucucagcgccgugagaauuuucuuucugaaugccgcuaaggccaaagcugcccuugcgcggaagccugaacgcaaagccaacccgaaguucggagaguggcaaguggaaaucgucaauaaccauuuucccggcaauagaaacaauccuauugggaacaaugaucugacaauccaccggcucuccggauaucuggcucgcugggugcuugagcauuucacggaagacgaggaugagucucagagagaacugauucggagcaccaucaucaaccccauugccgaguccaauggcauccgcuggaacaauggcccugaaauuuaccucagcuuuuuccccgggacagagauguuucuggaggcuuucaaauuuuauccucugaccaucggaauuuacagaguuaagcacggccucauggacccgcaguaucugaagaaagcccuucggcagcgcuacgggacacugaccgcggaaaaguggauggcccagaaaacagugcucaucgcuaagucucugaaagaugucgagcaacuuaaguggggaagaggcgggcuguccgacgccgcucggaccuuccucauuaaguucggagugaaacugcccuga

SEQ ID NO: 7515 - RNA, 708 nt, Artificial Sequence
  derived and/or modified CDS sequence (opt5) from SORV(NJO 94F)__U47141.1__N
augggcgaccugguguucuacgaugucgccagcaccggggcuaacggauuugaccccgaugccggcuucguugcguuuauggcugaccacggggaguccaucaaucucucugccgugagaauuuucuuucugaacgccgcuaaggccaaagcugcccuugcgcggaagccugaacgcaaagccaauccgaaguucggagaguggcaaguggaaaucgucaacaaucauuuucccggcaacagaaauaacccuauugggaauaacgaucugacaauccaccggcucagcggauaucuggcucgcugggugcuugagcauuucacggaagacgaggaugagucccagagagaacugauucggucuaccaucaucaaucccauugccgagagcaacggcauccacuggaauaacggcccugaaauuuaccucuccuuuuuccccgggacagagauguuucuggaggcuuucaaauuuuauccucugaccaucggaauuuaccgcguuaagcauggcaugauggacccgcaguaucucaagaaagcccugagacagcgguacgggacacuuaccgcggaaaaguggauggcccagaaaacagugcugaucgcuaagucucucaaagaugucgagcaacugaaguggggacgcggcgggcuuagcgacgccgcuagaaccuuccugauuaaguucggagugaaacuccccuga

SEQ ID NO: 7516 - RNA, 708 nt, Artificial Sequence
  derived and/or modified CDS sequence (opt5) from SORV(NJO-94F)__KX817338.1__N
augggcgaccugguguucuacgaugucgccagcaccggggcuaacggauuugaccccgaugccggcuucguugcguuuauggcugaccacggggaguccaucaaucucucugccgugagaauuuucuuucugaacgccgcuaaggccaaagcugcccuugcgcggaagccugaacgcaaagccaauccgaaguucggagaguggcaaguggaaaucgucaacaaucauuuucccggcaacagaaauaacccuauugggaauaacgaucugacaauccaccggcucagcggauaucuggcucgcugggugcuugagcauuucacggaagacgaggaugagucccagagagaacugauucggucuaccaucaucaaucccauugccgagagcaacggcauccacuggaauaacggcccugaaauuuaccucuccuuuuuccccgggacagagauguuucuggaggcuuucaaauuuuauccucugaccaucggaauuuaccgcguuaagcauggccucauggacccgcaguaucugaagaaagcccuuagacagcgguacgggacacugaccgcggaaaaguggauggcccagaaaacagugcucaucgcuaagucucugaaagaugucgagcaacuuaaguggggacgcggcgggcugagcgacgccgcuagaaccuuccucauuaaguucggagugaaacugcccuga

SEQ ID NO: 7517 - RNA, 708 nt, Artificial Sequence
  derived and/or modified CDS sequence (opt5) from TAHV__Z68497.1__N
augagcgaccugguguucuacgaugucgccuccaccggcgcuaacggguuugaccccgaugccggauauguugacuucugcaucaagcacggcgaggcgauuaaucuccauucugugagaaucuuuuuccugaacgcugccaaagccaaggcugcccuugcucggaaaccugaacgcaaggccagcccgaaauuuggggaguggcaaguggaagucgugaauuaccacuuccccggaaacagaaauaacccuauugauaauaacgaccugacaauccaucggcucuauggcuaccuggcgcgcuggguucuugagcaguuuaaggaaaaugaggaugccgcucagagagagcugauuaagacgaccgugaucaaccccaucgccgaauccaaugggauucggugggacaacggagcugagaucuaucucgccuucuuuccuggcacagaaauguuccuggagaccuuuaauuucuacccccugacaauuggcaucuaucgcgucaaacaggggaugauggauccucaguaccucaagaaagcgcugagacaacgguacggaucucuuaccgccgacaaguggaugagccagaaaacaaccgcuauugccaagucccugaaggauguggagcagcucaaauggggccgcgggggacugucugacacggcuagaaccuuucuucagaaguucggcauccggcugccguga

SEQ ID NO: 7518 - RNA, 708 nt, Artificial Sequence
  derived and/or modified CDS sequence (opt5) from TAHV(22595-6)__HM036217.1__N
augagcgaccugguguucuacgaugucgccuccaccggcgcuaacggguuugaccccgaugccggauauguugacuucugcaucaagcacggcgaggcgauuaaucuccauucugugagaaucuuuuuccugaacgcugccaaagccaaggcugcccuugcucggaaaccugaacgcaaggccagcccgaaauuuggggaguggcaaguggaagucgugaauaaccacuuccccggaaauagaaacaauccuauugauaacaaugaccugacaauccaucggcucuccggcuaccuggcgcgcuggguucuugagcaguuuaaggaaaacgaggaugccgcucagagagagcugauuaagacgaccgugaucaaucccaucgccgaaucuaacgggauucggugggacaauggagcugagaucuaucucgccuucuuuccuggcacagaaauguuccuggagaccuuuaacuucuacccccugacaauuggcaucuaucgcgucaaacaggggaugauggauccucaguaccucaagaaagcgcugagacaacgguauggaagccuuaccgccgacaaguggaugucccagaaaacaaccgcuauugccaagucucugaaggauguggagcagcucaaauggggccgcgggggacugagcgacacggcuagaaccuuucuucagaaguucggcauccggcugccguga

SEQ ID NO: 7519 - RNA, 708 nt, Artificial Sequence
  derived and/or modified CDS sequence (opt5) from TAHV(NM08003)__HQ541823.1__N
augagcgaccugguguucuacgaugucgccuccaccggcgcuaacggguuugaccccgaugccggauauguugacuucugcaucaagcacggcgaggcgauuaaucuccauucugugagaaucuuuuuccugaacgcugccaaagccaaggcugcccuugcucggaaaccugaacgcaaggccagcccgaaauuuggggaguggcaaguggaagucgugaauaaccacuuccccggaaauagaaacaauccuauugauaacaaugaccugacaauccaucggcucuccggcuaccuggcgcgcuggguucuugagcaguuuaaggaaaacgaugacgccgcucagagagagcugauuaagacgaccgugaucaaucccaucgccgagucuaacgggauucggugggauaauggagcugaaaucuaucucgccuucuuuccuggcacagagauguuccuggaaaccuuuaacuucuacccccugacaauuggcaucuaucgcgucaaacaggggaugauggacccucaguaccucaagaaagcgcugagacaacgguauggaagccuuaccgccgauaaguggaugucccagaaaacaaccgcuauugccaagucucugaaggacguggagcagcucaaauggggccgcgggggacugagcgauacggcuagaaccuuucuucagaaguucggcauccggcugccguga

SEQ ID NO: 7520 - RNA, 708 nt, Artificial Sequence
  derived and/or modified CDS sequence (opt5) from TAHV(XJ0625)__EU622820.2__N
augagcgaccugguguucuacgaugucgccuccaccggcgcuaacggguuugaccccgaugccggauauguugacuucugcgugaaguacggcgaggcgaucaaucuccacucugugagaaucuuuuuccugaacgcugccaaagccaaggcugcccuugcucggaaaccugaacgcaaggccagcccgaaauuuggggaguggcaggucgaagugguuaauaaccauuuccccggaaauagaaacaauccuauugauaacaaugaccugacaauucaccggcucuccggcuaucuggcgcgcugggugcuugagcaauuuaaggaaaacgaggaugccgcucagagagagcugaucaagacgaccgucauuaaucccaucgccgaaucuaacgggauccggugggacaauggagcugagauuuaccucgccuucuuuccuggcacagaaauguuccuggagaccuuuaacuucuauccccugacaaucggcauuuaccgcgugaaacaggggaugauggauccucaguaucucaagaaagcgcugagacaacgguacggaccgcuuaccgccgacaaguggaugagccagaaaacaguugcuaucgccaagucccugaaggauguggagcagcucaaauggggccgcgggggacugucugacaccgcuagaacguuucuucagaaguucggcauucggcugcccuga

SEQ ID NO: 7521 - RNA, 708 nt, Artificial Sequence
  derived and/or modified CDS sequence (opt5) from TAHV(XJ0708)__HM243139.1__N
augagcgaccugguguucuacgaugucgccuccaccggcgcuaacggguuugaccccgaugccggauauguugacuucugcgcgaaguacggcgaggcuaucaaucuccacucugugagaaucuuuuuccugaacgccgccaaagcuaaggccgcucuugcccggaaaccugaacgcaaggcgagcccgaaauuuggggaguggcaaguggaagucgugaauaaccauuuccccggaaauagaaacaauccuauugauaacaaugaccugacaauucaccggcucuccggcuaucuggcccgcuggguucuugagcaguuuaaggaaaacgaggaugcugcccagagagagcugaucaagacgaccgugauuaaucccaucgcugaaucuaacgggauccggugggacaauggagccgagauuuaccucgcguucuuuccuggcacagaaauguuccuggagaccuuuaacuucuauccccugacaaucggcauuuaccgcgucaaacaggggaugauggauccucaguaucucaagaaagcccugagacaacgguacggaccgcuuaccgcugacaaguggaugagccagaaaacaguggccaucgcuaagucccugaaggauguugagcagcucaaauggggccgcgggggacugucugacaccgccagaacguuucuucagaaguucggcauucggcugcccuga

SEQ ID NO: 7522 - RNA, 708 nt, Artificial Sequence
  derived and/or modified CDS sequence (opt5) from TVTV(AR42)__KX891323.1__N
augagcgagcugguguucuacgacgcccccuccaccggcgcuaacggguuugauccugacgccggauaugucgcguucaucgcugcccacgccggcucuuacgaucucagcgcuguuagaaucuuuuuccugaaugccgcuaaggccaaaaacgcgcuuucccggaagccggaagggaaagugucuauuaaguuuggagaguggagcguggaagucgugaauaaccauuuccccggcaaucgcaacaauccuauugggaacaaugaccugacaauccacagaauuuccggauaucucgcccgguggguucuggaggaauuuaaaggccaggaugacgaggcucaaaaggauaucauccgcucuacgauugugaaccccaucgccgagagcaauggcauucauugggacuccggggcugaugccuaccuuagcuucuuuccuggaaccgaaauguuccuggagucuuuugacuuccucccccuggcgaucggcauuuauagagucaagaacgggaugauggaugugcaguaccugaaaaaggcccuccggcagcgcuauggaacaaugaccgcugacaaauggauguccacaaagaccacaguuaucgccaaaacccugaagagaguggagagcuuuaaguggggcaaagggggacuuucugaagcugcccgggccuuccuguccaaguucaaugucaaaauuccuuga

SEQ ID NO: 7523 - RNA, 708 nt, Artificial Sequence
  derived and/or modified CDS sequence (opt5) from TVTV(ND3374)__KM215564.1__N
augagcgagcugguguucuacgacgcccccuccaccggcgcuaacggguuugauccugacgccggauaugucgcguucaucgcugcccacgccggcucuuacgaucucagcgcuguuagaaucuuuuuccugaaugccgcuaaggccaaaaacgcgcuuucccggcgcccggaagggaaggugucuauuaaauuuggagaguggagcguggaagucgugaauaaccauuuccccggcaauagaaacaauccuauugggaacaaugaccugacaauccaccggauuuccggauaucucgcccgcuggguucuggaggaauuuaagggccaggaugacgaggcucaaaaagauaucaucagaucuacgauugugaaccccaucgccgagagcaauggcauucauugggacuccggggcugaugccuaccuuagcuucuuuccuggaaccgaaauguuccuggagucuuuugacuuccucccccuggcgaucggcauuuaucgggucaagaacgggaugauggaugugcaguaccugaagaaagcccuccgccagagauauggaacaaugaccgcugacaaguggauguccacaaaaaccacaguuaucgccaagacccugaaacggguggagagcuuuaaguggggcaaagggggacuuucugaagcugcccgcgccuuccuguccaaguucaaugucaagauuccuuga

SEQ ID NO: 7524 - RNA, 708 nt, Artificial Sequence
  derived and/or modified CDS sequence (opt5) from JCV(3324-04)__HM007356.1__N
augggcgaccugguguucuacgaugucgccagcaccggggcuaacggauuugaccccgaugccggcuucguugcguuuauggcugaccacggggaguccgugucucucagcgccgugagaaucuucuuucugaaugccgcuaaggccaaagcugcccuugcgcggaagccugaacgcaaagccacaccgaaguucggagaguggcaggucgaaauugugaacaaucauuuucccggcaacagaaauaacccuaucgggaauaacgaucugacgauucaccggcucuccggauaucuggcucgcuggguucuugagcauuucaccacagacgaugacgaaucucaaagagagcugauccggagcaccauuaucaaucccaucgccgaguccaacggcauucacuggaauaacggcccugaaaucuaccucagcuuuuuccccgggacagagauguuucuggaaauuuucaaauuuuauccucugaccaucggaauuuaccgcgugaagcauggcaugauggauccgcaguaucucaagaaagcucugagacagcgguacgggacacuuaccgccgagaaguggauggcgcagaaaacgguccugaucgccaagucucucaaagacguggagcaacugaaguggggacgcggcgggcuuuccgaugcugccagaaccuuccugauuaaguucggaguuaaacuccccuga

SEQ ID NO: 7525 - RNA, 708 nt, Artificial Sequence
  derived and/or modified CDS sequence (opt5) from JCV(61v2235)__U12796.1__N
augggcgaccugguguucuacgaugucgccagcaccggggcuaacggauuugaccccgaugccggcuucguugcguuuauggcugaccacggggaguccaucaaucucucugccgugagaauuuucuuucugaacgccgcuaaggccaaagcugcccuugcgcggaagccugaacgcaaagccacaccgaaguucggagaguggcaaguggaaaucgucaauaaccauuuuagcggcaauagaaacaaucccauugggaacaaugaucugacgauccaccggcucuccggauaucuggcucgcugggugcuugagcauuucaacucugacgaugacgaaagccagagagagcugauucgguccaccaucaucaauccuauugccgagucuaacggcauccacuggaauaacggccccgaaauuuaccucagcuuuuucccugggacagagauguuucuggaaaucuucaaauuuuauccccugaccauuggaaucuaccgcguuaagcauggcaugauggauccucaguaucucaagaaagcucugagacagcgguacgggacacuuaccgccgagaaguggauggcgcagaaaacagugcugauugccaagucccucaaagacgucgagcaacugaaguggggacgcggcgggcuuagcgaugcugccagaaccuuccugaucaaguucggagugaaacucccguga

SEQ ID NO: 7526 - RNA, 708 nt, Artificial Sequence
  derived and/or modified CDS sequence (opt5) from JCV(1064-03)__EF681816.1__N
augggcgaccugguguucuacgaugucgccagcaccggggcuaacggauuugaccccgaugccggcuucguugcguuuauggcugaccacggggaggccaucaaucucgccgcugugagaauuuucuuucugaacgccgcuaaggccaaagcggcccuugcucggaagccugaacgcaaagccacaccgaaguucggagaguggcaaguggaaaucgucaauaaccauuuucccggcaauagaaacaauccuauugggaacaaugaucugacgauccaccggcucuccggauaucuggcucgcugggugcuugagcauuucaccgaagacgaugacgagucucagagagagcugauucggagcacaaucaucaaccccauugccgaauccaauggcauccacuggaacaauggcccugagauuuaccucagcuuuuuccccgggaccgaaauguuucuggagguuuucaaauuuuauccucugacaaucggaauuuaccgcgugaagcauggcaugauggauccgcaguaucucaagaaagcgcugagacagcgguacgggacccuuacagccgagaaguggauggcucagaaaaccguccugaucgccaagucucucaaagacguggaacaacugaaguggggacgcggcgggcuuuccgaugcugccagaacguuccugauuaaguucggaguuaaacuccccuga

SEQ ID NO: 7527 - RNA, 708 nt, Artificial Sequence
  derived and/or modified CDS sequence (opt5) from JCV(33909)__EF681853.1__N
augggcgaccugguguucuacgaugucgccagcaccggggcuaacggauuugaccccgaugccggcuucguugcguuuauggcugaccacggggaggugaucaaucucgccgccgugagaauuuucuuucugaacgcugccaaggcuaaagccgcgcuugcccggaagccugaacgcaaagcuacaccgaaguucggagaguggcaggucgaaaucgugaauaaccauuuucccggcaauagaaacaauccuauugggaacaaugaucugacgauccaccggcucuccggauaucuggcccgcuggguucuugagcauuucaccgaagacgaugacgagucucaaagagagcugauucggagcacaaucaucaaccccauugcugaauccaauggcauccacuggaacaauggcccugagauuuaccucagcuuuuuccccgggaccgaaauguuucuggagguguucaaauuuuauccucugacaaucggaauuuaccgcgucaagcauggcaugauggauccgcaguaucucaagaaagcccugagacagcgguacgggacccuuacagcggagaaguggauggcccagaaaaccgugcugaucgcuaagucucucaaagacguugaacaacugaaguggggacgcggcgggcuuuccgaugccgcuagaacguuccugauuaaguucggagugaaacuccccuga

SEQ ID NO: 7528 - RNA, 708 nt, Artificial Sequence
  derived and/or modified CDS sequence (opt5) from JCV(2179-00)__EF681808.1__N
augggcgaccugguguucuacgaugucgccagcaccggggcuaacggauuugaccccgaugccggcuucguugcguuuauggcugaccacggggaguccgugucucucagcgccgugagaaucuucuuucugaaugccgcuaaggccaaagcugcccuugcgcggaagccugaacgcaaagccacaccgaaguucggagaguggcaggucgaaauugugaacaaucauuuucccggcaacagaaauaacccuaucgggaauaacgaucugacgauucaccggcucuccggauaucuggcucgcuggguucuugagcauuucaccacagacgaugacgaaucucaaagagagcugauccggagcaccauuaucaaucccaucgccgaguccaacggcauucacuggaauaacggcccugaaaucuaccucagcuuuuuccccgggacagagauguuucuggaaauuuucaaauuuuauccucugaccaucggaauuuaccgcgugaagcauggcaugauggauccgcaguaucucaagaaagcucugagacagcgguacgggauccuuacagccgagaaguggauggcgcagaaaaccguccugauugccaagucucucaaagacguggagcaacugaaguggggacgcggcgggcuuuccgaugcugccagaacguuccugaucaaguucggaguuaaacuccccuga

SEQ ID NO: 7529 - RNA, 708 nt, Artificial Sequence
  derived and/or modified CDS sequence (opt5) from JCV(2989-06)__EF681849.1__N
augggcgaccugaucuucuacgauguggccagcaccggggcuaacggauuugaccccgaugccggcuucgucgcguuuauggcugaccacggggaguccguuucucucagcgccgugagaauuuucuuucugaaugccgcuaaggccaaagcugcccuugcgcggaagccugaacgcaaagccacaccgaaguucggagaguggcaaguggaaaucgucaacaaucauuuucccggcaacagaaauaacccuauugggaauaacgaucugacgauccaccggcucuccggauaucuggcucgcugggugcuugagcauuucaccacagacgaugacgaaucucagagagagcugauucggagcaccaucaucaaucccauugccgaguccaacggcauccacuggaauaacggcccugaaauuuaccucagcuuuuuccccgggacagagauguuucuggaaaucuucaaauuuuauccucugaccauuggaaucuaccgcguuaagcauggcaugauggauccgcaguaucucaagaaagcucugagacagcgguacgggacacuuaccgccgagaaguggauggcgcagaaaacggugcugauugccaagucucucaaagacgucgagcaacugaaguggggacgcggcgggcuuuccgaugcugccagaaccuuccugaucaaguucggagugaaacuccccuga

SEQ ID NO: 7530 - RNA, 708 nt, Artificial Sequence
  derived and/or modified CDS sequence (opt5) from JCV(5592-02)__EF681804.1__N
augggcgaccugguguucuacgaugucgccagcaccggggcuaacggauuugaccccgaugccggcuucguugcguuuauggcugaccacggggaguccgugucucucagcgccgugagaaucuucuuucugaaugccgcuaaggccaaagcugcccuugcgcggaagccugaacgcaaagccacaccgaaguucggagaguggcaggucgaaauugugaacaaucauuuucccggcaacagaaauuccccuaucgggaacaaugaucugacgauucaccggcucucuggauaucuggcucgcuggguucuugagcauuucaccacagacgaugacgaaagccaaagagagcugauccgguccaccauuaucaaccccaucgccgagucuaauggcauucacuggaacaauggcccugaaaucuaccucagcuuuuuccccgggacagagauguuucuggaaauuuucaaauuuuauccucugaccaucggaauuuaccgcgugaagcauggcaugauggauccgcaguaucucaagaaagcucugagacagcgguacgggacacuuaccgccgagaaguggauggcgcagaaaacgguccugaucgccaagucccucaaagacguggagcaacugaaguggggacgcggcgggcuuagcgaugcugccagaaccuuccugauuaaguucggaguuaaacuccccuga

SEQ ID NO: 7531 - RNA, 708 nt, Artificial Sequence
  derived and/or modified CDS sequence (opt5) from JCV(F5609)__KM215546.1__N
augggcgaccugguguucuacgaugucgccagcaccggggcuaacggauuugaccccgaugccggcuucguugcguuuauggcugaccacggggaguccgugucucucagcgccgugagaaucuucuuucugaaugccgcuaaggccaaagcugcccuugcgcggaagccugaacgcaaagccacaccgaaguucggagaguggcaggucgaaauugugaacaaucauuuucccggcaacagaaauaacccuaucgggaauaacgaucugacgauucaccggcucuccggauaucuggcucgcuggguucuugagcauuucaccacagacgaugacgaaucucaaagagagcugauccggagcaccauuaucaaucccaucgccgaguccaacggcauucacuggaauaacggcccugaaaucuaccucagcuuuuuccccgggacagagauguuucuggaaauuuucaaauuuuauccucugaccaucggaauuuaccgcgugaagcauggcaugauggauccgcaguaucucaagaaagcucugagacagcgguacgggacacuuaccgccgagaaguggauggcgcagaaaacgguccugaucgccaagucucucaaagacguggagcaacugaaguggggacgcggcgggcuuuccgaugcugccagaaccuuccugacaaaguucggaguuaaacuccccuga

SEQ ID NO: 7532 - RNA, 708 nt, Artificial Sequence
  derived and/or modified CDS sequence (opt5) from JCV(F6577)__KM215557.1__N
augggcgaccugguguucuacgaugucgccagcaccggggcuaacggauuugaccccgaugccggcuucguugcguuuauggcugaccacggggaguccgugucucucagcgccgugagaaucuucuuucugaaugccgcuaaggccaaagcugcccuuucccggaagccugaacgcaaagcgacaccgaaguucggagaguggcaggucgaaauugugaacaaucauuuucccggcaacagaaauaacccuaucgggaauaacgaucugacgauucaccggcucucuggauaucuggcccgcuggguucuugagcauuucaccacagacgaugacgaaagccaaagagagcugauccgguccaccauuaucaaucccaucgcugagucuaacggcauucacuggaauaacggcccugaaaucuaccucagcuuuuuccccgggacagagauguuucuggaaauuuucaaauuuuauccucugaccaucggaauuuaccgcgugaagcauggcaugauggauccgcaguaucucaagaaagcccugagacagcgguacgggacacuuaccgcugagaaguggauggcccagaaaacgguccugaucgcgaagucccucaaagacguggagcaacugaaguggggacgcggcgggcuuagcgaugccgcuagaaccuuccugauuaaguucggaguuaaacuccccuga

SEQ ID NO: 7533 - RNA, 708 nt, Artificial Sequence
  derived and/or modified CDS sequence (opt5) from JCV(W13135)__KM215552.1__N
augggcgaccugguguucuacgaugucgccagcaccggggcuaacggauuugaccccgaugccggcuucguugcguuuauggcugaccacggggaguccgugaaucucucugccgugagaaucuucuuucugaacgccgcuaaggccaaagcugcccuugcgcggaagccugaacgcaaagccacaccgaaguucggagaguggcaggucgaaauugugaauaaccauuuucccggcaauagaaacaauccuaucgggaacaaugaucugacgauucaccggcucagcggauaucuggcucgcuggguucuugagcauuucaccacagacgaugacgaaucccaaagagagcugauccggucuaccauuaucaaccccaucgccgagagcaauggcauucacuggaacaauggcccugaaaucuaccucuccuuuuuccccgggacagagauguuucuggaaauuuucaaauuuuauccucugaccaucggaauuuaccgcgugaagcauggcaugauggauccgcaguaucucaagaaagcucugagacagcgguacgggacacuuaccgccgagaaguggauggcgcagaaaacgguccugaucgccaagucucucaaagacguggagcaacugaaguggggacgcggcgggcuuagcgaugcugccagaaccuuccugauuaaguucggaguuaaacuccccuga

SEQ ID NO: 7534 - RNA, 708 nt, Artificial Sequence
  derived and/or modified CDS sequence (opt5) from JCV(W18393)__KM215559.1__N
augggcgaccugguguucuacgaugucgccagcaccggggcuaacggauuugaccccgaugccggcuucguugcguuuauggcugaccacggggaguccaucaaucucucugccgugagaauuuucuuucugaacgccgcuaaggccaaagcugcccuugcgcggaagccugaacgcaaagccacaccgaaguucggagaguggcaaguggaaaucauuaauaaccauuuucccggcaauagaaacaauccuaucgggaacaaugaucugacgauucaccggcucagcggauaucuggcucgcuggguccuugagcauuucaccgccgacgaugacgaaucccagagagagcugauccggucuacaaucauuaaccccaucgcugagagcaauggcauucacuggaacaauggcccugaaaucuaccucuccuuuuuccccgggaccgagauguuucuggaaauuuucaaauuuuauccucugacaaucggaauuuaccgcgugaagcauggcaugauggauccgcaguaucucaagaaagcccugagacagcgguacgggacccuuacagcggagaaguggauggcccagaaaaccguucugaucgcuaagucucucaaagacguggagcaacugaaguggggacgcggcgggcuuagcgaugccgcuagaacguuccugaucaaguucggagucaaacuccccuga

SEQ ID NO: 7535 - RNA, 708 nt, Artificial Sequence
  derived and/or modified CDS sequence (opt5) from KEYV(KEYV/Ochlerotatus atlanticus/USA/KEYVLK01/2005)__KT630290.1__N
augggcgaccugguguucuacgaugucgccagcaccggggcuaacggauuugaccccgaugccggcuauguugcguucauggcuaaucacggggaguccaucucucucagcacagugagaaucuuuuuccugaacgccgccaaggcuaaagccgcucuuacgcggaagccugaacgcaaagccaccccgaaguuuggagaguggcaaguggaaauugucaauaaccauuuccccggcaauagaaacaauccuauugggaacaaugaccugacacuccaccggaucuccggauaccuggcgcgcugggugcuugagcauuuuggcgaaggcgaggaugagucucagaaagaacugauuaagagcaccguuaucaaccccaucgccgaguccaaugggauuagauggggaaacggcguggaaaucuaucucucuuucuuuccugggacagagauguuccuggagcuguuuaaguucuacccccucaccauuggaaucuaucgggucaaacacggcaugauggacgcucaguaccugaagaaagcccuucgccagagauaugggacacugaccgcugauaaguggauggcccagaaaacgagcaugauuaccaagucccucaaggacguggaacaacugaaauggggaaagggcggccuuagcgauacagcgcgggccuuucuggcuaaauucgggguucgccucccuuga

SEQ ID NO: 7536 - RNA, 708 nt, Artificial Sequence
  derived and/or modified CDS sequence (opt5) from KEYV(KEYV/Ochlerotatus atlanticus/USA/KEYVLK02/2005)__KT630293.1__N
augggcgaccugguguucuacgaugucgccagcaccggggcuaacggauuugaccccgaugccggcuauguugcguucauggcuaaucacggggaguccaucucucucagcacagugagaaucuuuuuccugaacgccgccaaggcuaaagccgcucuuacgcggaaguccgaacgcaaagccaccccuaaguuuggagaguggcaaguggaaauugucaauaaccauuucccgggcaauagaaacaaucccauugggaacaaugaccugacacuccaccggaucucuggauaccuggcgcgcugggugcuugagcauuuuggcgaaggcgaggaugagagccagaaagaacugauuaaguccaccguuaucaacccuaucgccgagucuaaugggauuagauggggaaacggcguggaaaucuaucucagcuucuuucccgggacagagauguuccuggagcuguuuaaguucuacccucucaccauuggaaucuaucgggucaaacacggcaugauggacgcucaguaccugaagaaagcccuucgccagagauaugggacacugaccgcugauaaguggauggcccagaaaacguccaugauuaccaagagccucaaggacguggaacaacugaaauggggaaagggcggccuuucugauacagcgcgggccuuucuggcuaaauucgggguucgccuccccuga

SEQ ID NO: 7537 - RNA, 708 nt, Artificial Sequence; identical to SEQ ID NO: 7535
  derived and/or modified CDS sequence (opt5) from KEYV(C14031-33)__U12801.1__N

SEQ ID NO: 7538 - RNA, 708 nt, Artificial Sequence
  derived and/or modified CDS sequence (opt5) from LACV(Human/78)__NC_004110.1__N
augagcgaccugguguucuacgaugucgccuccaccggcgcuaacggguuugaccccgaugccggauauauggacuucugcguuaagaaugcggagcuccugaaccuugcugccgugagaaucuuuuuccugaaugccgcuaaagccaaggcugcccucucucggaaaccugaacgcaaggcgaacccgaaauuuggcgaguggcaaguggaagucauuaauaaccacuuccccgggaauagaaacaauccuaucggaaacaaugaucugacaauucaucggcuuagcggcuaccuggcccgcugggugcucgaccaguauaacgagaaugaugacgaaucccagcacgagcugaucagaacgaccauuaucaaccccaucgcugagucuaaugggguuggaugggauagcggcccugaaauuuaccuguccuuuuuccccggcacagagauguuucucgaaaccuucaaguuuuauccucugacaaucgggauucaucgggugaagcagggaaugauggacccgcaguaccuuaaaaaggcccugcgccaaagauauggcacccucacagcugauaaauggaugucucagaaggucgccgcgaucgccaaaagccugaaggacguggagcagcuuaagugggggaaaggaggccuguccgauaccgcuaagacguuccuccagaaauuugggauucggcugcccuga

SEQ ID NO: 7539 - RNA, 708 nt, Artificial Sequence
  derived and/or modified CDS sequence (opt5) from LACV__KP271107.1__N
augagcgaccugguguucuacgaugucgccuccaccggcgcuaacggguuugaccccgauacaggauauauggacuucugcguuaagaaugccgagucucucaaccuggcggcugugagaaucuuuuuccuuaaugccgccaaagcuaaggccgcucugagccggaaaccugaacgcaaggccaacccgaaauuuggcgaguggcaaguggaagucauuaauaaccacuuccccgggaauagaaacaauccuaucggaaacaaugaucucacgauucaucggcuguccggcuaccuugcgcgcugggugcuggaccaguauaacgagaaugaugacgaaucucagcacgagcucaucagaaccacaauuaucaaccccaucgccgagagcaaugggguuggaugggauuccggcccugaaauuuaccugagcuuuuuccccggcaccgagauguuucuggaaacauucaaguuuuauccucucaccaucgggauucaucgggugaagcagggaaugauggacccgcaguaccugaaaaaggcccuucgccaaagauauggcacacugaccgcugauaaauggaugucucagaaggucgcugccaucgcgaaaucccucaaggacguggagcagcugaagugggggaaaggaggccuuagcgauacggccaagaccuuccugcagaaauuugggauucggcuccccuga

SEQ ID NO: 7540 - RNA, 708 nt, Artificial Sequence
  derived and/or modified CDS sequence (opt5) from LACV(BEN2_Lafayette_WI_2007)__GU596386.1__N
augagcgaccugguguucuacgaugucgccuccaccggcgcuaacggguuugaccccgaugccggauauauggacuucugcguuaagaaugcggagucucucaaccuggcugccgugagaaucuuuuuccuuaaugccgcuaaagccaaggcugcccugagccggaaaccugaacgcaaggcgaacccgaaauuuggcgaguggcaaguggaagucauuaauaaccacuuccccgggaauagaaacaauccuaucggaaacaaugaucucacaauucaucggcuguccggcuaccuugcccgcugggugcuggaccaguauaacgagaaugaugacgaaucucagcacgagcucaucagaacgaccauuaucaaccccaucgcugagagcaaugggguuggaugggauuccggcccugaaauuuaccugagcuuuuuccccggcacagagauguuucuggaaaccuucaaguuuuauccucucacaaucgggauucaucgggugaagcagggaaugauggacccgcaguaccugaaaaaggcccuucgccaaagauauggcacccugacagcugauaaauggaugucucagaaggucgccgcgaucgccaaaucccucaaggacguggagcagcugaagugggggaaaggaggccuuagcgauaccgcuaagacguuccugcagaaauuugggauucggcuccccuga

SEQ ID NO: 7541 - RNA, 708 nt, Artificial Sequence
  derived and/or modified CDS sequence (opt5) from LACV(Dallas/TX/2009)__GU591164.1__N
augagcgaccugguguucuacgaugucgccuccaccggcgcuaacggguuugaccccgaugccggauauauggacuucugcguuaagaaugcggagucucucaaccuggcugccgugagaaucuuuuuccuuaaugccgcuaaagccaaggcugcccugagccggaaaccugaacgcaaggcgaacccgaaauuuggcgaguggcaaguggaagucgugaauaaccacuuccccgggaauagaaacaauccuauuggaaacaaugaucucacaauccaucggcuguccggcuaccuugcccgcuggguucuggaccaguauaacgagaaugaugacgaaucucagagagagcucauucggacgaccaucauuaaccccaucgcugagagcaauggggugcgcugggauuccggaccugaaaucuaccugagcuuuuuccccggcacagagauguuucuggaaaccuucaaguuuuauccucucacaauuggcauccacagagucaagcaggggaugauggacccgcaguaccugaaaaaggcccuucggcaacgcuauggaacccugacagcugauaaauggaugucucagaagguggccgcgauugccaaaucccucaaggacguugagcagcugaaguggggcaaagggggacuuagcgauaccgcuaagacguuccugcagaaauuuggcaucagacuccccuga

SEQ ID NO: 7542 - RNA, 708 nt, Artificial Sequence
  derived and/or modified CDS sequence (opt5) from LACV(Fort Bend County/TX/2009)__GU591167.1__N
augagcgaccugguguucuacgaugucgccuccaccggcgcuaacggguuugaccccgaugccggauauauggacuucugcguuaagaaugcggagucucucaaccuggcugccgugagaaucuuuuuccuuaaugccgcuaaagccaaggcugcccugagccggaaaccugaacgcaaggcgaacccgaaauuuggcgaguggcaaguggaagucauuaauaaccacuuccccgggaauagaaacaauccuaucggaaacaaugaucucacaauucaucggcuguccggcuaccuugcccgcugggugcuggaccaguauaacgagaaugaugacgaaucucagagagagcucauccggacgaccauuaucaaccccaucgcugagagcaaugggguucgcugggauuccggaccugaaauuuaccugagcuuuuuccccggcacagagauguuucuggaaaccuucaaguuuuauccucucacaaucggcauucacagagugaagcaggggaugauggacccgcaguaccugaaaaaggcccuucggcaacgcuauggaacccugacagcugauaaauggaugucucagaaggucgccgcgaucgccaaaucccucaaggacguggagcagcugaaguggggcaaagggggacuuagcgauaccgcuaagacguuccugcagaaauuuggcauuagacuccccuga

SEQ ID NO: 7543 - RNA, 708 nt, Artificial Sequence
  derived and/or modified CDS sequence (opt5) from LACV(LACV/95/OH-H (CCH-MB96))__GU206135.1__N
augagcgaccugguguucuacgaugucgccuccaccggcgcuaacggguuugaccccgaugccggauauauggacuucugcguuaagaaugcggagucucucaaccuggcugccgugagaaucuuuuuccuuaaugccgcuaaagccaaggcugcccugagccggaaaccugaacgcaaggcgaacccgaaauuuggcgaguggcaaguggaagucgugaauaaccacuuccccgggaauagaaacaauccuauuggaaacaaugaucucacaauccaucggcuguccggcuaccuugcccgcuggguucuggaccaguauaacgagaaugaugacgaaucucagcacgagcucauuaagacgaccaucauuaaccccaucgcugagagcaauggggugggaugggauuccggcccugaaaucuaccugagcuuuuuccccggcacagagauguuucuggaaaccuucaaguuuuauccucucacaauugggauccauagagucaaacagggaaugauggacccgcaguaccugaagaaagcccuucggcaacgcuauggcacccugacagcugauaaguggaugucucagaaaguggccgcgauugccaagucccucaaggacguugagcagcugaaaugggggaagggaggccuuagcgauaccgcuaaaacguuccugcagaaguuugggaucagacuccccuga

SEQ ID NO: 7544 - RNA, 696 nt, Artificial Sequence
  derived and/or modified CDS sequence (opt5) from OROV(BeAn19991)__NC_005777.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacagaugcggucuccuauuaagcaggcugaauuucgcgccaccguuguggucccccuggcggaggugaaaggcugcacauggaaugauggggacgccauguaucucggauucgcugccggcgcugaaauguuucugcagaccuucacguucuuuccucuggugaucgagaugcacagaguccucaaggauggcauggacguuaacuucaugaagaaagugcugcggcaacgcuacgggcagaagaccgccgagcaguggaugagagaagagauuguggcgguccgggccgcuuuugaagccgugggaacacuugcuugggcccgcaccggcuucagcccggccgcuagagauuuucugcggcaguucgggaucgacauuuga

SEQ ID NO: 7545 - RNA, 696 nt, Artificial Sequence
  derived and/or modified CDS sequence (opt5) from OROV(AR136921)__HQ830443.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacagaugcggucuccuauuaagcaggcugaauuucgcgccaccguuguggucccccuggcggaggugaaaggcugcacauggaaugauggggacgccauguaucucggauucgcugccggcgcugaaauguuucugcagaccuucacguucuuuccucuggugaucgagaugcacagaguccucaaggauggcauggacguuaacuucaugaagaaagugcugcggcaacgcuacgggcagaagaccgccgagcaguggaugagagaagagauuguggcgguccgggccgcuuuugaagccgugggaacacuugcuugggcccgcaccggcuucagcccggccgcuagagauuuucugcggcaguucgggaucggaauuuga

SEQ ID NO: 7546 - RNA, 696 nt, Artificial Sequence
  derived and/or modified CDS sequence (opt5) from OROV(AR366927)__HQ830448.1__N
augagcgaguucuuuuucaacgacgugccccagagaaccacauccacguuugauccugaagccgcuuacgucgccuucgaggcgcgguauggccaaguucugaaugcugggguggugcgcgucuuuuuccucaaccagaagaaagccaaggacgugcugagaaaaaccucucggccgaugguugaucuuacauuuggaggcgugcaguucgccauggucaauaaccacuuuccccaguuccaaagcaauccugugcccgacaacgggcugacccuccaucgccuguccggauaccuugcuagaugggccuuuacacagaugcggucuccuaucaagcaggcugaguuccgcgccaccguuguggucccccuggcggaagugaaaggcugcacauggaaugauggggacgccauguaucucggauuugcugccggcgcugaaauguuccugcagaccuucacguuuuucccucuggugauugagaugcacagaguccucaaggauggcauggacguuaacuuuaugaagaaagugcugcggcaaaaguacgggcagaaaaccgccgagcaguggaugcgcgaagagaucguggcggucagagccgcuuucgaagccgugggaacacuugcuugggcccggaccggcuuuagcccggccgcucgcgauuuccugagacaguuugggauuggaaucuga

SEQ ID NO: 7547 - RNA, 696 nt, Artificial Sequence
  derived and/or modified CDS sequence (opt5) from OROV(BeAn 206119)__AY993909.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacagaugcggucuccuauuaagcaggcugaauuucgcgccgcgguuguggucccccugguggaggugaaaggcugcaccuggaaugauggggacgccauguaucucggauucgcugccggcgcugaaauguuucugcagacauucaccuucuuuccucuggucaucgagaugcacagaguucucaaggauggcauggacgugaacuucaugaagaaagugcugcggcaacgcuacgggcagaagacggccgagcaguggaugagagaagagauugucgcggugcgggccgcuuuugaaaccguuggaacauucgccugggcucgcaccggcuuuagcccggccgccagagauuuccuucggcaguuugggaucggaauuuga

SEQ ID NO: 7548 - RNA, 696 nt, Artificial Sequence
  derived and/or modified CDS sequence (opt5) from OROV(BeAn 208819)__AY993911.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacagaugcggucuccuauuaagcaggcugaauuucgcgccaccguuguggucccccugguggaggugaaaggcugcacauggaaugauggggacgcgauguaucucggauucgccgcuggcgccgaaauguuucugcagaccuucacguucuuuccucuggucaucgagaugcacagaguucucaaggauggcauggacgugaacuucaugaagaaagugcugcggcaacgcuacgggcagaagaccgcugagcaguggaugagagaagagauugucgccgugcgggcggccuuugaagcuguuggaacacuugccugggcucgcaccggcuucagcccggccgccagagauuuucugcggcaguucgggaucggaauuuga

SEQ ID NO: 7549 - RNA, 696 nt, Artificial Sequence
  derived and/or modified CDS sequence (opt5) from OROV(BeAn 208823)__AY993912.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacagaugcggucuccuauuaagcaggcugaauuucgcgccaccguuguggucccccugguggaggugaaaggcugcacauggaaugauggggacgcgauguaucucggauucgccgcuggcgccgaaauguuucugcagaccuucacguucuuuccucuggucaucgagaugcacagaguucucaaggauggcauggacgugaacuucaugaagaaagugcugcggcaacgcuacgggcagaagaccgcugagagauggaugcgggaagagauugucgccgugcgcgcggccuuugaagcuguuggaacacuugccugggcuagaaccggcuucagcccggccgcccgggauuuucugcgccaguucgggaucggaauuuga

SEQ ID NO: 7550 - RNA, 696 nt, Artificial Sequence
  derived and/or modified CDS sequence (opt5) from OROV(H244576)__HQ830444.1__N
augagcgaguucuuuuucaacgacgugccccagagaaccacauccacguuugauccugaagccgcuuacgucgccuucgaggcgcgguauggccaaguucugaaugcugggguggugcgcgucuuuuuccucaaccagaagaaagccaaggacgugcugagaaaaaccucucggccgaugguugaucuuacauuuggaggcgugcaguucgccauggucaauaaccacuuuccccaguuccaaagcaauccugugcccgacaacgggcugaccuuucaucgccucuccggauaccuggcuagaugggccuucacacagaugcggucuccuaucaagcaggcugaauuucgcgccaccguuguggucccccuugcggaggugaaaggcugcacauggaaugauggggacgccauguaucugggauucgcugccggcgcugaaauguuccuccagaccuuuacguucuuuccucuggugauugagaugcacagaguccugaaggauggcauggacguuaacuucaugaagaaagugcuccggcaaaaguacgggcagaaaaccgccgagcaguggaugcgcgaagagaucguggcggucagagccgcuuuugaagccgugggaacacuggcuugggcccggaccggcuucagcccggccgcucgcgauuuucuuagacaguucgggauuggaaucuga

SEQ ID NO: 7551 - RNA, 696 nt, Artificial Sequence
  derived and/or modified CDS sequence (opt5) from OROV(H355186)__HQ830446.1__N
augagcgaguucaucuuuuccgacgugccccagagaaccacaucuacguucgauccugaagccgcuuacgucgccuuugaggcgcgguauggccaaguucugaacgcugggguggugcgcgucuucuuucucaaucagaagaaagccaaggacgugcugagaaaaaccagccggccgaugguugaucuuacauucggaggcgugcaguuugccauggucaacaaucacuucccccaguuucaauccaacccugugcccgacaaugggcugacccuccaucgccugucuggauaccuugcuagaugggccuucacacagaugcggagcccuauuaagcaggcugaauuucgcgccaccguuguggucccccuggcggaggugaaaggcugcacauggaacgauggggacgccauguaucucggauucgcugccggcgcugaaauguuucugcagaccuucacguucuuuccucuggugaucgagaugcacagaguccucaaggauggcauggacguuaauuucaugaagaaagugcugcggcaacgcuacgggcagaagaccgccgagcaguggaugagagaagagauuguggcgguccgggccgcuuuugaagccgugggaacacuugcuugggcccgcaccggcuucuccccggccgcuagagauuuucugcggcaguucgggaucggaauuuga

SEQ ID NO: 7552 - RNA, 696 nt, Artificial Sequence
  derived and/or modified CDS sequence (opt5) from OROV(H356898)__HQ830447.1__N
augagcgaguucaucuuuaacgacgugccccagagaaccacauccacguucgauccugaagccgcuuacgucucuuuugaggcccgguauggccaaguucugaaugcggggguggugcgcgucuucuuucucaaccagaagaaagcuaaggacgugcugagaaaaaccagccggccgaugguugaucuuacauucggaggcgugcaguuugccauggucaauaaccacuucccccaguuucaauccaauccugugcccgacaacgggcugacccuccaucgccugucuggauaccuugccagaugggcuuucacacagaugcggagcccuauuaagcaggccgaauuucgcgcuaccguuguggucccccuggccgaggugaaaggcugcacauggaaugauggggacgcgauguaucucggauucgccgcuggcgccgaaauguuucugcagaccuucacguucuuuccucuggugaucgagaugcacagaguccucaaggauggcauggacguuaacuucaugaagaaagugcugcggcaacgcuacgggcagaagaccgcugagcaguggaugagagaagagauuguggccguccgggcggccuuugaagcugugggaacacuugccugggcucgcaccggcuucuccccggccgccagagauuuucugcggcaguucgggaucggaauuuga

SEQ ID NO: 7553 - RNA, 696 nt, Artificial Sequence
  derived and/or modified CDS sequence (opt5) from OROV(H389865)__HQ830453.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacacaugcggucuccuauuaagcaggcugaauuucgcgccaccguuguggucccccuggcggaggugaaaggcugcacauggaaugauggggacgccauguaucucggauucgcugccggcgcugaaauguuucugcagaccuucacguucuuuccucuggugaucgagaugcauagaguccucaaggauggcauggacguuaacuucaugaagaaauuucugcggcagcgcuacgggcaaaagaccgccgagcaguggaugagagaagagauucuugcggugaaagccgcuuucgaaagcgugggaacacuggccugggcucggaccggcuuuuccccggccgcccgcgauuuccucagacaguuugcuaucgggauuuga

SEQ ID NO: 7554 - RNA, 696 nt, Artificial Sequence
  derived and/or modified CDS sequence (opt5) from OROV(H472433)__HQ830455.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucagcggagugcaguuugccauggucaauaaccacuucccccaguuucaauccaauccugugcccgacaacggccugacccuccaucgccugucuggguaccuugcuagaugggccuucacacagaugcggagcccuauuaagcaggcugaauuucgcgccaccguuguggucccccuggcggaggugaaaggaugcacauggaaugauggcgacgccauguaucucggguucgcugccggagcugaaauguuucugcagaccuucacguucuuuccucuggugaucgagaugcacagaguccucaaggauggcauggacguuaacuucaugaagaaagugcugcggcaacgcuacggccagaagaccgccgagcaguggaugagagaagagauuguggcgguccgggccgcuuuugaagccguggggacacuugcuugggcccgcaccggauucuccccggccgcuagagauuuucugcggcaguucggcaucgggauuuga

SEQ ID NO: 7555 - RNA, 696 nt, Artificial Sequence
  derived and/or modified CDS sequence (opt5) from OROV(H532490)__HQ830463.1__N
augagcgaguucaucuuuaacgacgugccccagagaaccacauccacguucgauccugaagccgcuuacgucucuuuugaggcccgguauggccaaguucugaaugcggggguggugcgcgucuucuuucucaaccagaagaaagcuaaggacgugcugagaaaaaccagcuccccgaugguugaucuuacauucggaggcgugcaguuugccauggucaauaaccacuucccccaguuucaaucuaauccugugcccgacaacgggcugacccuccaucggcugagcggauaccuugcccgcugggcuuucacacagaugagauccccuauuaagcaggccgaauuucgggcuaccguuguggucccccuggccgaggugaaaggcugcacauggaaugauggggacgcgauguaucucggauucgccgcuggcgccgaaauguuucugcagaccuucacguucuuuccucuggugaucgagaugcaccgcguccucaaggauggcauggacguuaacuucaugaagaaagugcugagacaacgguacgggcagaagaccgcugagcaguggaugcgcgaagagauuguggccgucagagcggccuuugaagcugugggaacacuugccugggcucggaccggcuucucuccggccgcccgcgauuuucugagacaguucgggaucggaauuuga

SEQ ID NO: 7556 - RNA, 696 nt, Artificial Sequence
  derived and/or modified CDS sequence (opt5) from OROV(H543629)__HQ830467.1__N
augagcgaguuccuguuuaacgacgugccccagagaaccacauccacguucgauccugaagccgcuuacgucgccuuugaggcgcgguauggccaaguucucaaugcugggguggugcgcgucuucuuucugaaccagaagaaagccaaggacgugcuuagaaaaaccucucggccgaugguugaucugacauucggaggcgugcaguuugccauggucaauaaccacuucccccaguuucaaagcaauccugugcccgacaacgggcucacccugcaucgccuuuccggauaccuggcuagaugggccuucacacagaugcggucuccuaucaagcaggcugaauuucgcgccaccguuguggucccccucgcggaggugaaaggcugcacauggaaugauggggacgccauguaucugggauucgcugccggcgcugaaauguuucugcagaccuucacguucuuuccucucgugauugagaugcacagaguccugaaggauggcauggacguuaacuucaugaagaaagugcuucggcaacgcuacgggcagaagaccgccgagcaguggaugagagaagagaucguggcgguccgggccgcuuuugaagccgugggaacacuggcuugggcccgcaccggcuucagcccggccgggagagauuuucuccggcaguucggaauuggcaucuga

SEQ ID NO: 7557 - RNA, 696 nt, Artificial Sequence
  derived and/or modified CDS sequence (opt5) from OROV(H543638)__HQ830468.1__N
augagcgaguuccuguuuaacgacgugccccagagaaccacauccacguucgauccugaagccgcuuacgucgccuuugaggcgcgguauggccaaguucucaaugcugggguggugcgcgucuucuuucugaaccagaagaaagccaagaaugugcuuagaaaaaccucucggccgaugguugaccugacauucggaggcgugcaguuugccauggucaacaaucacuucccccaguuucaaagcaacccugugcccgauaaugggcucacccugcaucgccuuuccggauaccuggcuagaugggccuucacacagaugcggucuccuaucaagcaggcugaauuucgcgccaccguuguggucccccucgcggaggugaaaggcugcacauggaacgacggggaugccauguaucugggauucgcugccggcgcugaaauguuucugcagaccuucacguucuuuccucucgugauugagaugcacagaguccugaaggacggcauggauguuaauuucaugaagaaagugcuucggcaacgcuacgggcagaagaccgccgagcaguggaugagagaagagaucguggcgguccgggccgcuuuugaagccgugggaacacuggcuugggcccgcaccggcuucagcccggccgggagagacuuucuccggcaguucggaauuggcaucuga

SEQ ID NO: 7558 - RNA, 696 nt, Artificial Sequence
  derived and/or modified CDS sequence (opt5) from OROV(H706890)__HQ830473.1__N
auggccgaguucaucuuuaacgacgugccccagagaaccacaagcacguucgauccugaagcugccuacgucgcguuugaggcucgguauggccaaguucugaaugccgggguggugcgcgucuucuuucucaaccagaagaaagccaaggacgugcugagaaaaaccucccggccgaugguugaucuuacauucggaggcgugcaguuugcuauggucaauaaccacuucccccaguuucaaucuaauccugugcccgacaacgggcugacccuccaucgccugagcggauaccuugccagaugggcuuucacacagaugcgguccccuauuaagcaggccgaauuucgcgcgaccguuguggucccccuggccgaggugaaaggcugcacauggaaugauggggacgcuauguaucucggauucgccgcuggcgccgaaauguuucugcagaccuucacguucuuuccucuggugaucgagaugcacagaguccucaaggauggcauggacguuaacuucaugaagaaagugcugcggcaacgcuacgggcagaagaccgcggagcaguggaugagagaagagauuguggccguccgggcugccuuugaagcugugggaacacuugccugggcccgcaccggcuucucuccggcugcgagagauuuucugcggcaguucgggaucggaauuuga

SEQ ID NO: 7559 - RNA, 696 nt, Artificial Sequence
  derived and/or modified CDS sequence (opt5) from OROV(H758669)__HQ830479.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauucugaauaaccacuucccccaguuucaaagcaauccuguccccgacaacgggcucacccugcaucgccuuuccggauaccuggcuagaugggccuucacacagaugcggucuccuaucaagcaggcugaauuucgcgccaccgugguugugccccucgcggaggucaaaggcugcacauggaaugauggggacgccauguaucugggauucgcugccggcgcugaaauguuucugcagaccuucacguucuuuccucucgugauugagaugcacagagugcugaaggauggcauggacgucaacuucaugaagaaaguucuucggcaacgcuacgggcagaagaccgccgagcaguggaugagagaagagaucguggcggugcgggccgcuuuugaagccgucggaacacuggcuugggcccgcaccggcuucagcccggccgcuagagauuuucuccggcaguucgggauuggaaucuga

SEQ ID NO: 7560 - RNA, 696 nt, Artificial Sequence
  derived and/or modified CDS sequence (opt5) from OROV(H758687)__HQ830478.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacagaugcggucuccuauuaagcaggcugaauuucgcgccaccguuguggucccccuggcggaggugaaaggcugcacauggaaugauggggacgccauguaucucggauucgcugccggcgcugaaauguuucugcagaccuucacguucuuuccuuucgugaucgagaugcacagaguccugaaggauggcauggacguuaacuuuaugaagaaagugcuccggcaacgcuacgggcagaagaccgccgagcaguggaugagagaagagauuguggcgguccgggccgcuuucgaagccgugggaacacuggcuugggcccgcaccggcuuuagcccggccgcuagagauuuccuucggcaguuugggaucggaauuuga

SEQ ID NO: 7561 - RNA, 696 nt, Artificial Sequence
  derived and/or modified CDS sequence (opt5) from OROV(H759041)__HQ830488.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacagaugcggucuccuauuaagcaggcugaauuucgcgccaccguuguggucccccuggcggaggugaaaggcugcacauggaaugauggggacgccauguaucucggauucgcugccggcgcugaaauguuucugcagaccuucacguucuuuccucuggugaucgagaugcacagaguccucaacgauggcauggacguuaauuucaugaagaaggugcugcggcaacgcuacgggcagaaaaccgccgagcaguggaugagagaagagauuguggcgguccgggccgcuuuugaagccgugggaacacuugcuugggcccgcaccggcuucagcccggccgcuagagauuuucugcggcaguucgggaucggaauuuga

SEQ ID NO: 7562 - RNA, 696 nt, Artificial Sequence
  derived and/or modified CDS sequence (opt5) from OROV(BeAr473358)__AF164539.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacacaugcggucuccuauuaagcaggcugaauuucgcgccaccguuguggucccccuggcggaggugaaaggcugcacauggaaugauggggacgccauguaucucggauucgcugccggcgcugaaauguuucugcagaccuucacguucuuuccucuggugaucgagaugcauagaguccucaaggauggcauggacguuaacuucaugaagaaaauucugcggcagcgcuacgggcaaaagaccgccgagcaguggaugagagaagagaucauugcggugaaaacagccuuugaaaccgugggaacacuugcuugggccaucaccggcuucagcccggcugcccggaauuuucugcgccaguucgagaucgauauuuga

SEQ ID NO: 7563 - RNA, 696 nt, Artificial Sequence
  derived and/or modified CDS sequence (opt5) from OROV(BeH 521086)__AY704559.1__N
augagcgaguuccuguuuaacgacgugccccagagaaccacauccacguucgauccugaagccgcuuacgucgccuuugagucucgguauggccaaguucucaaugcggggguggugcgcgucuucuuucugaaccagaagaaagcuaaggacgugcuuagaaaaaccagccggccgaugguugaucugacauucggaggcgugcaguuuaccauggucaauaaccacuucccccaguuucaauccaauccugugcccgacaacgggcucacacugcaucgccuuucuggauaccuggccagaugggccuucacccagaugcggagcccuaucaagcaggcugaauuucgcgccacaguuguggucccccucgcugaggugaaaggcugcaccuggaaugauggggacgccauguaucugggauucgcggccggcgcugaaauguuucugcagacguucaccuucuuuccucucgugauugagaugcacagaguccugaaggauggcauggacguuaacuucaugaagaaagugcuucggcaacgcuacgggcagaagacagccgagcaguggaugagagaagagaucguggcuguccgggccgcguuugaagccgugggaacccuggcuugggcccgcacaggcuucuccccggcugccagagauuuucuccggcagucugggauuggaaucuga

SEQ ID NO: 7564 - RNA, 696 nt, Artificial Sequence
  derived and/or modified CDS sequence (opt5) from OROV(BeH121923)__HM470110.1__N
augagcgaguucaucuuuaacgacgugccccagagaaccacauccucuuucgauccugaagccgcuuacgucgccuuugaggcgcgguauggccaaguucugaaugcuugcguggugcgcgucuucuuucucaaccagaagaaagccaaggacgugcugagaaaaacgagcuggccgaugguugaucuuaccuucgggcgggugcaguuugccauggucaauaaccacuucccccaguuucaauccaauccugugcccgacaacggacuggcucuccaucgccugucuggcuaccuugccagaugggcuuucacacagaugcggagcccuauuaagcaggccgaauuucgcgcgaccguuguggucccccuggccgaggugaaaggguguacauggaaugauggagacgcuauguaucucggcuucgccgcuggggccgaaauguuucugcagaccuucacauucuuuccucuggugaucgagaugcacagaguccucaaggauggaauggacguuaacuucaugaagaaagugcugcggcaacgcuacggccagaagaccgcggagcaguggaugagagaagagauuguggccguccgggcugccuuugaagcugugggcacgcuugccugggcccgcaccggguucuccccggcugcgagagauuuucugcggcaguucggaaucgacauuuga

SEQ ID NO: 7565 - RNA, 696 nt, Artificial Sequence
  derived and/or modified CDS sequence (opt5) from OROV(BeH379693)__AF164534.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagacggaccucucgcccgaugguugaucuuacauucggaggcgugcaguuugccauggucaauaaccacuucccccaguuucaaagcaauccugugcccgacaacgggcugacccuccauagacuguccggauaccuugcucggugggccuucacacagaugcgcucuccuauuaaacaggcugaauuuagagccaccguuguggucccccuggcggaggugaagggcugcacauggaaugauggggacgccauguaucucggauucgcugccggcgcugaaauguuucugcagaccuucacguucuuuccucuggugaucgagaugcaccggguccucaaagauggcauggacguuaacuucaugaagaaggugcugcgccaaagauacgggcagaaaaccgccgagcaguggaugcgggaagagauuguggcgguccgcgccgcuuuugaagccgugggaacacuugcuugggccagaaccggcuucagcccggccgcucgggauuuucugcgccaguucgggaucggaauuuga

SEQ ID NO: 7566 - RNA, 696 nt, Artificial Sequence
  derived and/or modified CDS sequence (opt5) from OROV(BeH381114)__AF164535.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacagaugcggucuccuauuaagcaggcugaauuucgcgccaccguuguggucccccuggcggaggugaaaggcugcacauggaaugauggggacgccauguaucucggauucgcugccggcgcugaaauguuucugcagaccuucacguucuuuccucuggugaucgagaugcacagaguccucaaggauggcauggacguuaacuucaugaagaaagugcugcggcaacgcuacgggcagaagaccgccgagcaguggaugagagaagagauuguggcgguccgggccgcuuuugaagccgugggaacacuugcuugggcccgcaccggcuucagcccggccgcuagagauuuucugcggcaguucgggaucuguauuuga

SEQ ID NO: 7567 - RNA, 696 nt, Artificial Sequence
  derived and/or modified CDS sequence (opt5) from OROV(BeH390233)__AF164536.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacagaugcggucuccuauuaagcaggcugaauuucgcgccaccguuguggucccccuggcggaggugaaaggcugcacauggaaugauggggacgccauguaucucggauucgcugccggcgcugaaauguuucugcagaccuucacguucuuuccucuggugaucgagaugcacagaguccucaaggauggcauggacguuaacuucaugaagaaagugcugcggcaacgcuacgggcagaagaccgccgagcaguggaugagagaagagauuguggcgguccgggccgcuuuugaagccgugggaacacuugcuugggcccgcaccggcuucagcccggccgcuagagauuuucuggggcaguucggaaucggcauuuga

SEQ ID NO: 7568 - RNA, 696 nt, Artificial Sequence
  derived and/or modified CDS sequence (opt5) from OROV(BeH472204)__AF164538.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacagaugcggucuccuauuaagcaggcugaauuucgcgccaccguuguggucccccuggcggaggugaaaggcugcacauggaaugauggggacgccauguaucucggauucgcugccggcgcugaaauguuucugcagaccuucacguucuuuccucuggugaucgagaugcacagaguccucaaggauggcauggacguuaacuucaugaagaaagugcugcggcaacgcuacgugcagaagaccgccgagcaguggaugagagaagagauugucgcggugcgggccgcuuuugaagccguugggacacuugcuugggcccgcaccggauucagcccggccgcuagagauuuucugcggcaguucggcaucgggauuuga

SEQ ID NO: 7569 - RNA, 696 nt, Artificial Sequence
  derived and/or modified CDS sequence (opt5) from OROV(BeH505442)__AF164542.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacagaugcggucuccuauuaagcaggcugaauuucgcgccaccguuguggucccccuggcggaggugaaaggcugcacauggaaugauggggacgccauguaucucggauucgcugccggcgcugaaauguuucugcaggccuucaccuucuuuccucuggugaucgagaugcacagaguccucaaggauggcauggacguuaacuucaugaagaaagugcugcggcaacgcuacgggcagaagacggcggagcaguggaugagagaagagauuguggccguccgggcugccuuugaagcugugggaacccuugccugggcccgcacaggcuucagcccggcugcgagagauuuucugcggcaguucgggaucgacauuuga

SEQ ID NO: 7570 - RNA, 696 nt, Artificial Sequence
  derived and/or modified CDS sequence (opt5) from OROV(BeH541863)__AF164544.1__N
augagcgaguucaucuuuuccgacgugccccagagaaccacaucuacguucgauccugaagccgcuuacgucgccuuugaggcgcgguauggccaaguucugaacgcugggguggugcgcgucuucuuucucaaucagaagaaagccaaggacgugcugagaaaaaccagccggccgaugguugaucuuacauucggaggcgugcaguuugccauggucaacaaucacuucccccaguuucaauccaacccugugcccgacaaugggcugacccuccaucgccugucuggauaccuugcuagaugggccuucacacagaugcggagcccuauuaagcaggcugaauuucgcgccaccguuguggucccccuggcggaggugaaaggcugcacauggaacgauggggacgccauguaucucggauucgcugccggcgcugaaauguuucugcagaccuucacguucuuuccucuggugaucgagaugcacagaguccucaaggauggcauggacguuaauuucaugaagaaagugcugcggcaacgcuacgggcagaagaccgccgagcaguggaugagagaagagauuguggcgguccgggccgcuuuugaagccgugggaacacuugcuugggcccgcaccggcuucuccccggccgcuagaaacuuucugcggcaguucgggaucggaauuuga

SEQ ID NO: 7571 - RNA, 696 nt, Artificial Sequence
  derived and/or modified CDS sequence (opt5) from OROV(BeH543033)__AF164545.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacagaugcggucuccuauuaagcaggcugaauuucgcgccaccguuguggucccccuggcggaggugaaaggcugcacauggaaugauggggacgccauguaucucggauucgcugccggcgcugaaauguuucugcagaccuucacguucuuuccucuggugaucgagaugcacagaguccucaaggauggcauggacguuaacuucaugaagaaagugcugcggcaacgcuacgggcagaagaccgccgagcaguggaugagagaagagauuguggcgguccgggccgcuuuugaagccgugggaacacuugcuugggcccgcaccggcuucagcccggccgcuagagaguuucugcggcaguucgggaucggaauuuga

SEQ ID NO: 7572 - RNA, 696 nt, Artificial Sequence
  derived and/or modified CDS sequence (opt5) from OROV(BeH543618)__AF164548.1__N
augcaggaguucaucuuuaacgacgugccccaaagaaccacaagcacguucgauccugaagccgcuuacgucgccuuugaggcgcgguauggccagguucugaaugcugggguggugcgcgucuucuuucucaaccagaagaaagccaaggacgugcugagaaaaaccucccggccgaugguugaucuuacauucggaggcgugcaguuugccauggucaauaaccacuucccccaauuucagucuaauccugugcccgacaacgggcugacccuccaucgccugagcggauaccuugcuagaugggccuucacacagaugcgguccccuauuaagcaggcugaauuucgcgccaccguuguggucccccuggcggaggugaaaggcugcacauggaaugauggggacgccauguaucucggauucgcugccggcgcugaaauguuucugcaaaccuucacguucuuuccucuggugaucgagaugcacagaguccucaaggauggcauggacguuaacuucaugaagaaagugcugcggcagcgcuacgggcagaagaccgccgagcaguggaugagagaagagauuguggcgguccgggccgcuuuugaagccgugggaacacuugcuugggcccgcaccggcuucucuccggccgcuagagauuuucugcggcaauucgggaucggaauuuga

SEQ ID NO: 7573 - RNA, 696 nt, Artificial Sequence
  derived and/or modified CDS sequence (opt5) from OROV(BeH544552)__AF164546.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacagaugcggucuccuauuaagcaggcugaauuucgcgccaccguuguggucccccuggcggaggugaaaggcugcacauggaaugauggggacgccauguaucucggauucgcugccggcgcugaaauguuucugcagaccuucacguucuuuccucuggugaucgagaugcacagaguccucaaggauggcauggacguuaacuucaugaagaaagugcugcggcaacgcuacgggcagaagaccgccgagcaguggaugagagaagagauuguggcgguccgggccgcuuuugaagccgugggaacacuugcuugggcccgcaccggcuucagcccggccgcuagagauuuucugcggcagaucgggauuggaaucuga

SEQ ID NO: 7574 - RNA, 696 nt, Artificial Sequence
  derived and/or modified CDS sequence (opt5) from OROV(GML444911)__AF164556.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacagaugcggucuccuauuaagcaggcugaauuucgcgccaccguuguggucccccuggcggaggugaaaggcugcacauggaaugauggggacgccauguaucucggauucgcugccggcgcugaaauguuucugcagaccuucacguucuuuccucuggugaucgagaugcacagaguccucaaggauggcauggacguuaacuucaugaagaaagugcugcggcaacgcuacgggcagaagaccgccgagcaguggaugagagaagagauuguggcgguccgggccgcuuuugaagccgugggaacacuugcuugggcccgcaccggcuucagcccggccgcuagagauuuucugcggcaguucgggaucuauauuuga

SEQ ID NO: 7575 - RNA, 696 nt, Artificial Sequence
  derived and/or modified CDS sequence (opt5) from OROV(IQT4083)__AF164552.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacagaugcggucuccuauuaagcaggcugaauuucgcgccaccguuguggucccccuggcggaggugaaaggcugcacauggaaugauggggacgccauguaucucggauucgcugccggcgcugaaauguuucugcagaccuucacguucuuuccucuggugaucgagaugcacagaguccucaaggauggcauggacguuaacuucaugaagaaagugcugcggcaacgcuacgggaagaaaaccgccgagcaguggaugagagaagagauuguggcgguccgggccgcuuuugaagccgugggaacacuugcuugggcccgcaccggcuucagcccggccgcuagagauuuucugcggcaguucgggaucgacauuuga

SEQ ID NO: 7576 - RNA, 696 nt, Artificial Sequence
  derived and/or modified CDS sequence (opt5) from OROV(PPS 522 H 669314)__EF467370.1__N
augagcgaguucaucuccaacgacgugccccacagaaccacaucuacguuugauccugaagccgcuuacgucgccuucgaggcgcgguauggccagguucugaaugcugggguggugcgcgucuuuuuccucaaccaaaagaaagccaaggacgugcugagaaaaaccagccggccgaugguugaucuuacauuuggaggcgugcaguucgccauggucaauaaccauuuuccccaguuccaguccaauccugugcccgacaacgggcugacccuccaccgccugucuggauaccuugcuagaugggccuuuacacaaaugcggagcccuauuaagcaggcugaguuccgcgccaccguuguggucccccuggcggaagugaaaggcugcacauggaaugauggggacgccauguaucucggauuugcugccggcgcugaaauguuccugcagaccuuuacguucuucccucuggugaucgagaugcauagaguccucaaggauggcauggacguuaacuuuaugaagaaagugcugcggcagcgcuacgggcaaaagaccgccgagcaguggaugagagaagagauuguggcgguccgggccgcuuucgaagccgugggaacacuugcuugggcccgcaccggcuuuuccccggccgcuagagauuuccugcggcaguuugggaucuguauuuga

SEQ ID NO: 7577 - RNA, 696 nt, Artificial Sequence
  derived and/or modified CDS sequence (opt5) from OROV(TVP-19254/GML-480914)__KP795083.1__N
augagcgaguucaucuuuaacgacgugccccagagaaccacauccacguucgauccugaagccgcuuacgucgccuuugaggcgcgguauggccaaguucugucugcugggguggugcgcgucuucuuucucaaucagaagaaagccaaggacgugcugagaaaaaccagccggccgaugguugaucuuacauucggaggcgugcaguuugccauggucaacaaucacuucccccaguuucaauccaacccugugcccgacaaugggcugacccuccaucgccugucuggauaccuugcuagaugggccuucacacagaugcggagcccuauuaagcaggcugaauuucgcgccaccguuguggucccccuggcggaggugaaaggcugcacauggaacgauggggacgccauguaucucggauucgcugccggcgcugaaauguuucugcagaccuucacguucuuuccucuggugaucgagaugcacagaguccucaaggauggcauggacguuaauuucaugaagaaagugcugcggcaacgcuacgggcagaagaccgccgagcaguggaugagagaagagauuguggcgguccgggccgcuuuugaagccgugggaacacuugcuugggcccgcaccggcuucuccccggccgcuagagauuuucugcggcaguucgggaucgacauuuga

SEQ ID NO: 7578 - RNA, 696 nt, Artificial Sequence
  derived and/or modified CDS sequence (opt5) from OROV(TVP-19256/IQE-7894)__KP795086.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuuaccauggucaauaaccacuucccccaguuucaaagcaauccugugcccgacaacgggcugacacuccaucgccuguccggauaccuugccagaugggcuuucacccagaugcggucuccuauuaagcaggccgaauuucgcgcuacaguuguggucccccuggccgaggugaaaggcugcaccuggaaugauggggacgcgauguaucucggauucgccgcuggcgccgaaauguuucugcagacguucaccuucuuuccucuggugaucgagaugcacagaguccucaaggauggcauggacguuaacuucaugaagaaagugcugcggcaacgcuacgggcagaagacagcugagcaguggaugagagaagagauuguggccguccgggcggccuuugaagcugugggaacccuugccugggcucgcacaggcuucagcccggccgccagagauuuucugcggcaguucgggaucgacauuuga

SEQ ID NO: 7579 - RNA, 696 nt, Artificial Sequence
  derived and/or modified CDS sequence (opt5) from OROV(TVP-19258/IQT-4083)__KP795092.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacagaugcggucuccuauuaagcaggcugaauuucgcggcaccguuguggucccccuggccgaggugaaagggugcacauggaaugauggagacgcgauguaucucggcuucgccgcuggcgccgaaauguuucugcagaccuucacguucuuuccucuggugaucgagaugcacagaguccucaaggaugggauggacguuaacuucaugaagaaagugcugcggcaacgcuacggacagaagaccgcugagcaguggaugagagaagagauuguggccguccgggcggccuuugaagcugugggcacacuugccugggcucgcaccggguucagcccggccgccagagauuuucugcggcaguucggaaucgacauuuga

SEQ ID NO: 7580 - RNA, 699 nt, Artificial Sequence
  derived and/or modified CDS sequence (opt5) from OROV/FPV(Aus Ch 16129)__AF362400.1__N
augaccgacuucguguuuaacgaugucccccagagagccacaagcacguucgacccugaggcugccuacguugcguuugaaaaucgguuccgcgcuaaccugaccguggauguggccagaaucuuuuuccucaaucaaaagaaagccaaggaccggcuggcuaaaacagcccgcgcuaccgucgauauuacauuuggcggggugguuuucccgguggucaacaaucacuaucccgaguaccagagaaacccugugcccgacgauggacuuacccugcaucggcucuccggcuaucuggcccgcuggcuuaucgaccagugcaaugcgucuccuguuagaaugacagaaauucggaccaaggugaucauuccccuggccgaggucaaaggguguacguggaacgauggagcuagcauguaccucggcuuugccgcuggggccgaaauguuccugcaguccuuuaccuucuauccucuggugaucgagaugcaacgcgugcucaaggacggaauggaugucaauuuuaugagaaagguucugcggcagcgcuacggcacaaaaaccgcggagcaguggaugagagacgauaucguggccgugaagacagcuuucgaagccauuaacaccaucucuugggcucggagcggcuucuccccggccgcccgcgaguuucuuagacaguucgggauuaauaucuga

SEQ ID NO: 7581 - RNA, 696 nt, Artificial Sequence
  derived and/or modified CDS sequence (opt5) from OROV/IQTV(IQE3728/PER/06)__KF150535.1__N
augagcgaguucaucuuuaacgacgugccccagagaaccacauccacguucgauccugaagccgcuuacgucgccuuugaggcgcgguauggccaaguucugaaugcugggguggugcgcgucuucuuucucaaccagaagaaagccaaggacgugcugagaaaaaccucucggccgaugguugaucuuacauucggaggcgugcaguuugccauggucaauaaccacuucccccaguuucaaagcaauccugugcccgacaacgggcugacccuccaucgccuguccggauaccuugcuagaugggccuucacacagaugcggucuccuauuaagcaggcugaauuucgcgccaccguuguggucccccuggcggaggugaaaggcugcacauggaaugauggggacgccauguaucucggauucgcugccggcaccgaaauguuucugcagacguucaccuucuuuccucuggugaucgagaugcacagaguccucaaggauggcauggacguuaacuucaugaagaaagugcugcggcaacgcuacgggcagaagacagcugagcaguggaugagagaagagauuguggccguccgggcggccuuugaagcugugggaacccuugccugggcucgcacaggcuucagcccggccgccagagauuuucugcggcaguucgggaucggaauuuga

SEQ ID NO: 7582 - RNA, 699 nt, Artificial Sequence
  derived and/or modified CDS sequence (opt5) from OROV/UTIV(Be An 84785)__KF697156.1__N
auggccgaguucguguuuaacgacgucccccagagaagcaccuccacauucgauccugaaguugcuuacgccacguuugaggcggcuuuccggcaaacccugaaugugaacgugguccgcguguuuuuccucaaucagaagaacgccaaaaauguucugagaaagacaucucggccgaacguggaccuuaccuuuggcggggccacauuccccaucgucaauaaccacuuuccucaguuccagagcaaucccgugccugauaacggacugacccuccaucgccuguccggcuaucuugcuagauggucuauggaccaaaugcggacaaaucccauucgccaggccgaauuuagagcugccguuguggucccucuggcggagaucaaagggugcaccuggaacgauggagacgccauguaccucgcuuucgccgcuggcgccgaaauguuucugaauacguucaccuucuuuccgcuggugauugagaugcaccgggugcucaaggaugggauggacgucaacuucaugcgcaaaguucugagacagcgguauggaacaaagaccgcggagcaguggaugaaggaugaaaucauucccaucaaagccgcuuuugaggccgugggcaugcuuagcugggcucgcacaggcuucuccccugccgccagagacuuucugcggcaauucgggaucaauguguga

SEQ ID NO: 7583 - RNA, 738 nt, Artificial Sequence
  derived and/or modified CDS sequence (opt5) from HRTV(TN)__KJ740146.1__N
augaccgacuggagcgccaucgcuguggagauuggcaacgaaccccuggaugucccugcccucguugaguucgcgaaggaaaucgcuuacgaggggcuggacccggccgugauucuuggacugcucagagaacggggcggggagaauuggcgcaacgaugugaaauauaucauugucuuugcccugacaagaggaaauaagaucgugaaggcuugcggcaaaauguccaaaaagggggccgagcggaugacgaaccuugcucgcguuuacgaacugaaggagaaugccguggacagaauggcggucacccccgugcggguugcccagugucucccuacauggaccugcgcugccgcugccgcgaucaaagaauaucugcccgugggaccugccauuaugcacaacaagauccaaggcuacccccuggagaugauguguauggcuuucggcucucucauuccucaggccgaugucagcaucgaggugauuaaagacuuuauggaugcuuauucccuguggcaggacacauucgcccgcaccaucaauguggaucagagaaagaugacaaaagccgaagucuacgcuaaguuucgggacccgcuucaugcggccguuaacucucuguucuuucccaaugcuacccgcauuagcuggcuccaagccaaggggcugcuuacggccaccaaagaggcuuccggaucugugaaggccgcggcugccgccuauagaaacauguga

SEQ ID NO: 7584 - RNA, 738 nt, Artificial Sequence
  derived and/or modified CDS sequence (opt5) from HRTV(Patient1)__JX005842.1__N
augaccgacuggagcgccaucgcuguggagauuggcaacgaaccccuggaugucccugcccucguugaguucgcgaaggaaaucgcuuacgaggggcuggacccggccgugauuuuuggacuucugagagaacggggcggggagaauuggcgcaacgaugugaaauauaucauugucuucgcccucacaagaggaaauaagaucgugaaggcuugcggcaaaauguccaaaaagggggccgagcggaugacgaaccuggcucgcguuuacgaacuuaaggagaaugccguggacagaauggcggucacccccgugcggguugcccagugucugccuacauggaccugcgcugccgcugccgcgaucaaagaauaucuccccgugggaccugccauuaugcacaacaagauccaaggcuacccccuggagaugauguguauggcuuuuggcucucugauuccucaggccgaugucagcaucgaggugauuaaagacuucauggaugcuuauucccucuggcaggacacauuugcccgcaccaucaauguggaucagagaaagaugacaaaagccgaagucuacgcuaaguuccgggacccgcugcaugcggccguuaacucucuguuuuuccccaaugcuacccgcauuagcuggcuucaagccaaggggcuccugacggccaccaaagaggcuuccggaucugugaaggccgcggcugccgccuauagaaacauguga

SEQ ID NO: 7585 - RNA, 738 nt, Artificial Sequence; identical to SEQ ID NO: 7583
  derived and/or modified CDS sequence (opt5) from HRTV(Patient2)__JX005843.1__N

SEQ ID NO: 7586 - RNA, 732 nt, Artificial Sequence
  derived and/or modified CDS sequence (opt5) from PTV(PAN472868)__NC_027202.1__N
augagcuacgaggaaaucgccgugcaguucgcuuccgagucuauugacgaacaagccgucgcgggcuggguuaccgauuuugcuuaucagggguucgacgccaagagagugaucgcccuggugaaagaucggggaggcgaggacuggaagcaggaugucaaaaagaugauugugcucagccugacacgcgggaacaaacccaauaagaugguucuuaagauguccgacaaaggaaaggcuauggugaacgaacugguccucaaauacaagcugaaaucuggcaauccuagcagagaugaccuuacgcugucccggaucaccgccgcuuuugccggguggacaugccaggcggccgauuaugugcaagaguaccucccgguuaccggacgcgcuauggacgccauuucuagcuccuaucccagagcuaugaugcacccuagcuucgccggccugaucgaucaggagcugcccgcggacgugcucucugaaaucacacaggcccauugucuguuuaugauucaguucuccaagaccaucaacccuagccuucggggccugucuaaggaugagauugucuccagcuuugaacgccccaugcaagcugccaucucuuccacauuccucaccagcgcuaauagacgggccaugcugaaaacgcuugggauuaucaacgacaaucugaagccuuccucuagcaccguguccgccgcuaaaguguuucgcagccucuga

SEQ ID NO: 7587 - RNA, 732 nt, Artificial Sequence
  derived and/or modified CDS sequence (opt5) from PTV(Adames)__KR912210.1__N
augagcuacgaggaaaucgccgugcaguucgcuuccgagucuauugacgaacaagccgucgcgggcuggguuaccgauuuugcuuaucagggguucgacgccaagagagugaucgcccuggugaaagagcggggaggcgaagauuggaagcaggacgucaaaaagaugauugugcucagccugacacgcgggaacaaacccaauaagaugguucuuaagauguccgauaaaggaaaggcuauggugaacgagcugguccucaaauacaagcugaaaucuggcaauccuagcagagacgaucuuacgcugucccggaucaccgccgcuuuugccggguggacaugccaggcggccgacuaugugcaagaguaccucccgguuaccggacgcgcuauggauacaauuucuagcggcuaucccagagccaugaugcacccuuccuucgcuggccugaucgaccaggaacugcccgccgaugugcucagcgagaucacccaggcgcauugucuguuuaugauucaguucucuaagacaaucaacccuucccuucgggggcugagcaaggacgaaauugucucuuccuuugagcgccccaugcaagccgcuaucagcucuaccuuccucacguccgccaauagacgggcuaugcugaaaacccuuggaauuaucaacgauaaucugaagccuagcuccucuacagugagcgccgccaaaguguuucgcucccucuga

SEQ ID NO: 7588 - RNA, 732 nt, Artificial Sequence
  derived and/or modified CDS sequence (opt5) from PTV(Balliet)__KR912211.1__N
augagcuacgaggaaaucgccgugcaguucgcuuccgagucuauugacgaacaaaccgucgccggcuggguuacagauuuugcguaucagggguucgacgcuaagagagugaucgcccuggugaaagaucggggaggcgaggacuggaagcaggaugucaaaaagaugauugugcucagccugacgcgcgggaacaaacccaauaagaugauccuuaagauguccgacaaaggaaaggccaugguuaacgaacuggugcucaaauacaagcugaaaucuggcaauccuagcagagaugaccuuacccugucccggauuacagcugccuuugcuggguggaccugccaggccgcggauuauguccaagaguaccucccggugacaggacgcgccauggacgcuaucucuagcuccuaucccagagccaugaugcacccuagcuucgcuggccugaucgaucaggagcugcccgccgacguguuuucugaaauuacccaggcgcauugucucuucaugauccaguuuuccaagacaauuaacccuagccugcggggccuuucuaaggaugagaucguuuccagcuucgaacgccccaugcaagccgcuauuucuuccaccuuucugacgagcgccaauagacgggcuaugcucaaaacccuggggaucauuaacgacaaucuuaagccuuccucuagcacagucuccgccgccaaaguguuccgcagccuguga

SEQ ID NO: 7589 - RNA, 732 nt, Artificial Sequence
  derived and/or modified CDS sequence (opt5) from PTV(PaAR2381)__KP272006.1__N
augagcuacgaggaaaucgccgugcaguucgcuuccgagucuauugacgaacaagccgucgcgggcuggguuaccgauuuugcuuaucagggguucgacgccaagagagugaucgcccuggugaaagaucggggaggcgacgauuggaagcaggacgucaaaaagaugauugugcucagccugacacgcgggaacaaacccaauaagaugguucuuaagauguccgauaaaggaaaggcuauggugaacgagcugguccucaaauacaagcugaaaucuggcaauccuagcagagacgaucuuacgcugucccggaucaccgccgcuuuugccggguggacaugccaggcggccgacuaugugcaagaauaccucccgguuaccggacgcgcuauggaugccauuucuagcuccuaucccagagcuaugaugcacccuagcuucgccggccugaucgaccaggagcugcccgcggaugugcucucugagaucacacaggcccauugucuguuuaugauucaguucuccaagaccaucaacccuagccuucggggccugucuaaggacgaaauugucuccagcuuugagcgccccaugcaagcugccaucucuuccacauuccucaccagcgcuaauagacgggccaugcugaaaacgcuugggauuaucaacgacaaucugaagccuuccucuagcaccguguccgccgcuaaaguguuucgcagccucuga

SEQ ID NO: 7590 - RNA, 732 nt, Artificial Sequence
  derived and/or modified CDS sequence (opt5) from PTV(GML902876)__KP272012.1__N
augagcuacgaggaaaucgccgugcaguucgcuuccgagucuauugacgaacaagccgucgcgggcuggguuaccgauuuugcuuaucagggguucgacgccaagagagugaucgcccuggugaaagaucggggaggcgacgauuggaagcaggacgucaaaaagaugauugugcucagccugacacgcgggaacaaacccaauaagaugguucuuaagauguccgauaaaggaaaggcuauggugaacgagcugguccucaaauacaagcugaaaucuggcaauccuagcagagacgaucuuacgcugucccggaucaccgccgcuuuugccggguggacaugccaggcggccgacuaugugcaagaauaccucccgguuaccggacgcgcuauggaugccauuucuagcuccuaucccagagcuaugaugcacccuagcuucgccggccugaucgaccaggagcugcccgcggaugugcucucugagaucacacaggcccauugucuguuuaugauucaguucuccaagaccaucaacccuagccuucggggccugucuaaggacgaaauugucuccagcuuugagcgccccaugcaagcugccaucucuuccacauuccucaccagcgcuaauagacgggccaugcugaaaacgcuugggauuaucaacgacaaucugaagccuuccucuagcaccgccuccgcugcgaaaguguuucgcagccucuga

SEQ ID NO: 7591 - RNA, 732 nt, Artificial Sequence
  derived and/or modified CDS sequence (opt5) from PTV(Adames)__KP272030.1__N
augagcuacgaggaaaucgccgugcaguucgcuuccgagucuauugacgaacaagccgucgcgggcuggguuacccacuuugcuuaucagggguucgaugccaagagagugaucgcccuggugaaagagcggggaggcgaagacuggaagcaggaugucaaaaagaugauugugcucagccugacacgcgggaacaaacccaauaagaugguucuuaagauguccgacaaaggaaaggcuauggugaacgagcugguccucaaauacaagcugaaaucuggcaauccuagcagagaugaccuuacgcugucccggaucaccgccgcuuuugccggguggacaugccaggcggccgauuaugugcaagaguaccucccgguuaccggacgcgcuauggacacaauuucuagcggcuaucccagagccaugaugcauccuuccuucgcuggccugaucgaucaggaacugcccgccgacgugcucagcgagaucacccaggcgcacugucuguuuaugauucaguucucuaagacaaucaacccuucccuucgggggcugagcaaggaugaaauugucucuuccuuugagcgccccaugcaagccgcuaucagcucuaccuuccucacguccgccaauagacgggcuaugcugaaaacccuuggaauuaucaacgacaaucugaagccuagcuccucuacagugagcgccgccaaaguguuucgcucccucuga

SEQ ID NO: 7592 - RNA, 735 nt, Artificial Sequence
  derived and/or modified CDS sequence (opt5) from Phlebovirus(CoAr171616)__HM566153.1__N
augagcuacgaggaaaucgccgugaacuucgcuuccgagucuauugacgaaagcaccaucuccgccugggucucugauuuugcguaucagggcuucgacgcuaagagaguuauugcccugaucaaagagcgcgggggagaaaauuggaaggaggaugugaaaaagaugauugugcucagccugacacggggcaacaaacccgccaagaugauccuuaagauguccgacaaagggaagaaagaggucaaugaucugaucacgagauacaagcucaaaucuggaaacccuagccgggacgaucugacccuuucccgcguggcugccgcuuuugccggcuggacaugccaagcggccgaauauguucaggaguaccugccggugaccgggagagcuauggacgccuucagcgcugauuuuccccgggcccucaugcacccuucuuucgcgggacugauugaccaggaacugcccuccagcgccaugacagauaucguccaugcucacugucucuuuaugauucaguucucuaagaccaucaauccuacaauucgcuccgccagcaaggacgagaucguggcuucuuuugauagacccaugcaagccgccauuaacuccaccuuccugacgagcgcucagcggcgcgcgaugcuuaaaacccugggcguuaucaaugacaaccucaagguguccacagccgucucuagcgcugccaaagccuuuaagaaacugcaguga

SEQ ID NO: 7593 - RNA, 735 nt, Artificial Sequence
  derived and/or modified CDS sequence (opt5) from Phlebovirus(CoAr171616)__EF201836.1__N
augagcuacgaggaaaucgccauucacuucgcuuccgagucuaucgacgaaagcaccauuuccgccugggugucugauuuugcguaucagggcuucgacgcuaagagagucaucgcccugauuaaagagcgcgggggagaaaacuggaaggaggauguuaaaaagaugaucgugcucagccugacacggggcaauaaacccgccaagaugauccuuaagauguccgacaaagggaagaaagaggugaacgaucugauuacgagauacaagcucaaaucuggaaauccuagccgggacgaucugacccuuucccgcgucgcugccgcuuuugccggcuggacaugccaagcggccgaauaugugcaggaguaccugccgguuaccgggagagcuauggacgccuucagcgcugauuuuccccgggcccucaugcauccuucuuucgcgggacugaucgaccaggaacugcccuccagcgccaugacagauauugugcacgcucauugucucuuuaugauccaguucucuaagaccauuaacccuacaauccgcuccgccagcaaggacgagauugucgcuucuuuugauagacccaugcaagccgccaucaauuccaccuuccugacgagcgcucagcggcgcgcgaugcuuaaaacccugggcgugaucaacgacaaucucaagguuuccacagccgugucuagcgcugccaaagccuuuaagaaacugcaguga

SEQ ID NO: 7594 - RNA, 732 nt, Artificial Sequence
  derived and/or modified CDS sequence (opt5) from Phlebovirus(CoAr170255)__EF201840.1__N
augagcuacgaggaaaucgccauucaguucgcuuccgagucuguggacgccaccacaaucgcggcuugggucagcgaauuugccuaucaaggcuucgaugccagacagguuauuaaccuggugaagcagcgcgggggagacgauuggaaagaggacgugaagaaaaugaucguccucucccugacgcggggcaauaagcccucuaaaaugcuuaacaagaugagcgaauccgggcagaagauugugaaugaucugaucucuaaauacaagcucaaaagcggaaacccuggcagaaaugaccugacccuuucccggaucgcugccgcuuuugccggguggacaugccaagcggccgagguugugcaggauuaucugccggucaccggacgcgcuauggacgccauuagcgauaaguuccccagagcucucaugcacccuucuuuugccggccugguggaccccacacugccugagggcguuguggaagauaucguccaugcgcacugucucuucaugauucaguuuuccaaaaccaucaaccccagccugcggucuuccagcaagucugaggugguguccagcuucgaccgcccuaugcaggccgcuauuaauuccccguuucuuacagccgggaacagacgggauauccugaugucucucggacugauuaauagcaaccuuaagcccuccccugcugucaucgccgccgcuaaaguuuaccgcaagcuguga

SEQ ID NO: 7595 - RNA, 732 nt, Artificial Sequence
  derived and/or modified CDS sequence (opt5) from Buenaventura virus(CoAr3319)__KP272003.1__N
augagcuacgaggaaaucgccauucaguucgcuuccgagucuguggacgccaccacaaucgcggcuugggucagcgaauuugccuaucaaggcuucgaugccagacagguuauuaaccuggugaagcagcgcgggggagacgauuggaaagaggacgugaagaaaaugaucguccucucccugacgcggggcaauaagcccucuaaaaugcuuaacaagaugagcgaauccgggcagaagauugugaaugaucugaucucuaaauacaagcucaaaagcggaaacccuggcagaaaugaccugacccuuucccggaucgcugccgcuuuugccggguggacaugccaagcggccgagguugugcaggauuaucugccggucaccggacgcgcuauggacgccauuagcgauaaguuccccagagcucucaugcacccuucuuuugccggccugguggaccccacacugccugagggcguuguggaagauaucguccaugcgcacugucucuucaugauucaguuuuccaaaaccaucaaccccagccugcggucuuccagcaagucugaggugguguccagcuucgaccgcccuaugcaggccgcuauuaauuccccguuucuuacagccgggaacagacgggauauccugaugucucucggacugauuaauagcaaccuuaagcccuccccuaccgucguugcugccgccaaaguguaccgcaagcuguga

SEQ ID NO: 7596 - RNA, 732 nt, Artificial Sequence
  derived and/or modified CDS sequence (opt5) from Cocle virus(GML244915)__KP272035.1__N
augagcuacgaggaaaucgccgugcaguucgcuuccgagucuauugacgaacaagccgucgcgggcuggguuaccgauuuugcuuaucagggguucgacgccagacgggugaucgcccuggugaaggaucgcggaggcgaggacuggaaacaggaugucaagaaaaugauugugcucagccugacaagagggaacaagcccaauaaaaugguucuuaagauguccgacaagggaaaagcuauggugaacgaacugguccucaaguacaaacugaagucuggcaauccuagccgggaugaccuuacgcugucccgcaucaccgccgcuuuugccggguggacaugccaggcggccgauuaugugcaagaguaccucccgguuaccggcagagcuauggacgccauuucuagcggauauccccgggcuaugaugcacccuuccuucgccggccugaucgaucaggagcugcccgcggacgugcucagcgaaaucacacaggcccauugucuguuuaugauucaguucucuaaaaccaucaacccuucccuucgcgggcugggaaaggaugagauugucagcucuuuugaaagacccaugcaagcugccaucuccagcacauuccucaccucugcuaaucggcgcgccaugcugaagacgcuuggcauuaucaacgacaaucugaaaccuuccagcuccaccgugucugccgcuaagguguuuagaagccucuga

SEQ ID NO: 7597 - RNA, 732 nt, Artificial Sequence
  derived and/or modified CDS sequence (opt5) from Capira virus(VP-366G)__KP272044.1__N
augagcuacgaggaaaucgccauucaguucgcuuccgagucuaucgacgaaagcaccauugccgcguggguguccgauuuugcuuaucaaggcuucgacgccaagcaggucaucauucugaucaagaagagagggggagagaacuggaaagaagauguuaagaaaaugaucgugcucucucugacacggggcaauaagcccagcaagauggugaacaaaauguccgacgaggggaagaaagucgugaaugagcuuauuucuaaguacaaacugaagacgggaaacccugcccgcgaugaccucacccugagcagaaucgcugccgcuuuugccggcuggacaugccaggcggccgaauauguucaggauuaccuuccggugaccgggcgggcuauggacgcccuguccgauaaguauccccgcgcucucaugcacccuagcuucgccggacugauugaccccacacugccugaugacgcggucaaagauaucgugcaugcccacugucucuuuaugauucaauucucuaagaccaucaaucccucccugagaagcucuacaaaaaccgagauuguuaacuccuuugaccggccuaugcaggcugccaucaauagcccguuccuuacggcugaaaaccgcagagccaugcugaccacacucggcgugaucaauucuaaccugaagcccuccgccgcugucguggcggccgcuaaagccuaccggaaacuuuga

SEQ ID NO: 7598 - RNA, 732 nt, Artificial Sequence
  derived and/or modified CDS sequence (opt5) from Campana virus(VP-334K)__KP272042.1__N
augagcuacgaggaaaucgccauucaguucgcuuccgagucuguggacgccaccacaaucgcggcuugggucagcgaauuugccuaucaaggcuucgaugccagacagguuauuaaccuggugaagcagcggggaggagacgauuggaaagaggacgugaagaaaaugaucguccucucccugacgcgcggcaauaagcccucuagaauggugaccaaaaugagcgaauccgggcagaagauuguuaacgaucuuaucucuaaguacaaacugaagucuggaaauccuggccggaacgaccucacacugucccgcguggcugccgcuuuugccggguggaccugccaagcggccgaggucgugcaggauuaucuuccgguuacagggagagcuauggacgcccugagcgauaaauucccccgggcuaucaugcacccuucuuuugccggccucauugaccccacccugccugagaauguggucgaagauaucgugcaugcgcacugucuguucaugauucaguuuuccaagacaaucaaccccagccuccgcagcuccagcaaaucugagguggucuccagcuucgacagaccuaugcaggccgcuauuaauuccccguuucugaccgccgcuaaccggcgcgauaugcuuaugucucugggccucaucagcuccaaucugaagcccagcgccgccguuacggcugcggccaaggcuuacagaaaacuuuga

SEQ ID NO: 7599 - RNA, 738 nt, Artificial Sequence
  derived and/or modified CDS sequence (opt5) from RVFV(ZH-548)__DQ380151.1__N
auggacaacuaccaagagcuggccauccaauucgcugcccaggcgguggauagaaaugaaauugagcaguggguccgggaauuugcuuaucagggcuucgacgcccgcagaguuaucgagcuccugaagcaauacgggggagccgauugggaaaaagacgcuaagaaaaugauugugcuugcccugacccggggcaacaagccccgcagaaugaugaugaaaaugagcaaggaggggaaggcuacaguggaggcccucaucaauaaauauaagcugaaagaaggaaacccuucccgggaugagcuuacgcugucucgcgucgcggccgcucucgccggcuggaccugccaggcucuggugguucugagcgaauggcucccggugacagggaccacaauggacggacugucccccgccuacccuagacacaugaugcaucccucuuuugcgggcauggucgauccuagccuucccggcgacuaucugcgggccauucucgaugcucacucccuguaccuucugcaguucucucgcgugaucaauccuaaccucagagggcggaccaaggaggagguugccgcuacauuuacccagccgaugaaugccgccgugaacagcaauuucaucucccaugaaaaacgcagagaguuucugaaggcuuucggacuggucgacagcaacggcaagcccucugcggccgugauggcugccgcccaggcuuauaaaacggccgcguga

SEQ ID NO: 7600 - RNA, 738 nt, Artificial Sequence
  derived and/or modified CDS sequence (opt5) from RVFV(OV 35/74)__EF530207.1__N
auggacaacuaccaagagcuggccauccaauucgcugcccaggcgguggauagaaaugaaauugagcaguggguccgggaauuugcuuaucagggcuucgacgcccgcagaguuaucgagcuccugaagcaauacgggggagccgauugggaaaaagacgcuaagaaaaugauugugcuugcccugacccggggcaacaagccccgcagaaugaugaugaaaaugagcaaggaggggaaggcuacaguggaggcccucaucaauaaauauaagcugaaagaaggaaacccuucccgggaugagcuuacgcugucucgcgucgcggccgcucucgccggcuggaccugccaggcucuggugguucugagcgaauggcucccggugacagggaccacaauggacggacugucccccgccuacccuagacacaugaugcaucccucuuuugcgggcauggucgauccuagccuucccgaggacuaucugcgggccauucucgaugcucacucccuguaccuucugcaguucucucgcgugaucaauccuaaccucagaggccggaccaaggaggaaguugccgcuacauuuacccagccgaugaaugccgccgugaacagcaauuucaucucccaugagaaacgcagagaauuucugaaggcuuucgggcuggucgacagcaacggaaagcccucugcggccgugauggcugccgcccaggcuuauaaaacggccgcguga

SEQ ID NO: 7601 - RNA, 762 nt, Artificial Sequence
  derived and/or modified CDS sequence (opt5) from SFNV(Toscana)__NC_006318.1__N
augagcgacgagaacuacagagauaucgcccuggcuuuccucgacgaauccgccgauucuggcaccauuaaugcgugggugaacgaguuugcuuaucagggguucgaccccaagcggaucguccaacugguuaaagaacgcggaacagccaagggcagagauuggaaaaaggacgugaaaaugaugauugugcuuaaucugguccgggggaacaagccugaggccaugaugaagaaaaugagcgaaaagggagcuuccaucguggccaaucucauuucuguuuaccagcugaaagagggcaacccggggcgcgauacgaucacccuuagcagaguguccgcugccuuuguccccuggacagugcaggcgcugcggguucucucugagagccugccuguguccggaaccacaauggacgccaucgcuggcgucaccuauccccgcgccaugaugcacccuagcuucgcuggcauuaucgaucuggaccuccccaauggggccggagcgacaauugccgaugcucauggccuguuuaugaucgaguucucuaagaccauuaacccuucccuuagaacgaaacaggccaaugaaguggcugccaccuuugaaaagccgaacauggccgcuaugagcgggcgguucuuuacacgcgaggacaagaaaaagcugcucaucgcggugggaauuaucgaugaggaccugguccuugccucugcuguugugagauccgccgaaaaauaccgggccaaggugggcaaauga

SEQ ID NO: 7602 - RNA, 762 nt, Artificial Sequence
  derived and/or modified CDS sequence (opt5) from SFNV__HM566170.1__N
augagcgaggaaaacuacagagagaucgcccuggcuuuccucgacgaagccgcggauuccggcacaauuacagcuugggugaaugaguuugccuaucagggguucgaccccaagcggaucguccaacugguuaaagaacgcggaacggccaagggcagagauuggaaaaaggacgugaaaaugaugauugugcuuaaccugguccgggggaauaagccugaggcuaugaugaagaaaaugucugagaagggagccggcaucguggcucagcucauuagcguuuaccagcugaaagaagggaacccgggacgcgauaccaucacacuuuccagagugucugccgcguuuguccccuggaccauccaggcccugcgggugcucagcgacucccugccuguuacaggcaccacaauggaugcuauugccggcgugaccuauccccgcgcuaugaugcacccuucuuucgccgggaucauugaccuggaucuccccaauagagcgggagaggucaucgccgacgcucauggccuguuuaugcuugaguucagcaagacgauuaacccuucccugcggaccaaacaaccgaaugaaaucgccgcuacauuugagaagcccaacauggccgccaugagcgggcgcuucuuuaccagagaagauaagaaaaagcuccugauggcugugggcauucuuaaugaggaccuggugcucaccccugcgaucgucaaaugcgccgaaaaguacuguucuaaaguuggaaaguga

SEQ ID NO: 7603 - RNA, 735 nt, Artificial Sequence; identical to SEQ ID NO: 7592
  derived and/or modified CDS sequence (opt5) from SFNV(Namru)__HM566168.1__N

SEQ ID NO: 7604 - RNA, 762 nt, Artificial Sequence
  derived and/or modified CDS sequence (opt5) from SFNV(NAMRU 840055)__EF201828.1__N
augagcgaggaaaacuacagagagaucgcccuggcuuuccucgacgaagccgcggauuccggcaccauuacagcuugggugaaugaguuugccuaucagggguucgaccccaagcggaucguccaacugguuaaagaacgcggaacggccaagggcagagauuggaaaaaggacgugaaaaugaugauugugcuuaaccugguccgggggaauaagccugaggcuaugaugaagaaaaugucugagaagggagccggcaucguggcucagcucauuagcguuuaccagcugcgcgaagggaacccgggaagagauaccaucacacuuucccgggugucugccgcguuuguccccuggaccauccaggcccugaaagugcucagcgacucccugccuguuacaggcaccacaauggaugcuauugccggcguggucuauccccgcgcuaugaugcacccuucuuucgccgggaucauugaccuggaucuccccaauagagcgggagaggccaucgcugacgcccauggccuguuuaugcuugaguucagcaagaccauuaacccuucccugcggacgaaacaaccgaaugaaaucgcugccaccuuugagaagcccaacauggccgcuaugagcgggcgcuucuuuacaagagaagauaagaaaaagcuccugauggcggugggcauucuuaaugaggaccuggugcucaccccugccaucgucaaaugcgcugaaaaguaccggucuaaaguuggaaaguga

SEQ ID NO: 7605 - RNA, 762 nt, Artificial Sequence
  derived and/or modified CDS sequence (opt5) from SFNV(NAMRU 840055)__EF201829.1__N
augagcgaggaaaacuacagagagaucgcccuggcuuuccucgacgaagccgcggauuccggcacaauuacagcuugggugaaugaguuugccuaucagggguucgaccccaagcggaucguccaacugguuaaagaacgcggaacggccaagggcagagauuggaaaaaggacgugaaaaugaugauugugcuuaaccugguccgggggaauaagccugaggcuaugaugaagaaaaugucugagaagggagccggcaucguggcucagcucauuagcguuuaccagcugaaagaagggaacccgggacgcgauaccaucacacuuuccagagugucugccgcguuuguccccuggaccauccaggcccugcgggugcucagcgacucccugccuguuacaggcaccacaauggaugcuauugccggcgugaccuauccccgcgcuaugaugcacccuucuuucgccgggaucauugaccuggaucuccccaauagagcgggagaggccaucgcugacgcccauggccuguuuaugcuugaguucagcaagacgauuaacccuucccugcggaccaaacaaccgaaugaaaucgcugccacauuugagaagcccaacauggccgcuaugagcgggcgcuucuuuaccagagaagauaagaaaaagcuccugauggcggucggcauucuuaaugaggaccuggugcucaccccugccaucgugaaaugcgcugaaaaguacuguucuaaagucggaaaguga

SEQ ID NO: 7606 - RNA, 762 nt, Artificial Sequence
  derived and/or modified CDS sequence (opt5) from SFNV(P-7101795)__EF201830.1__N
augagcgaggaaaacuacagagagaucgcccuggcuuuccucaaugaagccgcggacuccggcaccauuacagcuugggugaacgaguuugccuaucagggguucgaucccaagcggaucguccaacugguuaaagaacgcggaacggccaagggcagagacuggaaaaaggaugugaaaaugaugauugugcuuaaucugguccgggggaacaagccugagaccaugaugaagaaaaugucugagaagggagcuggcaucguggcccagcucauuagcguuuaccagcugaaagaagggaauccgggacgcgacacaaucacccuuuccagagugucugcugccuuuguccccuggacagugcaggcgcugcggguucucagcgauucccugccugugaccggcacaaccauggacgccaucgcuggcgucacguauccccgcgccaugaugcacccuucuuucgcugggauuaucgaucuggaccuccccaacagagccggagagaccauugcggaugcccauggccuguuuaugcuugaguucagcaagacaaucaauccuucccugcggaccaaacaaccgaacgaaauugcugccacauuugagaagcccaauauggcugccaugagcgggcgcuucuuuaccagagaagacaagaaaaagcuccugauggccgugggagugcuuaacgaggaucugguccucacgccugcuaucguuaaaugcgcggaaaaguaccggucuaaagugggcaaguga

SEQ ID NO: 7607 - RNA, 762 nt, Artificial Sequence
  derived and/or modified CDS sequence (opt5) from SFNV(P-7101795)__EF201832.1__N
augagcgaggaaaacuacagagagaucgcccuggcuuuccucgacgaagccgcggauuccggcaccauuacagcuugggugaaugaguuugccuaucagggguucgaccccaagcggaucguccaacugguuaaagaacgcggaacggccaagggcagagauuggaaaaaggacgugaaaaugaugauugugcuuaaccugguccgggggaauaagccugaggcuaugaugaagaaaaugucugagaagggagccggcaucguggcucagcucauuagcguuuaccagcugcgcgaagggaacccgggaagagauaccaucacacuuucccgggugucugccgcguuuguccccuggaccauccaggcccugaaagugcucagcgacucccugccuguuacaggcaccacaauggaugcuauugccggcgugauguauccccgcgcuaugaugcacccuucuuucgccgggaucauugaccuggaucuccccaauagagcgggagaggccaucgcugacgcccauggccuguuuaugcuugaguucagcaagaccauuaacccuucccugcggacgaaacaaccgaaugaaaucgcugccaccuuugagaagcccaacauggccgcuaugagcgggcgcuucuuuacaagagaagauaagaaaaagcuccugauggcggucggcauucuuaaugaggaccuggugcucaccccugccaucaucaaaugcgcugaaaaguaccggucuaaagugggaaaguga

SEQ ID NO: 7608 - RNA, 762 nt, Artificial Sequence
  derived and/or modified CDS sequence (opt5) from Arrabida virus(PoSFPhlebV/126/2008)__KP863801.1__N
augagcgaggacaacuacagaaccaucgcccuggcuuuccucgaugaauccgccgacucuacaacgauuaaugcgugggugaacgaguuugcuuaucagggcuucgaucccaagcggaucguccaacugguuaaagaacgcgggaccgccaagggaagagacuggaaaaaggaugugaaaaugaugauugugcuuaaucugguccggggcaacaagccugagagcaugaugaagaaaauguccgaaaagggggccgcuaucgugacacagcucauuucuaccuaccagcugaaagagggaaauccgggccgcgacacaaucacccuuagcagaguuuccgccgcuuuugugcccuggacaguccaggcccugaagacccucucugagagccugccugugacggggaccacaauggauuccaucgcgggaaccacauauccccggugcaugaugcacccuagcuucgccggcauuaucgaccuggaacuccccaacaauaccggcgcuaugcuggccgaugcucaugggcuuuuuaugcuggaguucucuaaaacgauuaacccuucccuccgcacaaagcaaccgaaugaaaucgccgcgaccuuugagaagcccaacauggccgcuaugacaggaagauucuuuacccgggacgauaaaaagaaacugcuuauugccaucggcguucuggacgaggaucucgugccuaaucccgcuauugaaaagugugccgagaaauacaaggccaaagucgggaaguga

SEQ ID NO: 7609 - RNA, 765 nt, Artificial Sequence
  derived and/or modified CDS sequence (opt5) from Gordil virus(Dak ANBr 496d)__KF297902.1__N
augagcgaggaaaacuacagagagaucgccauggcuuucgccaaugacuccgcggauuuuaacaugauuucugugugggcuaaugacuucgccuaucagggcuuugaucccaagcggaucgucgaacugguucgccaaagagggcucgccaaagcucggaacuggaagcaggacgugaaaaugaugauugugcugaaucuuaugcgcggaaacaagccugaggccauggucagaaaaaugcaggaaaagggccagcggaucgugcuggagcucauuagcguuuacgagcugaaggaagggaauccgggacgcgauaccaucacacuuuccagagugucugcugccuucguccccuggacgaucauggcgcugcggcaacucgccgagaacauuccugugaccggcagcaucauggacuccauucuggauggggcuguuuauccccgcgccaugaugcacccuucuuuugcuggaaucauugaccuggaacuccccgagggcagaggcgccgagcuggcggaugcccaugggcuuuucaugaucgaauuuagcaaaacaauuaauccuucccugcggaccaagagcgcuaucgagaucgccgcuucuuucgaaaaaccgaacauggccgccaugacaggaaacuuuuucaccaaggacgauaaacgcaagcuccugaagcagauuggcauccuugacuccgaucugaaacucacacccgugauugagaaggcugcggcccuguacagaagcaaaaccaauaaguga

SEQ ID NO: 7610 - RNA, 762 nt, Artificial Sequence
  derived and/or modified CDS sequence (opt5) from Granada virus(GR25)__GU135608.1__N
augagcgaggacaacuacagaaccaucgcccuggcuuuccucgaugaauccgccgacucuacaacgauuaaugcgugggugaacgaguuugcuuaucagggcuucgaucccaagcggaucguccaacugguuaaagaacgcgggaccgccaagggaagagacuggaaaaaggaugugaaaaugaugauugugcuuaaucugguccggggcaacaagccugagagcaugaugaagaaaauguccgaaaagggggccgcuaucgugacacagcucauuucuaccuaccagcugaaagagggaaauccgggccgcgacacaaucacccuuagcagaguuuccgccgcuuuugugcccuggacaguccaggcccugaagacccucucugagagccugccugugacggggaccacaauggauuccaucgcgggaaccacauauccccggugcaugaugcacccuagcuucgccggcauuaucgaccuggaacuccccaacaauaccggcgcuaugcuggccgaugcucaugggcuuuuuaugcuggaguucucuaaaacgauuaacccuucccuccgcacaaagcaaccgaaugaaaucgccgcgaccuuugagaagcccaacauggccgcuaugacaggaagauucuuuacccgggacgauaaaaagaaacugcuuauugccaucggcguucugaaugaggaccucgugccuaaccccgcuauugaaaagugugccgagaaauacaaggccaaagucgggaaguga

SEQ ID NO: 7611 - RNA, 762 nt, Artificial Sequence
  derived and/or modified CDS sequence (opt5) from Massilia virus(127)__KT906102.1__N
augagcgaggacaacuacagaaccaucgcccuguccuuccucgaugaaacagcugugucuacgagcauuaaugccugcgucaacgaguuugcguaucagggcuucgaccccaagcggaucguucaacuggugaaagaacgcgggaccgcuaagggaagagauuggaaaaaggacgugaaaaugaugauuguccuuaaucuggugcggggcaacaagccugaguccaugaugaagaaaaugucugaaaagggggccgccaucguuacacagcucauuagcaccuaccagcugaaagagggaaauccgggccgcgauacaaucacccuuuccagagugucugcugccuuuguccccuggacagugcaggcucugaagacccucagcgagucccugccuguuacggggaccacaauggacagcaucgccggaaccacauauccccgguguaugaugcacccuucuuucgcgggcauuaucgaucuggaacuccccaacaauaccggcgccaugcuggcugacgcccaugggcuuuuuaugcuggaguucuccaaaacgauuaacccuagccuccgcacaaagcaaccgaaugaaaucgcugccaccuuugagaagcccaacauggcggccaugacaggaagauucuuuacccgggaugacaaaaagaaacugcuuauugcuaucggcgugcuggaugaggaccucgucccuaaucccgccauugaaaagugcgcugagaaauacaaggccaaaguggggaaguga

SEQ ID NO: 7612 - RNA, 762 nt, Artificial Sequence
  derived and/or modified CDS sequence (opt5) from Massilia virus(130)__KT906103.1__N
augagcgaggacaacuacagaaccaucgcccuguccuuccucgaugaaacagcugacucuacgagcauuaaugccugcgugaacgaguuugcguaucagggcuucgaucccaagcggaucguccaacugguuaaagaacgcgggaccgcuaagggaagagacuggaaaaaggaugugaaaaugaugauugugcuuaaucugguccggggcaacaagccugaguccaugaugaagaaaaugucugaaaagggggccgccaucgugacacagcucauuagcaccuaccagcugaaagagggaaauccgggccgcgacacaaucacccuuuccagaguuucugcugccuuugugcccuggacaguccaggcucugaagacccucagcgagucccugccugugacggggaccacaauggauagcaucgccggaaccacauauccccgguguaugaugcacccuucuuucgcgggcauuaucgaccuggaacuccccaacaauaccggcgccaugcuggcugaugcccaugggcuuuuuaugcuggaguucuccaaaacgauuaacccuagccuccgcacaaagcaaccgaaugaaaucgcugccaccuuugagaagcccaacauggcggccaugacaggaagauucuuuacccgggacgauaaaaagaaacugcuuauugcuaucggcguucuggacgaggaucucgugccuaaucccgccauugaaaagugcgcugagaaauacaaggccaaagucgggaaguga

SEQ ID NO: 7613 - RNA, 762 nt, Artificial Sequence
  derived and/or modified CDS sequence (opt5) from Naples virus(Yu 8/76)__JF920141.1__N
augagcgaggacgauuaccacaagaucgcccuggcuuucgccgaagaguccgcggacgugucuaccauugaaagcugggucaacgauuuugcuuaucagggcuucgaccccagacggaucguucaacucgugaaagagcgcgggacagccaagggaagagauuggaaaaaggacgugaaaaugaugauuguccugaaucuugugcggggcaacaagccugaagccaugaugaagaaaauguccgagaagggggcugccaucguugcucagcugauuucuguguaccagcucaaagagggaaauccgggccgcgauacgaucacccugagcagagucuccgccgcguuugugcccuggacaguucaggcccuucgggugcugucugaccaucucccugucaccgggacaaccauggaugcuaucgccggagugacauauccccgcgcuaugaugcacccuagcuucgccggcauuguggaccuggaacugcccagaaagaccggcgagaugaucgcggaugcccaugggcucuuuaugcuggaguucuccaaaacgauuaacccuagccuucggaccaagcaaccgaaugaaaucgcuacaaccuuugagaagcccaacauggccgcuaugucuggaaaauucuuuucccgcgaagacaagaaaaagcugcucaugagcgucggcauuaucaaugaugaccugcuucugacagccucuguugugaaaugcgccgagaaguacagagcuaaaaccgggaaguga

SEQ ID NO: 7614 - RNA, 762 nt, Artificial Sequence
  derived and/or modified CDS sequence (opt5) from Punique virus(P1_B4_2008)__FJ848987.1__N
augagcgaggaaaacuacagagagaucgcccuggcuuuccucgacgaauccgccgauucuggcaccauuagcacaugggugaaugacuuugcguaucagggguucgaucccaagcggaucguccaacugguuaaagagcgcggaacggcuaagggcagagacuggaaaaaggaugugaaaaugaugauugugcuuaaccugguccgggggaauaagccugaauccaugaugaagaaaaugucugagaagggagccgccaucguggcucagcucauugccgcuuaccagcugaaagagggcaacccggggcgcgacaccaucacacuuagcagaguuuccgccgcguuugugcccuggaccguccaggcccugcggucucucagcgauucccugccugugacaggaaccacaauggacagcaucgcuggcguuaccuauccccgcugcaugaugcacccuucuuucgccggcauuaucgaucuggaccuccccaaugauacgggggcuaugcuggccgacgcgcauggacuuuuuaugcuggaguucuccaagaccauuaacccuagccucagaacaaaacaagccaaugaaaucgcugccaccuuugaaaagccgaacauggcugccaugaauggccgguucuuuacacgcgaggauaagaaaaagcugcuuauugccaucggggugcugaacgaggaccucauucccgucucugcuaucgcgaaaugugccgaaaaguacagagcuaaagugggaaaguga

SEQ ID NO: 7615 - RNA, 762 nt, Artificial Sequence
  derived and/or modified CDS sequence (opt5) from Saint Floris virus(Dak ANB512)__JF920138.1__N
augagcgaggaaaccuacgcccagcuggcuauggccuuccucgcggagcccgcugacugguccacacugucugugugggucaacgaauuugccuaucaaggcuucgauccuaagagaaucguugagcuuauuauggaacgggggaaaaaguuuaaucgcgaguggaaaaaggacgugaaaaugaugaucacgcugaaccucauuagaggaaauaagccggaggccaugaugcggaagaugagcgauaaaggccgcuccaucgugucugaacugauuagcgucuacgagcuuaaggaagggaaccccggaagagacaccaucacacugucccgggugucugcugccuucguuccuuggaccgugcgcgcucucgucgcccugcagaaugaucugcccgugacaggcgcggccauggacagcaucugcgggguuaccuauccuagagcuaugaugcaccccuccuuugccggagugauugaucucgagcugccuaacggcgucggcgcucagcuugccgacgcgcaugggcuguucaugcucgaguuuagcaaaacaaucaauccgggacugcggaccaagcagcccaacgaaauugccgcuacguucgagaaaccuaaucuugccgcuaugaccggcaaguuuuucacaaaggaagauaaacgcaaggugcugaucucugugggggucauuaacuccgaccuccaacccaauagcguugugaaaaccugugccgagcuguacagagcccgggugaugaaguga

SEQ ID NO: 7616 - RNA, 762 nt, Artificial Sequence
  derived and/or modified CDS sequence (opt5) from Tehran virus(I-47)__JF939848.1__N
augagcgaggaagacuacagagccaucgcucuguccuucucugaugagagcgccgacgugggcauuaucaccacaugggucaacgaauuugcguaucagggguucgaucccaagcggauuguucaacucgugaaagagcgcggacaggcuaagggcagagacuggaaaaaggaugugaaaaugaugaucguccugaaucuuauucgggggaacaagccugacgccaugaugaagaaaauguccgaaaagggagccgcuacgguggcccagcugguuucuguguaccagcucaaagagggcaauccggggcgcgauaccaucacacugagcagagucuccgcugccuuugugcccuggaccguucaagcgcuuaaggugcugucugagagccucccugucacaggaaccacaauggacaccguggccggcgugacguauccccgggcuaugaugcacccuuccuucgccggcaucauugaucuggaacugcccgggcgcgcuggagaggccaucgcggacgcccauggccucuuuaugcuggaguucagcaaaaccauuaacccuucucuuagaacaaagcagccgaaugaaaucgcugccaccuuugagaagcccaacauggcugccaugacagggcgguucuuuacccgcgaagauaaaaagaaacugcucauugccgucggaaucauuaaugacgaucugcuucugacgccuuccaucgcuaagugcgcggagaaauacagagccaagguuggcaaauga

SEQ ID NO: 7617 - RNA, 762 nt, Artificial Sequence
  derived and/or modified CDS sequence (opt5) from Zerdali virus(37)__KP966618.1__N
augagcgaggaagacuacagagccaucgcucuguccuucucugaugaggccgcggacgugggcaccauuacagcuugggucaacgaauuugccuaucagggguucgaucccaagcggaucguucaacucgugcgcgagagaggaauugccaaaggccgggacuggaagaaagaugugaagaugaugaucguccugaaucuuauucgcgggaacaaaccugacgcuaugaugaagaagaugagcgaaaaaggagccgcuacgguggcccagcugguuuccguguaccagcucaaggagggcaauccggggagagauaccaucacacccucucgggucagcgcggccuuugugccuuggaccguucaggcucugaaagugcuuuccgagucucugcccgucacaggaaccacaauggacaccaucgccggcgugagcuauccucgcgcuaugaugcaccccuccuucgccggcauuaucgaucucgaacugccuagacgggcgggggaggugauugccgacgcucauggacuguuuaugcucgaguucagcaagacgaucaacccgucucugcgcaccaaacaacccaaugaaauugccgcuacauuugagaagccuaacauggccgccaugaccggcagauucuuuacacgggaagauaagaaaaagcugcuuaucgcugucgggauuaucaaugacgaucuccugcuugcgcccuccguugccaaaugcgcugagaaguaccgcgccaaagugggaaaguga

SEQ ID NO: 7618 - RNA, 762 nt, Artificial Sequence; identical to SEQ ID NO: 7601
  derived and/or modified CDS sequence (opt5) from TOSV(9028)__KU904263.1__N

SEQ ID NO: 7619 - RNA, 762 nt, Artificial Sequence
  derived and/or modified CDS sequence (opt5) from TOSV(SI-121283)__JF330274.1__N
augagcgacgagaacuacagagauaucgcccuggcuuuccucgacgaauccgccgauucuggcaccauuaaugcgugggugaacgaguuugcuuaucagggguucgaccccaagcggaucguccaacugguuaaagaacgcggaacagccaagggcagagauuggaaaaaggacgugaaaaugaugauugugcuuaaucugguccgggggaacaagccugaggccaugaugaagaaaaugagcgaaaagggagcuuccaucguggccaaucucauuucuguuuaccagcugaaagagggcaacccggggcgcgauacgaucacccuuagcagaguguccgcugccuuuguccccuggacagugcaggcgcugcggguucucucugagagccugccuguguccggaaccacaauggacgccaucgcuggcgucaccuauccccgcgccaugaugcacccuagcuucgcuggcauuaucgaucuggaccuccccaauggggccggagcgacaauugccgaugcucauggccuguuuaugaucgaguucucuaagaccauuaacccuucccuuagaacgaaacaggccaaugaaguggcugccaccuuugaaaacccgaauauggccgcuaugagcgggcgguucuuuacacgcgaggacaagaagaaacugcucaucgcggugggaauuaucgaugaggaccugguccuugccucugcuguugugagauccgccgaaaaguaccgggccaaagugggcaaguga

SEQ ID NO: 7620 - RNA, 762 nt, Artificial Sequence
  derived and/or modified CDS sequence (opt5) from TOSV(5963930705)__KU935733.1__N
augagcgacgagaacuacagagauaucgcccuggcuuuccucgacgaauccgccgauucuggcaccauuaaugcgugggugaacgaguuugcuuaucagggguucgaccccaagcggaucguccaacugguuaaagaacgcggaacagccaagggcagagauuggaaaaaggacgugaaaaugaugauugugcuuaaucugguccgggggaacaagccugaggccaugaugaagaaaaugagcgaaaagggagcuuccaucguggccaaucucauuucuguuuaccagcugaaagagggcaacccggggcgcgauacgaucacccuuagcagaguguccgcugccuuuguccccuggacagugcaggcgcugcggguucucucugagagccugccuguguccggaaccacaauggacgccaucgcuggcgucaccuauccccgcgccaugaugcacccuagcuucgcuggcauuaucgaucuggaccuccccaauggggccggagcgacaauugccgaugcucauggccuguuuaugguggaguucucuaagaccaucaacccuucccuuagaacgaaacaggccaaugaaguggcugccaccuuugaaaagccgaacauggccgcuaugagcgggcgguucuuuacacgcgaggacaagaaaaagcugcucauugcggucggaaucauugaugaggaccugguucuugccucugcuguggugagauccgccgaaaaauaccgggccaaggucggcaaauga

SEQ ID NO: 7621 - RNA, 762 nt, Artificial Sequence
  derived and/or modified CDS sequence (opt5) from TOSV(MRS2010-4319501)__KC776214.1__N
augagcgacgagaacuacagagauaucgcccuggcuuuccucgacgaauccgccgauucuggcaccauuaaugcgugggugaacgaguuugcuuaucagggguucgaccccaagcggaucguccaacugguuaaagaacgcggaacagccaagggcagagauuggaaaaaggacgugaaaaugaugauugugcuuaaucugguccgggggaacaagccugaggccaugaugaagaaaaugagcgaaaagggagcuuccaucguggccaaucucauuucuguuuaccagcugaaagagggcaacccggggcgcgauacgaucacccuuagcagaguguccgcugccuuuguccccuggacagugcaggcgcugcggguucucucugagagccugccuguguccggaaccacaauggacgccaucgcuggcgucaccuauccccgcgccaugaugcacccuagcuucgcuggcauuaucgaucugcaucuccccaauggggccggagcgacaauugccgacgcucacggccuguuuaugaucgaguucucuaagaccauuaacccuucccuuagaacgaaacaggccaaugaaguggcugccaccuuugaaaagccgaacauggccgcuaugagcgggcgguucuuuacacgcgaggauaagaaaaagcugcucaucgcggugggaauuaucgacgaggaucugguccuugccucugcuguugugagauccgccgaaaaauaccgggccaaggugggcaaauga

SEQ ID NO: 7622 - RNA, 762 nt, Artificial Sequence
  derived and/or modified CDS sequence (opt5) from TOSV(TOSV/Firenze.ITA/1983/2)__KM275765.1__N
augagcgacgagaacuacagagauaucgcccuggcuuuccucgacgaaugcgccgauuccggcaccauuaaugcgugggugaacgaguuugcuuaucagggguucgaccccaagcggaucguccaacugguuaaagaacgcggaacagccaagggcagagauuggaaaaaggacgugaaaaugaugauugugcuuaaucugguccgggggaacaagccugaggccaugaugaagaaaaugucugaaaagggagcuagcaucguggccaaucucauuuccguuuaccagcugaaagagggcaacccggggcgcgauacgaucacccuuucuagagugagcgcugccuuuguccccuggacagugcaggcgcugcggguucucuccgagucucugccugugagcggaaccacaauggacgccaucgcuggcgucaccuauccccgcgccaugaugcacccuuccuucgcuggcauuaucgaucuggaccuccccaauggggccggagcgacaauugccgaugcucauggccuguuuaugaucgaguucagcaagaccauuaacccuucucuuagaacgaaacaggccaaugaaguggcugccaccuuugaaaagccgaacauggccgcuauguccgggcgguucuuuacacgcgaggacaagaaaaagcugcucaucgcggugggaauuaucgaugaggaccugguccuugccagcgcuguugugagaucugccgaaaaauaccgggccaaggugggcaaauga

SEQ ID NO: 7623 - RNA, 738 nt, Artificial Sequence
  derived and/or modified CDS sequence (opt5) from SFTSV(HB29)__NC_018137.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugauggcccuccaggaaaaguaugggcugguggagcgggcugaaacacgccugagcaucaccccugucagaguggcccagucccucccgacauggaccugcgcugccgcggccgcucugaaagaguaccuucccguuggaccugccgugaugaaucugaaggucgagaacuaucccccugaaaugauguguauggcuuucggcucucucauccccacagccggcgugagcgaggcgaccacgaaaacccugauggaagccuacucccuuuggcaggaugcuuuuacaaagaccauuaauguuaagaugcgcggggccagcaaaacagagguguauaacucuuuccgggacccucugcacgcugccgucaauuccguguuuuucccgaacgaugugagagucaaguggcucaaagccaagggaauccugggccccgacgggguuccuagccgggcugcggaaguggccgcugccgccuaccgcaaucuguga

SEQ ID NO: 7624 - RNA, 738 nt, Artificial Sequence
  derived and/or modified CDS sequence (opt5) from SFTSV(111S)__KP339904.1__N
augagcgagugguccagaaucgccguggaguucggcgaacagcaacugaaccucaccgaacuggaggacuuugcucgggaacuugccuacgaggggcuggaucgcgcgcucauuaucaagaaacugaaggagacaggaggcgacgauugggucaaagacacgaaguucauuaucguuuuugcucuuaccagagggaauaaaauugugaaggccucuggaaagaugagcaacuccggcucuaaacggcugauggcccuccaggaaaaguaugggcugguggagcgcgcugaaacaagacugagcaucacccccguccggguggcccagucccucccuacauggaccugcgcugccgcggccgcucugaaagaguaccuuccgguuggacccgccgugaugaaucugaaggucgagaacuauccucccgaaaugauguguauggcuuucggcucucucaucccuacagccggcgugagcgaggcgaccacgaaaacccugauggaagccuacucccuuuggcaggaugcuuuuacaaagaccauuaauguuaagaugcgcggggccagcaaaacagagguguauaacucuuucagagacccccugcacgcugccgucaauuccguguuuuucccuaacgaugugcgggucaaguggcucaaagccaagggaauccugggcccggacgggguucccagccgcgcugcggaaguggccgcugccgccuacagaaaucuguga

SEQ ID NO: 7625 - RNA, 738 nt, Artificial Sequence
  derived and/or modified CDS sequence (opt5) from SFTSV(116S)__KP339905.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugauggcccuccaggaaaaguaugggcugguggagcgggcugaaacacgccugagcaucaccccugucagaguggcccagucccucccgacauggaccugcgcugccgcggccgcucugaaagaguaccuucccguuggaccugccgugaugaaucugaaggucgagaacuaucccccugaaaugauguguauggcuuucggcucucucauccccacagccggcgugagcgaggcgaccacgaaaacccugauggaagccuacucccuuuggcaggaugcuuuuacaaagaccauuaauguuaagaugcggggagccagcaaaacagagaucuauaacucuuuccgcgacccucugcacgcugccgucaauuccguguuuuucccgaacgaugugagagugaaguggcucaaagccaaggggauucugggccccgacggggucccuagccgggcugcggaaguugccgcugccgccuaccgcaaucuguga

SEQ ID NO: 7626 - RNA, 738 nt, Artificial Sequence
  derived and/or modified CDS sequence (opt5) from SFTSV(132S)__KP339912.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuucuguuuuugcucuuacccgcgggaauaaaaucgugaaggccagcggaaagauguccaacucuggcagcaaaagacugauggcccuccaggaaaaguaugggcugguggagcgggcugaaacacgccuguccauuaccccugucagaguggcccagucucucccgacauggaccugcgcugccgcggccgcucugaaagaguaccuucccguuggaccugccgugaugaaucugaaggucgagaacuaucccccugaaaugauguguauggcuuucggcagccucauccccacagccggcguguccgaggcgaccacgaaaacccugauggaagccuacagccuuuggcaggaugcuuuuacaaagaccaucaauguuaagaugcggggagccucuaaaacagagguguauaacuccuuccgcgacccucugcacgcugccgucaauagcguguuuuucccgaacgaugugagagucaaguggcucaaagccaaggggauucugggccccgacgggguuccuucucgggcugcggaaguggccgcugccgccuaccgcaaucuguga

SEQ ID NO: 7627 - RNA, 738 nt, Artificial Sequence
  derived and/or modified CDS sequence (opt5) from SFTSV(2014045S)__KR075923.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugauggcccuccaggaaaaguaugggcugguggagcgggcugaaacacgccugagcaucaccccugucagaguggcccagucccucccgacauggaccugcgcugccgcggccgcucugaaagaguaccuucccguuggaccugccgugaugaaucugaaggucgagaacuaucccccugaaaugauguguauggcuuucggcucucucauccccacagccggcgugagcgaggcgaccacgaaaacccugauggaagccuacucccuuuggcaggaugcuuuuacaaagaccauuaauguuaagaugcgcggggccagcaaaacagagguguauaacucuuuccgggacccucugcacgcugccgucaauuccguguuuuucccgaacgaugugagagucaaguggcucaaagccaagggaauccugggccccgacggggcuccuagccgggcggccgaaguugcugccgccgcuuaccgcaaucuguga

SEQ ID NO: 7628 - RNA, 738 nt, Artificial Sequence
  derived and/or modified CDS sequence (opt5) from SFTSV(2014193S)__KR075916.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugauggcccuccaggaaaaguaugggcugguggagcgggcugaaacacgccugagcgucaccccugugagaguugcccagucccucccgacauggaccugcgcugccgcggccgcucugaaagaguaccuucccgugggaccugccgucaugaaucugaagguggagaacuaucccccugaaaugauguguauggcuuucggcucucucauccccacagccggcguuagcgaggcgaccacgaaaacccugauggaagccuacucccuuuggcaggaugcuuuuacaaagaccaucaaugugaagaugcggggagccagcaaaacagaggucuauaacucuuuccgcgacccucugcacgcugccgucaauuccguguuuuucccgaacgaugugagaguuaaguggcucaaagccaaggggauucugggccccgacggggugccuagccgggcugcggaaguggccgcugccgccuaccgcaaucuguga

SEQ ID NO: 7629 - RNA, 738 nt, Artificial Sequence
  derived and/or modified CDS sequence (opt5) from SFTSV(2015SH232S)__KT736097.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugauggcccuccaggaaaaguaugggcugguggagcgggcugaaacacgccugagcaucaccccugucagaguggcccagucccucccgacauggaccugcgcugccgcggccgcucugaaagaguaccuucccguuggaccugccgugaugaaucugaaggucgagaacuaucccccugaaaugauguguauggcuuucggcucucucauccccacagccggcgugagcgaggcgaccacgaaaacccugauggaagccuacucccuuuggcaggaugcuuuuacaaagaccauuaauguuaagaugcgcggggccagcaaaacagagguguauaacucuuuccgggacccucugcacgcugccgucaauuccguguuuuucccgaacgaugugagaguccgguggcucaaggccaaaggaauccugggccccgacgggguuccuagccgcgcugcggaaguggccgcugccgccuacagaaaucuguga

SEQ ID NO: 7630 - RNA, 738 nt, Artificial Sequence
  derived and/or modified CDS sequence (opt5) from SFTSV(2015SYSH33)__KT380653.1__N
augagcgagugguccagaaucgccguggaguucggcgaacagcaacucaaccugaccgaacuugaggacuuugcucgggaacuggccuacgaggggcucgaucccgcgcugauuaucaagaaacuuaaggagacaggaggcgacgauugggucaaagacacgaaguucauuaucguuuuugcucugacccgcgggaauaaaauugugaaggccucuggaaagaugagcaacuccggcucuaaaagacucauggcccugcaggaaaaguaugggcugguggagcgggcugaaacacgccucagcaucaccccugucagaguggcccagucccugccgacauggaccugcgcugccgcggccgcucuuaaagaguaccugcccguuggaccugccgugaugaaucucaaggucgagaacuaucccccugaaaugauguguauggcuuucggcucucugauccccacagccggcgugagcgaggcgaccacgaaaacccuuauggaagccuacucccuguggcaggaugcuuuuacaaagaccauuaauguuaagaugcgcggggccagcaaaacagagguguauaacucuuuccgggacccucuccacgcugccgucaauuccguguuuuucccgaacgaugugagagucaaguggcugaaagccaagggaauccugggccccgacgggguuccuagccgggcugcggaaguggccgcugccgccuaccgcaaucucuga

SEQ ID NO: 7631 - RNA, 738 nt, Artificial Sequence
  derived and/or modified CDS sequence (opt5) from SFTSV(2015SYSH86)__KT380657.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauuaucaaggccucuggaaagaugagcaacuccggcucuaaaagacugauggcccuccaggaaaaguaugggcugguggagcgggcugaaacacgccugagcaucaccccugugagagucgcccagucccucccgacauggaccugcgcugccgcggccgcucugaaagaguaccuucccgugggaccugccguuaugaaucugaagguggagaacuaucccccugaaaugauguguauggcuuucggcucucucauucccacagccggcgucagcgaggcgaccacgaaaacccugauggaagccuacucccuuuggcaggaugcuuuuacaaagaccaucaaugugaagaugcggggagccagcaaaacagagguuuauaacucuuuccgcgacccucugcacgcugccgucaauuccguguuuuucccgaacgaugugagagugaaguggcucaaagccaaggggauucugggccccgacggggucccuagccgggcugcggaaguugccgcugccgccuaccgcaaucuguga

SEQ ID NO: 7632 - RNA, 738 nt, Artificial Sequence
  derived and/or modified CDS sequence (opt5) from SFTSV(67S)__KP339890.1__N
augagcgagugguccagaaucgccguggaguucgcugaacagcaacugaaccucaccgaacuggaggacuuugcccgggaacuugcguacgagggccuggaucccgcucucauuaucaagaaacugaaggagacagggggagacgauugggucaaagacacgaaguucauuaucguuuuugcccuuacccgcggcaauaaaauugugaaggccucugggaagaugagcaacuccggaucuaaaagacugauggcucuccaggaaaaguauggccugguggagcgggccgaaacacgccugagcaucaccccugucagaguggcucagucccucccgacauggaccugcgccgcggccgcugcccugaaagaguaccuucccguugggccugcugugaugaaucugaaggucgagaacuaucccccugaaaugauguguauggccuucggaucucucauccccacagcgggcgugagcgaggccaccacgaaaacccugauggaggcuuacucccuuuggcaggaugccuuuacaaagaccauuaauguuaagaugcggggcgcuagcaaaacagaaguguauaacucuuuccgcgacccucugcacgccgccgucaauuccguguuuuucccgaacgaugugagagucaaguggcucaaagcuaaggggauccugggacccgacggcguuccuagccgggcggccgaaguggcugccgccgcuuaccgcaaucuguga

SEQ ID NO: 7633 - RNA, 738 nt, Artificial Sequence
  derived and/or modified CDS sequence (opt5) from SFTSV(6S)__KP339927.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugauggcccuccaggaaaaguaugggcugguggagcgggcugaaacacgcuucagcaucaccccugucagaguggcccagucccugccgacauggaccugcgcugccgcggccgcucucaaagaguaccugcccguuggaccugccgugaugaaucuuaaggucgagaacuaucccccugaaaugauguguauggcuuuuggcucucugauccccacagccggcgugagcgaggcgaccacgaaaacccucauggaagccuacucccuguggcaggaugcuuucacaaagaccauuaauguuaagaugcgcggggccagcaaaacagagguguauaacucuuuucgggacccucuucacgcugccgucaauuccguguucuuuccgaacgaugugagagucaaguggcugaaagccaagggaauccucggccccgacgggguuccuagccgggcugcggaaguggccgcugccgccuaccgcaaucuguga

SEQ ID NO: 7634 - RNA, 738 nt, Artificial Sequence
  derived and/or modified CDS sequence (opt5) from SFTSV(72S)__KP339891.1__N
augagcgagugguccagaaucgccguggaguucggcgaacagcaacugacccucacagaacuggaggacuuugcucgggaacuugccuacgaggggcuggaucccgcgcucauuaucaagaaacugaaggagacgggaggcgacgauugggucaaagacaccaaguucauuaucguuuuugcucuuacacgcgggaacaaaauugugaaggccucuggaaagaugagcaauuccggcucuaaaagacugauggcccuccaggaaaaguaugggcugguggagcgggcugaaacccgccugagcaucacaccugucagaguggcccagucccucccgaccuggacaugcgcugccgcggccgcucugaaagaguaccuucccguuggaccugccgugaugaaccugaaggucgagaauuaucccccugaaaugauguguauggcuuucggcucucucauccccaccgccggcgugagcgaggcgacgaccaaaacacugauggaagccuacucccuuuggcaggaugcuuuuaccaagacaauuaacguuaagaugcgcggggccagcaaaaccgagguguauaauucuuuccgggacccucugcacgcugccgucaacuccguguuuuucccgaaugaugugagaguccgguggcucaaggccaaaggaauccugggccccgacgggguuccuagccgcgcugcggaaguggccgcugccgccuacagaaaccuguga

SEQ ID NO: 7635 - RNA, 738 nt, Artificial Sequence
  derived and/or modified CDS sequence (opt5) from SFTSV(AP01-Korea-13)__KR612072.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauuggguccgcgacacgaaauucauuaucguuuuugcucuuaccagagggaauaagauugugaaagccucuggaaagaugagcaacuccggcucuaagcggcugauggcccuccaggaaaaauaugggcugguggagcgcgcugaaacaagacugagcaucaccccuguccggguggcccagucccucccgacauggaccugcgcugccgcggccgcucugaaggaguaccuucccguuggaccugccgugaugaaucugaaagucgagaacuaucccccugaaaugauguguauggcuuucggcucucucauccccacagccggcgugagcgaggcgaccacgaagacccugauggaagccuacucccuuuggcaggaugcuuuuacaaaaaccauuaauguuaagaugcgcggggccagcaagacagagguguauaacucuuucagagacccucugcacgcugccgucaauuccguguuuuucccgaacgaugugcgggucaaauggcucaaggccaaaggaauccugggccccgacgggguuccuagccgcgcugcggaaguggccgcugccgccuacagaaaucuguga

SEQ ID NO: 7636 - RNA, 738 nt, Artificial Sequence
  derived and/or modified CDS sequence (opt5) from SFTSV(JP03-Korea-13)__KR612079.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauuggguccgcgacacgaaauucauuaucguuuuugcucuuaccagagggaauaagauugugaaagccucuggaaagaugagcaacuccggcucuaagcggcugauggcccuccaggaaaaauaugggcugguggagcgcgcugaaacaagacugagcaucaccccuguccggguggcccagucccucccgacauggaccugcgcugccgcggccgcucugaaggaguaccuucccguuggaccugccgugaugaaucugaaagucgagaacuaucccccugaaaugauguguauggcuuucggcucucucauccccacagccggcgugagcgaggcgaccacgaagacccugauggaagccuacucccuuuggcaggaugcuuuuacaaaaaccauuaauguuaagaugcgcggggccagcaagacagagguguauaacucuuucagagacccucugcacgcugccgucaauuccguguuuuucccgaacgaugugcgggucaaauggcucaaggccaaaggaauccugggccccgacgggauuccuagccgcgcugcggaaguugccgcugccgccuacagaaaucuguga

SEQ ID NO: 7637 - RNA, 738 nt, Artificial Sequence
  derived and/or modified CDS sequence (opt5) from SFTSV(JP07-Korea-13)__KR612088.1__N
augagcgagugguccagaaucgccguggaguucggcgaacaccagcugaaccucaccgaacuggaggacuuugcucgggaacuugccuacgaggggcuggaucccgcgcucauuaucaagaaacugaaggagacaggaggcgacgauuggguccgcgacacgaaauucauuaucguuuuugcucuuaccagagggaauaagauugugaaagccucuggaaagaugagcaacuccggcucuaagcggcugauggcccuccaagaaaaauaugggcugguggagcgcgcugaaacaagacugagcaucaccccuguccggguggcccagucccucccgacauggaccugcgcugccgcggccgcucugaaggaguaccuucccguuggaccugccgugaugaaucugaaagucgagaacuaucccccugaaaugauguguauggcuuucggcucucucauccccacagccggcgugagcgaggcgaccacgaagacccugauggaagccuacucccuuuggcaggaugcuuuuacaaaaaccauuaauguuaagaugcgcggggccagcaagacagagguguauaacucuuucagagacccucugcaugcugccgucaauuccguguuuuucccgaacgaugugcgggucaaauggcucaaggccaaaggaauccugggccccgacgggguuccuagccgcgcugcggaaguggccgcugccgccuacagaaaucuguga

SEQ ID NO: 7638 - RNA, 738 nt, Artificial Sequence
  derived and/or modified CDS sequence (opt5) from SFTSV(JS2011-13-2)__KR230790.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcuccucuggcagcaaaagacugauggcccuccaggaaaaguaugggcugguggagcgggcugaaacacgccuguccaucaccccugucagaguggcccagucucucccgacauggaccugcgcugccgcggccgcucugaaagaguaccuucccguuggaccugccgugaugaaccugaaggucgagaauuaucccccugaaaugauguguauggcuuucggcagccucauccccacagccggcguguccgaggcgaccacgaaaacccugauggaagccuacagccuuuggcaggaugcuuuuacaaagaccauuaacguuaagaugcgcggggccucuaaaacagagguguauaauuccuuccgggacccucugcacgcugccgucaacagcguguuuuucccgaaugaugugagagucaaguggcucaaagccaagggaauccugggccccgacgggguuccuucucgggcugcggaaguggccgcugccgccuaccgcaaccuguga

SEQ ID NO: 7639 - RNA, 738 nt, Artificial Sequence
  derived and/or modified CDS sequence (opt5) from SFTSV(JS2014-15)__KR230799.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugauggcccuccaggaaaaguaugggcugguggagcgggcugaaacacgccugagcaucaccccugucagaguggcccagucccucccgacauggaccugcgcugccgcggccgcucugaaagaguaccuucugguuggacccgccgugaugaaucucaaggucgagaacuauccucccgaaaugauguguauggcuuucggcucucugaucccuacagccggcgugagcgaggcgaccacgaaaacccuuauggaagccuacucccuguggcaggaugcuuuuacaaagaccauuaauguuaagaugcgcggggccagcaaaacagagguguauaacucuuuccgggacccccuccacgcugccgucaauuccguguuuuucccuaacgaugugagagucaaguggcugaaagccaagggaauccugggcccggacgggguucccagccgggcugcggaaguggccgcugccgccuaccgcaaucucuga

SEQ ID NO: 7640 - RNA, 738 nt, Artificial Sequence
  derived and/or modified CDS sequence (opt5) from SFTSV(KASJH)__KP663733.1__N
augagcgagugguccagaaucgccguggaguucggcgaacagcaacugaaccucucugaacuggaggacuuugcucgggaacuugccuacgaggggcuggaucccgcgcucauuaucaagaaacugaaggagaccggaggcgacgauugggucaaagacacaaaguucauuaucguuuuugcucuuacgcgcgggaauaaaauugugaaggccagcggaaagauguccaacucuggcagcaaaagacugauggcccuccaggaaaaguaugggcugguggagcgggcugaaacccgccuguccaucacaccugucagaguggcccagucucucccgaccuggacaugcgcugccgcggccgcucugaaagaguaccuucccguuggaccugccgugaugaaucugaaggucgagaacuaucccccugaaaugauguguauggcuuucggcagccucauccccaccgccggcguguccgaggcgacaaccaaaacgcugauggaagccuacagccuuuggcaggaugcuuuuaccaagacaauuaauguuaagaugcgcggggccucuaaaaccgagguguauaacuccuuccgggacccucugcacgcugccgucaauagcguguuuuucccgaacgaugugagagucaaguggcucaaagccaagggaauccugggccccgacgggguuccuucucgggcugcggaaguggccgcugccgccuaccgcaaucuguga

SEQ ID NO: 7641 - RNA, 738 nt, Artificial Sequence
  derived and/or modified CDS sequence (opt5) from SFTSV(YSH116)__KT721303.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugauggcccuccaggaaaaguaugggcugguggagcgggcugaaacacgccugagcaucaccccugucagaguggcccagucccucccgacauggaccugcgcugccgcggccgcucugaaagaguaccuucccguuggaccugccgugaugaaucugaaggucgagaacuaucccccugaaaugauguguauggcuuucggcucucucauccccacagccggcgugagcgaggcgaccacgaaaacccugauggaagccuacucccuuuggcaggauguuuuuacaaagaccauuaaugugaagaugcgcggggcuagcaaaacagaggucuauaacucuuuccgggacccucugcacgccgcugucaauuccguguuuuucccgaacgaugugagaguuaaguggcucaaagccaagggaauccugggccccgacggggugccuagccgggccgcugaaguggcggccgcugccuaccgcaaucuguga

SEQ ID NO: 7642 - RNA, 738 nt, Artificial Sequence
  derived and/or modified CDS sequence (opt5) from SFTSV(AH-YTY/China/05/2012)__KR017811.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugauggcccuccaggaaaaguaugggcugguggagcgggcugaaacacgccugagcaucaccccugucagaguggcccagucccucccgacauggaccugcgcugccgcggccgcucugaaagaguaccuucccguuggaccugccgugaugaaucugaaggucgagaacuaucccccugaaaugauguguauggcuuucggcucucucauccccacaaccggcgugagcgaggccacgaccaaaacacugauggaagcguacucccuuuggcaggaugccuuuaccaagacaauuaauguuaagaugcgcggggcuagcaaaaccgagguguauaacucuuuccgggacccucugcacgccgcugucaauuccguguuuuucccgaacgaugugagagucaaguggcucaaagccaagggaauccugggccccgacgggguuccuagccgggccgcugaaguggcggccgcugccuaccgcaaucuguga

SEQ ID NO: 7643 - RNA, 738 nt, Artificial Sequence
  derived and/or modified CDS sequence (opt5) from SFTSV(DS02/CHN/2013)__KR698319.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauuggguccgcgacacgaaauucauuaucguuuuugcucuuaccagagggaauaagauugugaaagccucuggaaagaugagcaacuccggcucuaagcggcugauggcccuccaggaaaaauaugggcugguggagaaggcugaaacacgccugagcaucaccccugucagaguggcccagucccucccgacauggaccugcgcugccgcggccgcucugaaagaguaccuucccguuggaccugccgugaugaaucugaaggucgagaacuaucccccugaaaugauguguauggcuuucggcucucucauccccacagccggcgugagcgaggcgaccacgaaaacccugauggaagccuacucccuuuggcaggaugcuuuuacaaagaccauuaauguuaagaugcgcggggccagcaaaacagagguguauaacucuuuccgggacccucugcacgcugccgucaauuccguguuuuucccgaacgaugugagagucaaguggcucaaagccaagggaauccugggccccgacgggguuccuagccgggcugcggaaguggccgcugccgccuaccgcaaucuguga

SEQ ID NO: 7644 - RNA, 738 nt, Artificial Sequence
  derived and/or modified CDS sequence (opt5) from SFTSV(HB2014-13)__KU738908.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugauggcccuccaggaaaaguaugggcugguggagcgggcugaaacacgccugagcaucaccccugucagaguggcccagucccucccgacauggaccugcgcugccgcggccgcucugaaagaguaccuucccguuggaccugccgugaugaaucugaaggucgagaacuaucccccugaaaugauguguauggcuuucggcucucucauccccacaaccggcgugagcgaggccacgaccaaaacacugauggaagcguacucccuuuggcaggaugccuuuaccaagacaauuaauguuaagaugcgcggggcuagcaaaaccgagguguauaacucuuuccgggacccucugcacgccgcugucaauuccguguuuuucccgaacgaugugagaguccgguggcucaaggccaaaggaauccugggccccgacgggguuccuagccgcgccgcugaaguggcggccgcugccuacagaaaucuguga

SEQ ID NO: 7645 - RNA, 738 nt, Artificial Sequence
  derived and/or modified CDS sequence (opt5) from SFTSV(HB2014-20)__KU738910.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugaugacacuccaggaaaaguaugggcugguggagcgggccgaaacccgccugagcaucacaccugucagaguggcucagucccucccgaccuggacaugcgccgcugccgcggcccugaaagaguaccuucccguuggaccugcugugaugaaucugaaggucgagaacuaucccccugaaaugauguguauggccuucggcucucucauccccaccgcuggcgugagcgaggccacgaccaaaacacugauggaagcguacucccuuuggcaggaugccuuuaccaagacaauuaauguuaagaugcgcggggcuagcaaaaccgagguguauaacucuuuccgggacccucugcacgccgcugucaauuccguguuuuucccgaacgaugugagagucaaguggcucaaagccaagggaauccugggccccgacgggguuccuagccgggccgcugaaguggcggccgcugccuaccgcaaucuguga

SEQ ID NO: 7646 - RNA, 738 nt, Artificial Sequence
  derived and/or modified CDS sequence (opt5) from SFTSV(LN2012-14)__KF887431.1__N
augagcgagagaucccggaucgccguggaguucggcgaacagcaacugaaccucaccgggcuggaagacuuugcucgcgagcuugccuacgaaggacuggaucccgcgcucauuaucaagaaacugaaggagacaggcggggacgauugggucaaagacacgaaguucauuaucguuuuugcucuuaccagaggaaauaaaauugugaaggccucuggcaagaugagcaacuccgggucuaaacggcugauggcccuccaggagaaguauggacugguggaacgcgcugagacaagacugagcaucaccccuguccggguggcccagucccucccgacauggaccugcgcugccgcggccgcucugaaagaauaccuucccguuggcccugccgugaugaaucugaaggucgagaacuaucccccugagaugauguguauggcuuucggcucucucauccccacagccggggugagcgaagcgaccacgcgcacccugauggaggccuacucccuuuggcaggaugcuuuuacaaaaaccauuaauguuaagaugagaggagccagcaagacagaaguguauaacucuuuccgggacccucugcacgcugccgucaauuccguguuuuucccgaacgaugugcgcgucaaauggcucaaggccaaaggcauccuggggcccgacggaguuccuagcagagcugcggagguggccgcugccgccuaccggaaucuguga

SEQ ID NO: 7647 - RNA, 738 nt, Artificial Sequence
  derived and/or modified CDS sequence (opt5) from SFTSV(NB31/CHN/2013)__KR698325.1__N
augagcgagugguccagaaucgccguggaguucggcgaacagcaacugaaccucauugaacuggaggacuuugcucgggaacuugccuacgaggggcuggaucccgcgcucaucauuaagaaacugaaggagaccggaggcgacgauuggguccgcgacacaaaauucaucauuguuuuugcucuuacgagagggaauaagaucgugaaagccucuggaaagaugagcaacuccggcucuaagcggcugauggcccuccaggaaaaauaugggcugguggagaaggcugaaacccgccugagcaucacaccugucagaguggcccagucccucccgaccuggacaugcgcugccgcggccgcucugaaagaguaccuucccguuggaccugccgugaugaaucugaaggucgagaacuaucccccugaaaugauguguauggcuuucggcucucucauucccaccgccggcgugagcaaaccuacaaccaagacgcugauggaggcguacucccuuuggcaggaugccuuuaccaagacaaucaauguuaaaaugcggggagcuagcaagaccgaaguguauaacucuuuccgcgacccgcugcacgccgcugucaauuccguguuuuuccccaacgaugugagagucaaauggcucaaggccaaagggauucugggcccugacgggguucccagccgggccgcugagguggcggccgcugccuaccgcaaucuguga

SEQ ID NO: 7648 - RNA, 738 nt, Artificial Sequence
  derived and/or modified CDS sequence (opt5) from SFTSV(QD7)__KR706565.1__N
augagcgagugguccagaaucgccguggaguucggcguccagcaacugaaccucaccgaacuggaagacuuugcucgggagcuugccuacgaagggcuggaucccgcgcucauuaucaagaaacugaaggagacaggaggcgacgauuggguuaaagacacgaaguucauuaucguguuugcucuuacccgcgggaauaaaauugugaaggccucuggaaagaugagcaacuccggcucuaaaagacugauggcccuccaggagaaguaugggcuggucgaacgggcugagacacgccugagcaucaccccugugagaguugcccagucccucccgacauggaccugcgcugccgcggccgcucugaaagaauaccuucccgugggaccugccgucaugaaucugaagguggagaacuaucccccugagaugauguguauggcuuucggcucucucauccccacagccggcguuagcgaagcgaccacgaaaacccugauggaggccuacucccuuuggcaggaugcuuuuacaaagaccauuaaugugaagaugcgcggggccagcaaaacagaagucuauaacucuuuccgggacccucugcacgcugccgucaauuccguguuuuucccgaacgaugugagaguuaaguggcucaaagccaagggaauccugggccccgacggggugccuagccgggcugcggagguggccgcugccgccuaccgcaaucuguga

SEQ ID NO: 7649 - RNA, 738 nt, Artificial Sequence
  derived and/or modified CDS sequence (opt5) from SFTSV(SDLZP06/2011)__JQ693009.1__N
augagcgagugguccagaaccgccguggaguucggcgaacagcaacugaaccucacagaacuggaggacuuugcucgggaacuugccuacgaggggcuggaucccgcgcucaucauuaagaaacugaaggagacgggaggcgacgauugggucaaagacaccaaguucaucauuguuuuugcucuuacacgcgggaauaaaaucgugaaggccucuggaaagaugagcaacuccggcucuaaaagacugauggcccuccaggaaaaguaugggcugguggagcgggcugaaacccgccugagcauuacaccugucagaguggcccagucccucccgaccuggacaugcgcugccgcggccgcucugaaagaguaccuucccguuggaccugccgugaugaaucugaaggucgagaacuaucccccugaaaugauguguauggcuuucggcucucucauccccaccgccggcgugagcgaggcgacgaccaaaacacugauggaagccuacucccuuuggcaggaugcuuuuaccaagacaaucaauguuaagaugcggggagccagcaaaaccgagguguauaacucuuuccgcgacccucugcacgcugccgucaauuccguguuuuucccgaacgaugugagagucaaguggcucaaagccaaggggauucugggccccgacgggguuccuagccgggcugcggaaguggccgcugccgccuaccgcaaucuguga

SEQ ID NO: 7650 - RNA, 738 nt, Artificial Sequence
  derived and/or modified CDS sequence (opt5) from SFTSV(ZJZHSH-FDE/China/06/2012)__KR017821.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauuggguccgcgacacgaaauucauuaucguuuuugcucuuaccagagggaauaagauugugaaagccucuggaaagaugagcaacuccggcucuaagcggcugauggcccuccaggaaaaauaugggcugguggagaaggcugaaacacgccugagcaucaccccugucagaguggcccagucccucccgacauggaccugcgcugccgcggccgcucugaaagaguaccuucccguuggaccugccgugaugaaucugaaggucgagaacuaucccccugaaaugauguguauggcuuucggcucucucauccccacagccggcgugagcgaggcgaccacgaaaacccugauggaagccuacucccuuuggcaggaugcuuuuacaaagaccauuaauguuaagaugcgcggggccagcaaaacagagguguauaacucuuuccgggacccucugcacgcugccgucaauuccgugcucuuuccgaacgaugugagagucaaguggcugaaagccaagggaauccugggccccgacgggguuccuagccgggcugcggaaguggccgcugccgccuaccgcaaucucuga

SEQ ID NO: 7651 - RNA, 738 nt, Artificial Sequence
  derived and/or modified CDS sequence (opt5) from SFTSV(ZJZHSH-FZHR/China/07/2013)__KR017824.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauuggaugaaagacacgaaguucauuaucgucuuugcucuuacccgcgggaauaaaauuguuaaggccucuggaaagaugagcaacuccggcucuaaaagacugauggcccuccaggaaaaguaugggcugguggagcgggcugaaacacgccugagcaucaccccugugagagucgcccagucccucccgacauggaccugcgcugccgcggccgcucugaaagaguaccuucccgugggaccugccguuaugaaucugaagguggagaacuaucccccugaaaugauguguauggcuuucggcucucucauccccacagccggcgucagcgaggcgaccacgaaaacccugauggaagccuacucccuuuggcaggaugcuuuuacaaagaccauuaaugugaagaugcgcggggccagcaaaacagagguuuauaacucuuuccgggacccucugcacgcugccgucaauuccguguuuuucccgaacgaugugagagugaaguggcucaaagccaagggaauccugggccccgacggggucccuagccgggcugcggaaguugccgcugccgccuaccgcaaucuguga

SEQ ID NO: 7652 - RNA, 738 nt, Artificial Sequence
  derived and/or modified CDS sequence (opt5) from SFTSV(ZJZHSH-HYC/China/05/2012)__KR017809.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauuggguccgcgacacgaaauucauuaucguuuuugcucuuaccagagggaauaagauugugaaagccucuggaaagaugagcaacuccggcucuaagcggcugauggcccuccaggaaaaauaugggcugguggagaaggcugaaacacgccugagcaucaccccugucagaguggcccagucccucccgacauggaccugcgcugccgcggccgcucugaaagaguaccuucccguuggaccugccgugaugaaucugaaggucgagaacuaucccccugaaaugauguguauggcuuucggcucucucauccccacagugggcguuagcgaggccaccacgaaaacccugauggaagcguacucccuuuggcaggaugccuuuacaaagaccauuaaugugaagaugcgcggggcuagcaaaacagaggucuauaacucuuuccgggacccucugcacgccgcugucaauuccguguuuuucccgaacgaugugagaguuaaguggcucaaagccaagggaauccugggccccgacggggugccuagccgggccgcugaaguggcggccgcugccuaccgcaaucuguga

SEQ ID NO: 7653 - RNA, 738 nt, Artificial Sequence
  derived and/or modified CDS sequence (opt5) from SFTSV(SPL003A)__AB817996.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauuggguccgcgacacgaaauucauuaucguuuuugcucuuaccagagggaauaagauugugaaagccucuggaaagaugagcaacuccggcucuaagcggcugauggcccuccaggaaaaauaugggcugguggagcgcgcugaaacaagacugagcaucaccccuguccggguggcccagucccucccgacauggaccugcgcugccgcggccgcucugaaggaguaccuucccguuggaccugccgugaugaaucugaaagucgagaacuaucccccugaaaugauguguauggcuuucggcucucucauccccacagccggcgugagcgaggcgaccacgaagacccugauggaagccuacucccuuuggcaggaugcuuuuacaaaaaccauuaauguuaagaugcgcggggccagcaagacagagguguauaacucuuucagagacccucugcacgcugccgucaauuccguguuuuucccgaacgaugugcgggucaaauggcucaaggccaaaggaauccugggccccgacggggcuccuagccgcgcggccgaaguugcugccgccgcuuacagaaaucuguga

SEQ ID NO: 7654 - RNA, 738 nt, Artificial Sequence
  derived and/or modified CDS sequence (opt5) from SFTSV(SPL077A)__AB985536.1__N
augagcgaguggcccagaaucgccguggaguucggcgaacagcaacugaaccucaccgaacuggaggacuuugcucgggaacuugccuacgaggggcuggauccugcgcucauuaucaagaaacugaaggagacaggaggcgacgauuggguccgcgacacgaaauucauuaucguuuuugcucuuaccagagggaauaagauugugaaagccuccggaaagaugucuaacagcggcuccaagcggcugauggcccuccaggaaaaauaugggcugguggagcgcgcugaaacaagacugucuaucaccccgguccggguggcccagagccuccccacauggaccugcgcugccgcggccgcucugaaggaguaccuuccuguuggacccgccgugaugaaucugaaagucgagaacuauccucccgaaaugauguguauggcuuucggcucccucaucccuacagccggcgugucugaggcgaccacgaagacccugauggaagccuacagccuuuggcaggaugcuuuuacaaaaaccauuaauguuaagaugcgcggggccuccaagacagagguguauaacagcuucagagacccgcugcacgcugccgucaauucuguguuuuuccccaacgaugugcgggucaaauggcucaaggccaaaggaauccugggcccugacgggguucccucccgcgcugcggaaguggccgcugccgccuacagaaaucuguga

SEQ ID NO: 7655 - RNA, 738 nt, Artificial Sequence
  derived and/or modified CDS sequence (opt5) from SFTSV(SPL106A)__AB985548.1__N
augagcgacugguccagaaucgccguggaguucggcgaacagcaacugaaccucaccgagcuggaagauuuugcucgggagcuugccuacgaagggcuggaccccgcgcucauuaucaagaaacugaaggagacaggaggcgaugacuggguccgcgauacgaaauucauuaucguuuuugcucuuaccagagggaauaagauugugaaagccucuggaaagaugagcaacuccggcucuaagcggcugauggcccuccaggagaaauaugggcugguggaacgcgcugagacaagacugagcaucaccccuguccggguggcccagucccucccgacauggaccugcgcugccgcggccgcucugaaggaauaccuucccguuggaccugccgugaugaaucugaaagucgagaacuaucccccugagaugauguguauggcuuucggcucucucauccccacagccggcgugagcgaagcgaccacgaagacccugauggaggccuacucccuuuggcaggacgcuuuuacaaaaaccauuaauguuaagaugcgcggggccagcaagacagaaguguauaacucuuucagagauccucugcacgcugccgucaauuccguguuuuucccgaacgacgugcgggucaaauggcucaaggccaaaggaauccugggccccgaugggguuccuagccgcgcugcggagguggccgcugccgccuacagaaaucuguga

SEQ ID NO: 7656 - RNA, 738 nt, Artificial Sequence
  derived and/or modified CDS sequence (opt5) from SFTSV(SPL114A)__AB985552.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauuggguccgcgacacgaaauucauuaucguuuuugcucuuaccagagggaauaagauugugaaagccccuggaaagaugucuaacagcggcuccaagcggcugauggcccuccaggaaaaauaugggcugguggagcgcgcugaaacaagacugucuaucaccccgguccggguggcccagagccuccccacauggaccugcgcugccgcggccgcucugaaggaguaccuuccuguuggacccgccgugaugaaucugaaagucgagaacuauccucccgaaaugauguguauggcuuucggcucccucaucccuacagccggcgugucugaggcgaccacgaagacccugauggaagccuacagccuuuggcaggaugcuuuuacaaaaaccauuaauguuaagaugcgcggggccuccaagacagagguguauaacagcuucagagacccgcugcacgcugccgucaauucuguguuuuuccccaacgaugugcgggucaaauggcucaaggccaaaggaauccugggcccugacgggguucccucccgcgcugcggaaguggccgcugccgccuacagaaaucuguga

SEQ ID NO: 7657 - RNA, 738 nt, Artificial Sequence
  derived and/or modified CDS sequence (opt5) from SFTSV(SPL125A)__AB985557.1__N
augagcgagugguccggcguggccgucgaguucggggaacagcaacugaaccucaccgaacuggaggacuuugcuagagaacuugccuacgagggacuggaucccgcgcucaucauuaagaaacugaaggagacaggcggggacgauuggguucgggacacgaaauucaucauuguguuugcucuuacccgcggaaauaagaucgugaaagccucuggcaagaugagcaacuccgggucuaagagacugauggcccuccaggaaaaauauggacuggucgagcgggcugaaacacgccugagcauuaccccugugagaguugcccagucccucccgacauggaccugcgcugccgcggccgcucugaaggaguaccuucccgugggcccugccgucaugaaucugaaaguggagaacuaucccccugaaaugauguguauggcuuucggcucucucauccccacagccgggguuagcgaggcgaccacgaagacccugauggaagccuacucccuuuggcaggaugcuuuuacaaaaaccaucaaugugaagaugcggggagccagcaagacagaggucuauaacucuuuccgcgacccucugcacgcugccgucaauuccguguuuuucccgaacgaugugagaguuaaauggcucaaggccaaaggcauucuggggcccgacggagugccuagccgggcugcggaaguggccgcugccgccuaccgcaaucuguga

SEQ ID NO: 7658 - RNA, 738 nt, Artificial Sequence
  derived and/or modified CDS sequence (opt5) from SFTSV(SPL160A)__AB985571.1__N
augagcgagugguccagaaucgccguggaguucggcgaacagcaacugaaccucaccgaacuggaggacuuugcucgggaacuugccuacgaggggcuggaucccgcgcucauuaucacaaagcugaaagagacgggaggcgacgauuggguccgcgacaccaaguucauuaucguuuuugcucuuacaagagggaauaaaauugugaaggccucuggaaaaaugagcaacuccggcucuaagcggcugauggcccuccaggaaaaguaugggcugguggagcgcgcugaaaccagacugagcaucacaccuguccggguggcccagucccucccgaccuggacaugcgcugccgcggccgcucugaaagaguaccuucccguuggaccugccgugaugaaucugaaggucgagaacuaucccccugaaaugauguguauggcuuucggcucucucauccccaccgccggcgugagcgaggcgacgaccaaaacacugauggaagccuacucccuuuggcaggaugcuuuuaccaagacaauuaauguuaaaaugcgcggggccagcaagaccgagguguauaacucuuucagagacccucugcacgcugccgucaauuccguguuuuucccgaacgaugugcgggucaaguggcucaaagccaagggaauccugggccccgacgggguuccuagccgcgcugcggaaguggccgcugccgccuacagaaaucuguga

SEQ ID NO: 7659 - RNA, 738 nt, Artificial Sequence
  derived and/or modified CDS sequence (opt5) from SFTSV(SPL163A)__AB985573.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauuggguccgcgacacgaaauucauuaucguuuuuccucuuaccagagggaauaagauugugaaggcuucuggaaaaaugagcaacuccggcucuaagcggcugauggcccuccaggaaaaauaugggcugguggagcgcgccgaaacaagacugagcaucaccccgguccggguggcucagucccuccccacauggaccugcgccgcugccgcggcccugaaggaguaccuuccuguuggacccgcugugaugaaucugaaagucgagaacuauccucccgaaaugauguguauggccuucggcucucucaucccuacagcuggcgugagcgaggccaccacgaagacccugauggaagcguacucccuuuggcaggaugccuuuacaaaaaccauuaauguuaagaugcgcggggcuagcaagacagagguguauaacucuuucagagacccgcugcacgccgcugucaauuccguguuuuuccccaacgaugugcgggucaaauggcucaaggccaaaggaauccugggcccugacgggguucccagccgcgccgcugaaguggcggccgcugccuacagaaaucuguga

SEQ ID NO: 7660 - RNA, 738 nt, Artificial Sequence
  derived and/or modified CDS sequence (opt5) from SFTSV/FTLSV(2011YPQ12)__KF711915.1__N
augagcaagugguccagaaucgccguggaguucggcgaacagcaacugaaccucaccgagcuggaagacuuugcucgggagcuugccuacgaagggcuggaucccgcgcucauuaucaaaaagcugaaagagacaggaggcgacgauugggucaaggacacgaaauucauuaucguuuuugcucuuacccgcgggaauaagauugugaaggccucuggaaaaaugagcaacuccggcucuaagagacugauggcccuccaggagaaauaugggcugguggaacgggcuaagacacgccugagcaucaccccugucagaguggcccagucccucccgacauggaccugcgcugccgcggccgcucugaaagaguaccuucccguuggaccugccgugaugaaucugaaggucgaaaacuaucccccugagaugauguguauggcuuucggcucucucauccccacagccggcgugagcgaggcgaccacgaagacccugauggaagccuacucccuuuggcaggaugcuuuuacaaaaaccauuaauguuaagaugcgcggggccagcaaaacagagguguauaacucuuuccgggacccucugcacgcugccgucaauuccguguuuuucccgaacgaugugagagucaaguggcucaaagccaagggaauccugggccccgacgggguuccuagcaaagcugcggaaguggccgcugccgccuaccggaaucuguga

SEQ ID NO: 7661 - RNA, 738 nt, Artificial Sequence
  derived and/or modified CDS sequence (opt5) from SFTSV/FTLSV(2011YXX9)__KF711898.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugauggcccuccaggaaaaguaugggcugguggagcgggcugaaacacgccugagcaucaccccugucagaguggcccagucccucccgacauggaccugcgcugccgcggccgcucugaaagaguaccuucccguuggaccugccgugaugaaucugaaggucgagaacuaucccccugaaaugauguguauggcuuucggcucucucauccccacagccggcgugagcgaggcgaccacgaaaacccugguugaagccuacucccuuuggcaggaugcuuuuacaaagaccauuaaugugaagaugcgcggggccagcaaaacagaggucuauaacucuuuccgggacccucugcacgcugccgucaauuccguguuuuucccgaacgaugugagaguuaaguggcucaaagccaagggaauccugggccccgacggggugccuagccgggcugcggaaguggccgcugccgccuaccgcaaucuguga

SEQ ID NO: 7662 - RNA, 738 nt, Artificial Sequence
  derived and/or modified CDS sequence (opt5) from SFTSV/FTLSV(YPQ2)__KF356519.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugauggcccuccaggaaaaguaugggcugguggagcgggcugaaacacgccugagcaucaccccugucagaguggcccagucccucccgacauggaccugcgcugccgcggccgcucugaaagaguaccuucccguuggaccugccgugaugaaucugaaggucgagaacuaucccccugaaaugauguguauggcuuucggcucucucauccccacagccggcgugagcgaggcgaccacgaaaacccugauggaagccuacucccuuuggcaggaugcuuuuacaaagaccauuaauguuaagaugcgcggggccagcaaaacagagguguauaacucuuuccgggacccucugcacgcugccgucaauuccguguuuuucccgaacgaugugagagucaaguggcucaaagccaagggaauccugggccccaaugggguuccuagccgggcugcggaaguggccgcugccgccuaccgcaaccuguga

SEQ ID NO: 7663 - RNA, 738 nt, Artificial Sequence
  derived and/or modified CDS sequence (opt5) from SFTSV/Guertu virus(DXM)__KT328591.1__N
augagcgagugguccaagaucgccguggaguucggcgaacagcaacugaacgucauugaacucgaggaauuugcuagagagcuggccuacgaggggcuugaccccgcgcugaucauuaaaaagcucaaagaaguuggaggcgaugacuggaugcgggauaccaaguucaucauuguguuugcucugacacgcgggaauaaaauccuuaaggccgccggaaagaugucuaacagcggcuccaaaagaaucauggcucugcaggagaaguaugggcucguggaacgggccgagacgcgccugucuauuaccccugucagaguggcucagagccugccgacauggaccugcuccgccgcggccgcucuccaggaguaccugcccguuggaccugccgugaugucucuuaaagucagcaauuuucccccugaaaugauguguauggcuuucggcucccugauccccgccacaggcgugccugagagcaccacaaagauucucauggaagcguauucucuguggcaagacgccuucaccaaaacgaucaacguuaagaugcggggagcuuccaaggccgagguguacaauagcuuucgcgauccgcuucacgcugccgucaacucuguguucuuucccaaugacgugagacugcgguggcucaaauccaaggggauucugggcccugaugggcugcccagcaaagccgucgaaaccgcugcggccgcuuaucgcaaccucuga

SEQ ID NO: 7664 - RNA, 738 nt, Artificial Sequence
  derived and/or modified CDS sequence (opt5) from SFTSV/Huaiyangshan virus(2010-FQM)__HQ419240.1__N
augagcgagugguccagaaucgccgugaaguucggcgaacagcaacugaaccucaccgagcuggaagacuuugcucgggagcuugccuacgaagggcuggaucccgcgcucauuaucaaaaagcugaaagagacaggaggcgacgauugggucaaggacacgaaauucauuaucguuuuugcucuuacccgcgggaauaagauugugaaggccucuggaaaaaugagcaacuccggcucuaagagacugauggcccuccaggagaaauaugggcugguggaacgggcugagacacgccugagcaucaccccugucagaguggcccagucccucccgacauggaccugcgcugccgcggccgcucugaaggaauaccuucccguuggaccugccgugaugaaucugaaagucgagaacuaucccccugagaugauguguauggcuuucggcucucucauccccacagccggcgugagcgaagcgaccacgaagacccugauggaggccuacucccuuuggcaggaugcuuuuacaaagaccauuaauguuaaaaugcgcggggccagcaagacagaaguguauaacucuuuccgggacccucugcacgcugccgucaauuccguguuucucccgaacgaugugagagucaaauggcugaaggccaaaggaauccugggccccgacgggguuccuagccgggcugcggagguggccgcugccgccuaccgcaaucucuga

SEQ ID NO: 7665 - RNA, 738 nt, Artificial Sequence
  derived and/or modified CDS sequence (opt5) from SFTSV/Huaiyangshan virus(2010-ZGQ)__HQ419241.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugaugagccuccaggaaaaguaugggcugguggagcgggccgaaacacgccuguccaucaccccugucagaguggcucagucucucccgacauggaccugcgccgcugccgcggcccugaaagaguaccuucccguuggaccugcugugaugaaucugaaggucgagaacuaucccccugaaaugauguguauggccuucggcagccucauccccacagcuggcguguccgaggccaccacgcggacccugauggaagcguacagccuuuggcaggaugccuuuacaaaaaccauuaauguuaagaugcgcggggcuucuaagacagagguguauaacuccuucagagacccucugcacgccgcugucaauagcguguuuuucccgaacgaugugcgggucaaauggcucaaggccaaaggaauccugggccccgacgggguuccuucucgcgccgcugaaguggcggccgcugccuacagaaaucuguga

SEQ ID NO: 7666 - RNA, 738 nt, Artificial Sequence
  derived and/or modified CDS sequence (opt5) from SFTSV/Huaiyangshan virus(S-HGX)__HQ171192.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugauggcccuccaggaaaaguaugggcugguggagcgggcugaaacacgccugagcaucaccccugucagaguggcccagucccucccgacauggaccugcacagcugccgcggcccugaaagaguaccuucccguuggaccugcugugaugaaucugaaggucgagaacuaucccccugaaaugauguguauggccuucgagucucucauccccaccgcuggcgugagcgaagccacgaccaaaacacugauggaggcguacucccuuuggcaggaugccuuuaccaagacaauuaauguugaaaugcggggcgcuagcaagaccgagguguauaacucuuuccgcgacccucugcacgccgcugucaauuccguguuuuucccgaacgaugugagagucaaauggcucaaggccaaagggauccugggacccgacggcguuccuagccgggccgcugagguggcggccgcugccuaccgcaaucuguga

SEQ ID NO: 7667 - RNA, 738 nt, Artificial Sequence
  derived and/or modified CDS sequence (opt5) from SFTSV/Huaiyangshan virus(S-HZM)__HQ171193.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacggaguucauuaucguuuuugcucuuacccgcgggaauaagauugugaaagccucuggaaagaugagcaacuccggcucuaagagacugauggcccuccaggaaaaauaugggcugguggaacgggcugagacacgccugagcaucaccccugucagaguggcccagucccucccgacauggaccugcgcugccgcggccgcucugaaggaguaccuucccguuggaccugccgugaugaaucugaaagucgaaaacuaucccccugagaugauguguauggcuuucggcucucucauccccacaaccggcgugagcgaagccacgaccaagacacugauggaggcguacucccuuuggcaggaugccuuuaccaaaacaauuaauguuaagaugcgcggggcuagcaagaccgaaguguauaacucuuuccgggacccucugcacgccgcugucaauuccguguuuuucccgaacgaucucagagugaaauggcugaaggccaaaggaauccugggccccgacggggucccuagccgggccgcugagguugcggccgcugccuaccgcaaucucuga

SEQ ID NO: 7668 - RNA, 738 nt, Artificial Sequence
  derived and/or modified CDS sequence (opt5) from SFTSV/Huaiyangshan virus(S-WJ)__HQ171191.1__N
augagcgagugguccagaaucgccguggaguucggcgaacagcaacugaaccucaccgaacuggaggacuuugcucgggaacuugccuacgaggggcugggacccgcgcucauuaucaagaaacugaaggagacaggcggggaugacugggucaaagauacgaaguucauuaucguuuuugcucuuacccgcggaaauaaaauugugaaggccucuggcaagaugagcaacuccgggucuaaaagacugauggcccuccaggaaaaguauggacugguggagcgggcugaaacacgccugagcaucaccccugucagaguggcccagucccucccgacauggaccugcgcugccgcggccgcucugaaagaguaccuucccguuggcccugccgugaugaaucugaaggucgagaacuaucccccugaaaugauguguauggcuuucggcucucucauccccacagccggggugagcgaggcgaccacgaaaacccugauggaagccuacucccuuuggcaggacgcuuuuacaaagaccauuaauguuaagaugcggggagccagcaaaacagagguguauaacucuuuccgcgauccucugcacgcugccgucaauuccguguuuuucccgaacgacgugagagucaaguggcucaaagccaagggcauccuggggcccgauggaguuccuagccgggcugcggaaguggccgcugccgccuaccgcaaucuguga

SEQ ID NO: 7669 - RNA, 738 nt, Artificial Sequence
  derived and/or modified CDS sequence (opt5) from SFTSV/Phlebovirus(JS2010-019)__JQ317180.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugauggcccuccaggaaaaguaugggcugguggagcgggcugaaacacgccugagcaucaccccugucagaguggcccagucccucccgacauggaccugcgcugccgcggccgcucugaaagaguaccuucccguuggaccugccgugaugaaucugaaggucgagaacuaucccccugaaaugauguguauggcuuucggcucucucauccccacagccggcgugagcgaggcgaccacgaaaacccugauggaagccuacucccuuuggcaggaugcuuuuacaaagaccauuaauguuaagaugcgcggggccagcaaaacagagguguauaacucuuuccgggacccucugcacgcugccgucaauuccguguuuuucccgaacgaugugagagucaaguggcucaaagccaagggaauccugggccccgacgggguuccuagccgggcugcggaagccgcugccgccgcuuaccgcaaucuguga

SEQ ID NO: 7670 - RNA, 738 nt, Artificial Sequence
  derived and/or modified CDS sequence (opt5) from SFTSV/Phlebovirus(SD24/China/2010 strain SD24)__HM802205.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugauggcccuccaggaaaaguaugggcugguggagcgggcugaaacacgccugagcaucaccccugucagaguggcccagucccucccgacauggaccugcgcugccgcggccgcucugaaagaguaccuucccguuggaccugccgugaugaaucugaaggucgagaacuaucccccugaaaugauguguauggcuuucggcucucucauccccacagccggcgugaccgaggcgacgaccaaaacacugauggaagccuacagccuuuggcaggaugcuuuuaccaagacaauuaauguuaagaugcgcggggccuccaaaaccgagguguauaacagcuuccgggacccucugcacgcugccgucaauucuguguuuuucccgaacgaugugagagucaaguggcucaaagccaagggaauccugggccccgacgggguuccuucccgggcugcggaaguggccgcugccgccuaccgcaaucuguga

SEQ ID NO: 7671 - RNA, 738 nt, Artificial Sequence
  derived and/or modified CDS sequence (opt5) from SFTSV/Phlebovirus(ZJ1/China/2011)__HE663216.1__N
augagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauuggguccgcgacacgaaauucauuaucguuuuugcucuuaccagagggaauaagauugugaaagccucuggaaagaugagcaacuccggcucuaagcggcugauggcccuccaggaaaaauaugggcugguggagaaggcugaaacacgccugagcaucaccccugucagaguggcccagucccucccgacauggaccugcgcugccgcggccgcucugaaagaguaccuucccguuggaccugccgugaugaaucugaaggucgagaacuaucccccugaaaugauguguauggcuuucggcucucucauccccacagccggcgugagcgaggcgaccacgaaagcccugauggaggcuuacucccuuuggcaggaugccuuuaccaagacaauuaauguuaagaugcgcggggcuagcaaaaccgaaguguauucuuccuuccgggacccucugcacgccgccgucaacagcguguuuuucccgaaugaugugagagucaaguggcucaaagcuaagggaauccugggccccgacgggguuccuucucgggcggccgaaguggcugccgccgcuuaccgcaaccuguga

SEQ ID NO: 7672 - RNA, 1287 nt, Artificial Sequence
  derived and/or modified CDS sequence (opt11) from ANDV(Chile-9717869)__AF291702.1__N
auguccacccuccaagaacuccaagaaaacaucacagcacacgagcaacaacucguaacugcccgucaaaaacucaaagacgcggaaaaagccgucgaagucgaccccgacgacgucaauaaauccacccuccaaucacgccgcgccgcagucagcacccucgaaaccaaacucggcgaacucaaacgacaacuagccgaccucguagcagcccaaaaacucgcaaccaaacccguagaccccaccggacuagaacccgacgaccaccucaaagaaaaauccucccuaagauacggcaacguccucgacgucaacagcaucgaccuagaggaaccaagcggccaaacagcagacuggaaagccaucggcgccuacauccuaggauucgccaucccaaucauacucaaagcccucuacaugcuuuccacacgcggacgccaaacgguuaaagacaacaaaggcacacgaauaagauuuaaagacgacagcuccuucgaagaagucaacggcauccgcaaacccaaacaccucuacguaucaaugcccaccgcccaauccaccaugaaagccgaagaaaucacacccggccgauucagaacaaucgccugcggacucuucccggcccaagucaaagcccgaaacaucauaucccccgucaugggagucaucggcuucggcuucuucgucaaagacuggauggaccgcaucgaagaguuccucgccgccgaaugcccauucuuaccaaaaccgaaagucgccuccgaggcuuucaugucuacgaacaaaauguacuuccucaacagacaacgccaagucaacgaaucaaaaguccaagacauaaucgacuuaaucgaccaugcagaaacagaauccgccacccucuucaccgaaauagccacaccccacagcgucugggucuucgccugcgcccccgaccgaugcccaccaaccgcccuauauguagccggcguacccgaacucggcgccuucuucucaauccuccaagacaugaggaacaccaucauggcauccaaaucaguaggcaccgccgaagaaaagcuaaagaagaaaagcgcauucuaccaaagcuaccuacgacgcacccaaucaaugggaauccaacucgaccagaaaaucauaauccuauacaugcucuccuggggaaaagaagcaguaaaccacuuccaccuaggcgacgacauggaccccgaacuccgccaacucgcccaaucacucaucgacacuaaaguaaaagagauauccaaccaagaaccacucaaacuauaa

SEQ ID NO: 7673 - RNA, 1287 nt, Artificial Sequence
  derived and/or modified CDS sequence (opt11) from ANDV(Nort)__AF325966.1__N
auguccacccuccaagaacuacaagaaaacaucacagcccacgagcaacaacucgucacagcccgacaaaaacucaaagacgcugagaaaaccgucgaaguagaccccgacgaagucaacaaaagcacccuccaaagccgccgugccgccguaagcacacucgaaaccaaacucggcgaacuuaaacgccaacuagccgaccuagucgccgcccaaaaacucgccaccaaacccgucgacccaaccggccucgaacccgacgaccaccuaaaagagaaaagcucacuccgcuacggaaacguucuagacgucaacucaaucgaccucgaagaacccuccggacaaaccgccgacuggaaagccaucggagccuacauacuaggauucgcaauccccaucauacucaaagcacuauacaugcuaucaacccgcggacgacaaaccgucaaagauaacaaaggcacccgcauuagauucaaagacgacagcagcuucgaagaaguaaacggcauccgcaaaccaaaacaucuuuacgucucaaugccaaccgcccagucaacaaugaaagccgaagaaaucacacccggacgcuucaggaccauagccugcggacuuuuccccgcccaagucaaggcacgcaacauaauaagccccgucaugggagucaucggcuuuuccuucuucgucaaagacuggauggaacgaaucgaagacuuccuagccgccgaaugcccauuccuccccaaacccaaagcacucuccgaagcauucauggcaacuaacaaggccuacuuccucaaccggcaacgacaaguaaacgacaguaagguccaagacauaguagaccucaucgaccacgccgaaaucgaauccgccacucucuucaccgacaucgccacaccccacagcgucuggguauucgccugcgcacccgacagaugcccacccaccgcccuauacgucgccggcguccccgaacucggcgccuucuucgccauccuacaggacaugcgcaacaccaucauggccuccaaauccgucggcaccgccgaagaaaaacucaaaaagaaaagcgcguucuaccaaucauaccuccgccgcacacaauacaugggcauccaacucgaccagaaaaucaucauacucuacaugcuauccuggggcaaagaagccguaaaccauuuccaccuaggcgacgacauggacccggagcucagacaacuagcccaaucccuaaucgacacaaaaguaaaagaaauaagcaaccaagaaccacucaaacucuaa

SEQ ID NO: 7674 - RNA, 1287 nt, Artificial Sequence
  derived and/or modified CDS sequence (opt11) from ANDV(CHI-7913)__AY228237.1__N
auguccacucuccaagaacuccaagaaaacaucacagcccacgaacaacaacucguuacagcccgccaaaaacuaaaagaugcagaaaaagccguagaagucgacccagacgacguaaacaaaucaacccuacaaaaccgucgagccgccgucuccacccucgaaaccaaacuaggagagcucaaaagacaacuagccgaccucgucgccgcccaaaaacucgcuacaaaacccguggaucccaccggacucgagccagacgaccaccucaaagaaaaaucaucccuccgcuacggaaacguacucgacguaaacucaaucgaccucgaagaaccaagcggacaaacagcagacuggaaagccaucggcgccuacauccucggauucgccauccccaucauccuaaaagcccucuacaugcucucaacccgaggccgacaagcaguaaaagacaacaaaggcacccgcauaagauucaaagacgauucauccuucgaagaagucaacggcauccgcaaacccaaacaccucuacguaucaaugccaaccgcccaauccaccaugaaagccgaagaaaucacgccaggccgauucagaaccauugccugcggccucuuccccgcacaagucaaagcacgcaacaucaucucacccgucaugggagucauuggcuucggcuucuucgucaaagacuggauggaccgcaucgaagaguuccucgccgccgaaugcccguuccuccccaaaccgaaagucgccuccgaagccuucaugucaaccaacaaaauguacuuccuaaaccgccagcgccaagucaaugaauccaaaguccaagacauaaucgaccucaucgaccacgcagaaacagaaucagccacccucuucacagaaaucgcaacaccccacuccgucuggguauucgccugcgcacccgaccgcugcccacccaccgcccucuacguagcgggcgucccagaacucggcgccuucuucuccauccuacaagacaugcgcaauaccauaauggccucaaaauccgucggcaccgcugaagaaaaacuaaagaagaaauccgccuucuaccaaucauaccuccgucgaacacaauccaugggcauacaacucgaccagaaaaucaucauccucuacaugcucuccuggggaaaagaggcagucaaccacuuccaccucggcgacgacauggacccagaacuccgccaacuagcacaaucccuaaucgacacaaaagucaaagaaauuucaaaccaagaaccacucaaacuauaa

SEQ ID NO: 7675 - RNA, 1287 nt, Artificial Sequence
  derived and/or modified CDS sequence (opt11) from ANDV(9718133)__AF482712.1__N
auguccacccuccaagaacuccaagaaaacaucacagcacacgaacaacaacucguaacagcacgccaaaaacucaaagacgccgaaaaagcagucgaaguagaccccgacgacguaaacaaaagcacccuccaaaaccgccgcgccgcagucuccacacucgaaacaaaacucggagagcucaaaagacaacuagcagaccucgucgccgcccaaaaacucgccaccaaacccgucgacccaacaggccucgaacccgacgaccaccucaaagaaaaaucaucacuccgauacggcaacgugcuagacgucaacuccaucgaccucgaagaacccuccggccaaaccgccgacuggaaagccauaggcgccuacauccucggcuuugccauccccaucauccucaaagcccuauacaugcuauccacgcgcggccgccaaaccgugaaagacaacaagggaacacgcauccgcuucaaagacgacuccuccuucgaagaagucaacggcauacgaaaacccaaacaccucuacgucuccaugcccaccgcccagucuaccaugaaagcagaagaaauaaccccaggacgcuuccgcaccauagccugcgggcuauucccagcacaaguaaaagcccgaaacaucaucucccccgugaugggagucaucggcuucggcuucuucgucaaagacuggauggaccgcaucgaagaguuccuagcagccgaaugcccauuccuacccaaacccaagguagcguccgaagccuucaugucaacaaacaaaauguacuuccucaaccgccagcgccaagucaacgaauccaaaguccaagacaucaucgaccugaucgaucacgccgaaaccgaaucggccacccuauucaccgaaauagccacgccccacagcgucuggguauucgccugcgcaccagaccgcugcccacccaccgcccuauacgucgccggaguccccgaacucggcgccuucuucagcauacuacaagacaugcgaaacaccauaauggcauccaaaagcguaggcaccgccgaagaaaaacuuaaaaagaaaagcgcauucuaccaauccuaccugcgcagaacccaaagcaugggcauacaacucgaccagaaaaucauaauacuauacaugcuauccuggggcaaagaagcagucaaccacuuccaucuaggcgacgacauggaccccgaacugagacaacuugcccaaagucucaucgacacgaaaguaaaagaaaucuccaaccaagaaccacucaaacuauaa

SEQ ID NO: 7676 - RNA, 1278 nt, Artificial Sequence
  derived and/or modified CDS sequence (opt11) from Araraquara virus(9480)__KP202360.1__N
auguccaaccuccaagaacuccaagaaaacaucacagcccacgaacaacagcuagucacagcacgccaaaaacucaaagacgccgaaaaagcagucgacgucgaccccgacgaagucaacaaaucaacacugcaaggcagacgcgccgcagucuccacccucgaaaccaaacucggcgagcuaaaacgucaacuagccgacuuagucgccgcacaacgccuagccuccaaaccgguagacccaaccggcaucgaacccgacgaccaccuaaaagaaaaguccagccuccgcuacggcaacguacucgacgucaacuccaucgaccucgaagaaccauccggccaaaccgcagacuggaaagcaaucggcgccuacauccucggcuucgccauccccauaauccucaaagcacucuacaugcuauccacccgcggccgccaaaccgucaaagacaacaaaggcacccggauccgauucaaagacgacuccagcuucgaagaaguaaacggcauccgcaagcccaaacaccucuacaucuccaugcccaccgcccaauccaccaugaaggccgaagaaaucaccccaggcagauuccgaaccaucgccugcggacucuuucccgcacaaguaaaagcccgaaacaucaucuccccagugaugggcgucauaggcuucgccuuuuucgucaaagacuggauggaaagaaucgaagacuuccuagccuccgaaugccccuuccuacccaaacccaaaaaccccuccgaagcauucauggcaaccaacaaagccuacuuccucaaccgacagaaacagguagacgaaucccaaguccccgacaucgucgaccucaucgaccacgccgaagcagaauccgcaacccucuucaaagaaaucgcguccccacauuccguaugggucuucgcaugcgcucccgacagaugcccacccaccgcccucuacguggccggcaugcccgaacuaggagccuucuucgccauacuccaagacaugcgcaacaccaucauggccuccaagagcgucggcaccgccgaagaaaaacucaaaaagaaauccgccuucuaccaauccuaucuccgccgaacccagucuaugggaauccagcuagaccagaaaaucaucauccucuacaugcuguccuggggcaaagaagcagucaaccacuuccaccucggcgacgacauggaccccgaauugcgccaauuagcccaaucccuaaucgacaccaaaguaaaagaaucccaaaccaaaucccuauaa

SEQ ID NO: 7677 - RNA, 1287 nt, Artificial Sequence
  derived and/or modified CDS sequence (opt11) from Araraquara-like virus(P5/Cajuru)__EF571895.1__N
augucaaaccuucaagaacuccaagaaaacaucacagcccacgaacaacaacucguaaccgcccgacaaaaacucaaagacgccgaaaaagccgucgaugucgacccagacgaagucaacaaauccacacuccaaggucgccgcgcagccguauccacucucgaaaccaaacucggcgaacucaaacgccaacucgccgaccuggucgcggcccaaagacucgccuccaaacccgucgacccaaccggcauagaaccagacgaccaccuaaaagaaaaaucaagccuuagauacggcaacguccucgacgucaaccccauugaccuagaggaaccgucagggcaaacagccgacuggaaagccaucggcgccuacauacuaggcuucgccauccccaucauccucaaagcacuauacaugcucuccacccgaggccgccaaaccgucaaagacaacaaaggaacaagaauccgauucaaagacgacagcuccuucgaagaagucaacggcauacgcaaacccaaacaccucuacauaucaaugcccaccgcccaauccaccaugaaagcagaagaaaucacccccggccgguuccgcaccaucgccugcggccucuuccccgcgcaagucaaagcacgcaacaucaucucacccgucaugggcgucaucggauucggauucuucguaaaagacuggauggaacgcaucgaagacuuccucgccuccgaaugcccauuccucccuaaacccaaaaaccccuccgaagcauucauggccaccaacaaagccuacuuccucaaccgacaaaaacaagucgacgaaucccagguacccgacaucgucgaccucaucgaccacgcagaagccgaauccgcaacacucuucaaggaaauagccucaccccacucagucugggucuucgccugcgccccagaccgaugcccacccaccgcacuauacgucgccggccucccugaacuaggugccuucuucgccauacuacaagacaugcgcaacaccauaauggcguccaaauccgucggcaccgccgaagaaaaacuaaagaagaaaucagccuucuaccaaagcuaccuccgccgcacacaaucaaugggcauccaacucgaccagaaaauaaucauacuauacaugcuguccuggggaaaagaagcagucaaucacuuccaccuaggcgacgauauggaccccgaacucagacaacucgcccaaucccucaucgacacaaaagucaaagaaaucuccaaccaaggcccccucaaacuauaa

SEQ ID NO: 7678 - RNA, 1287 nt, Artificial Sequence
  derived and/or modified CDS sequence (opt11) from BMJV(Oc22531)__AF482713.1__N
auguccacccuacaagaacuacaagaaaauauaacagcccacgaacaacaacucguaaccgcacgccaaaaacuaaaagacgcugagaaaacugucgaaguagaccccgacgaagucaacaaaagcacacuccaaucucgucgcgccgccgucucaacacuagaaacaaaacuuggagaacucaaacgccaacucgcagaccuaguagcagcccaaaaacucgcaaccaaacccgucgaccccacuggccucgaaccagacgaccaucucaaagaaaaaucuagccuccgauacgguaacguacuagacgucaacuccaucgaccucgaagaacccuccggccaaaccgccgacuggcguuccaucggagcauacauacuagguuucgccauccccaucauccucaaagcacucuacaugcuauccacccgaggccgccaaacagucaaagacaacaaaggaacccgaauccgcuucaaagacgacuccuccuucgaggaaguaaacggcaucagaaaacccaaacaccucuacgucucaaugcccacagcccaaucaaccaugaaagccgaagaaaucacuccaggccgauuccgcaccaucgcaugcggccucuucccagcacaagucaaagcccgcaacaucaucagccccguaaugggcgucaucggcuucuccuucuucgucaaagacuggauggaacgaaucgaagacuuccucgccgccgaaugccccuuccuccccaaaccaaaggcuccaucagaggcuuucauggcaaccaacaaagcauacuuccucaaccgucaacgccaaguaaacgaaucaaaaguccaagacaucgucgaccucaucgaccacgcagaaacagaauccgccacccuauucacagacauagccacuccccacuccguaugggucuucgcaugcgcacccgaccgaugcccacccaccgcacuauacgucgcaggcgucccagaacucggcgcauucuucgcuauucuccaagacaugcgcaacacaaucauggcaucaaagucagucggaaccgccgaagaaaaacucaaaaagaaauccgccuucuaccaauccuaccuacgccgcacccaaucaauggggauccaacucgaccagaaaauuaucauccuauacaugcucucuuggggcaaagaagcaguaaaccacuuccaccucggcgacgacauggacccagaacuacgccaacuagcccaaucgcucaucgacacaaaagucaaagaaauaagcaaccaagaaccucucaaacucuag

SEQ ID NO: 7679 - RNA, 1287 nt, Artificial Sequence
  derived and/or modified CDS sequence (opt11) from LECV(22819)__AF482714.1__N
augucaacacuacaagaacuccaagaaaacaucacagcccacgagcaacagcucgucaccgcacgccaaaaacucaaagacgccgagaaaaccgucgaaguagaccccgacgaaguaaacaaaucaacacuccagucccgacgcgccgccguaucaacccucgaaaccaaacuaggcgaacucaagcgccaacucgccgaccuagucgccgcccaaaaacucgccaccaagcccgucgaccccaccggccucgaacccgacgaccaccucaaagaaaagucgucgcucagauacggcaacguccucgacgucaacagcauagaccucgaagaaccaucaggccaaacagccgacuggcgcuccaucggagcuuacauucucggauucgccaucccuauaauccucaaagcccuauauaugcucuccacacgcggacgccaaaccgucaaagacaacaaaggcacccguauccgcuuuaaagacgacucuucauucgaagaaguuaacggcauacgaaagcccaaacaccuauacgucuccaugcccaccgcucaauccaccaugaaagccgaagaaaucacccccggccgcuuucgcacaaucgccugcggccucuuccccgcccaagucaaggcacgaaacauuaucucccccgucaugggcgucaucggauucuccuucuucguaaaagacuggauggaacgcauagaagacuuccucgccgccgaaugcccauuccucccaaaacccaaagcacccuccgaagccuuuauggcaaccaauaaagccuacuuccuaaacagacaacgccaagucaacgaauccaaaguacaagaaaucguagaccucauagaccacgccgaaaccgaauccgccacccuauucaccgacaucgcaacaccccacagcgucuggguuuucgcuugcgcccccgaccgcugcccacccaccgcccucuacgucgccggaguccccgaacucggcgcuuucuucgccauacuacaagacaugcgcaacaccaucauggcuucgaaauccgucggcaccgccgaagaaaaacucaagaagaaaagcgcauucuaccaaucauaccuacgccgaacccaauccaugggcauacaacuugaccagaaaauaauaauccuauacaugcuuucauggggcaaagaggccgucaaccacuuccaccucggcgacgacauggaccccgaacucagacaacuagcccaaucccuaaucgacaccaaaguaaaagagauauccaaccaagaaccccucaaacuauaa

SEQ ID NO: 7680 - RNA, 1287 nt, Artificial Sequence
  derived and/or modified CDS sequence (opt11) from MCLV(13796)__AF482716.1__N
auguccaaccuccaagaacuccaagaaaacauuaccgcccacgaacaacaacucgucaccgcccggcaaaaacuuaaagacgccgaaaaagcaguagacgucgacccagacgaagucaacaaaagcacccugcaaggcagacgagccgccgucagcacccuggaaaccaaacuuggcgaacucaaacgccaacucgccgaccuagucgcagcccaaaaacuggccaccaaacccgucgacccaaccggcaucgaacccgacgaccaccucaaagaaaaaucaagccuacgauacggcaacguacuagacgucaacucaaucgaccucgaagaacccuccggccaaaccgccgacuggaaagccaucggcgccuacauacucggcuucgcaauccccaucauccuaaaagcacuauacaugcuuuccacccgcggccgacaaacaguuaaagacaacaaaggcacacgcauccgcuucaaagacgacuccucauucgaagaggucaacggcauacgcaaaccaaaacaccuuuacaucagcaugcccaccgcacaaucaaccaugaaggcagaagaaaucacacccggccgcuuccgcaccaucguaugcggccucuuccccgcccaagucaaagcacgcaacauaaucuccccaguaaugggcgucaucggcuucuccuucuucguaaaagacuggauggaacgcaucgaaggcuuccucgccgccgaaugcccauuccugcccaaaccgaaaacagccgccgaaaccuucauggccaccaacaaagccuacuucuucaacagacaacgccaagucgacgaaucccaagucccggacaucguagaacuaauagaccaggccgaauccgaaucagcaacacucuucacagaaaucgccagcccucacuccguaugggucuucgccugcgcaccagaccgcugcccacccaccgcccuauacguagcaggaguccccgaacucggcgccuucuucgccauccuacaagacaugcgaaacaccaucauggccucaaaaucagucggcaccgccgaagaaaaacucaagaaaaagucagcauucuaccagucauaccuccgacgaacccaaucaaugggaauccagcuagaccagaagaucaucauccuguacaugcucucguggggaaaagaagccguaaaccacuuccaccuaggcgacgauauggaccccgagcuccgacaacucgcccaggcccucaucgacaccaaagucaaagaaaucuccaaccaggagccccucaaacucuaa

SEQ ID NO: 7681 - RNA, 1287 nt, Artificial Sequence
  derived and/or modified CDS sequence (opt11) from Neembucu(Neembucu)__DQ345763.1__N
augagcacucuccaagaacuccaagaaaacaucaccgcacacgaacaacaacucgucacagcccgccaaaaacucaaagacgcagagaaaaccgucgaaguagaccccgacgaaguaaacaaauccacccuccaaucccgucgcgcagccguaagcacccucgaaaccaaacucggagaacucaaacgccaacucgcagaccuggucgccgcccaaaaacuagccacacgccccgucgaccccaccggccucgaaccagacgaccaccucaaagaaaaauccucccugcgauacggaaacguucucgacgucaacagcaucgaccuagaagaaccaucaggccaaaccgcagacuggcgcuccaucggcgcauacauccucggcuucgcuauucccauaauccuaaaagcccucuacaugcuauccacucgcggacgacaaacagucaaagacaacaaaggaacacgcauacgcuuuaaagacgacuccuccuucgaagaaguaaacggaauacgcaagcccaaacaccucuacguauccaugcccacagcccaaagcacaaugaaagcagaagaaauaacccccggacgccuccgaacaaucgccugcggguuauucccagcccaagucaaggcccgcagcaucauauccccagucaugggcgucaucggauucagcuucuucgucaaggacuggauggaaagaaucgaagacuuccuagcagccgaaugccccuuccugccgaaacccaaagcccccuccgaagccuucauggcaaccaacaaagcauacuuccucaaccgccaacgccaagucaacgaaucaaaggugcaagacauagucgaccuaauagaccacgccgaaaccgaauccgccacccucuucaccgacauagcaacuccccacuccgucuggguauucgccugcgccccagaccgcugcccacccaccgcacucuaugucgccggcgucccagaacucggcgcguucuucgccauacuacaagacaugcgcaacaccaucauggccuccaaguccgucggcaccgccgaagaaaagcuaaagaagaaaucugcauucuaccagucauaccuccgccgaacccaauccaugggcauccaacucgaccagaaaauaauaauccuguacaugcugucaugggguaaagaagcugucaaccacuuccaccuaggagacgacauggacccagaacuacgccaacucgcccaaucacuaauagacacaaaagucaaggaaaucagcaaccaagaaccccucaaacucuaa

SEQ ID NO: 7682 - RNA, 1287 nt, Artificial Sequence
  derived and/or modified CDS sequence (opt11) from ORNV(22996)__AF482715.1__N
augucaacccuccaagaacugcaagaaaacaucaccgcacacgagcaacaacucgucaccgcucgacaaaaacucaaagacgcagagaaaaccguagaagucgaccccgacgaagucaacaaaucaacgcuccaaagccggcgagccgccgucuccacccucgaaacaaaacuaggcgaacucaaaagacagcuagccgaccucgucgccgcccaaaaacuagccacaaaacccgucgaccccaccggacuagaaccagacgaucaccucaaagagaaaagcucucuccgcuacggcaacguccuagacgucaacagcaucgaccucgaagaacccuccggccaaacagcagacuggaaagcaauuggagccuacauacucggcuucgccauaccuaucauacucaaagcacuauacaugcucucaacacgcggccgccaaaccguaaaagacaacaaaggcaccagaauccgcuucaaagacgacuccagcuuugaagaaguaaacggcauacgcaaacccaaacaccucuacguguccaugcccacagcccaauccacaaugaaagccgaagaaaucacccccggacgcuucagaaccauagcaugcggacucuucccagcccaggucaaagcccgcaacaucauaucacccgucaugggcgucaucggauucagcuucuucguaaaagacuggauggaacgcaucgaagacuuccucgcggccgaaugccccuuccuccccaaacccaaagcccuaagcgaagcauucauggccaccaacaaagcauacuuccuaaaccgccaacgccaggucaacgauucaaaaguccaagacaucguagaccuaaucgaucacgcagaaaucgaaucagccacccucuucaccgacaucgccacuccccacuccgucugggucuuugcaugcgcaccagaccggugcccacccaccgcccuuuacgucgccggagucccagaacucggcgcauucuucgcaauacuccaagacaugcgcaacaccaucauggccagcaaaucagucggaaccgccgaagaaaagcucaaaaagaaauccgccuucuaccaguccuaccuacgccggacccaauccaugggcauccaacuagaccagaaaaucaucauacucuacaugcucuccuggggcaaagaagccgucaaucacuuccaccuaggcgacgacauggacccagaacuacgacaacucgcacaaucucucaucgacaccaaaguaaaagaaaucagcaaccaagaaccacuaaaacucuaa

SEQ ID NO: 7683 - RNA, 1287 nt, Artificial Sequence
  derived and/or modified CDS sequence (opt11) from PRGV(14403)__AF482717.1__N
auguccacccuacaagaacuccaagaaaacauaacggcacaugaacaacaccucgucaccgcccgccaaaaacucaaagacgccgagaaaacaguugaagucgaccccgacgaaguaaacaaauccacacuccaaucacgccgcgccgcagucuccacccuagaaaccaaacucggagaacucaaacgccaacuagccgaccucgucgcagcacagaaacucgccgccaaacccgucgaccccacgggucucgagcccgacgaccaccuaaaagaaaaauccagccuacgcuacgguaacguacucgacguaaacuccaucgauuuagaagaacccuccggccaaaccgccgacuggaaagccaucggagccuacauccucgguuucgccauccccauaauccucaaagcccucuacaugcucucuacacgcggacgucaaaccgucaaagacaacaaaggcacccgcauaagguucaaagacgacuccuccuucgaagaagugaacgguaucaggaaaccaaaacaccucuaugucuccaugcccaccgcucaauccacuaugaaagccgaagaaaucacccccggacgcuuccgcaccauagccugcggccucuuccccgcccaagucaaagcccgaaacauaaucuccccugucaugggagucaucggcuucagcuucuucguaaaagacuggauggaacgcauagaagacuuccucgcagccgaaugccccuuccuccccaaacccaaaacaaccuccgaagccuucaugucaaccaacaaagccuacuuccuaaaccgccaaaggcaagucgacgaaucucagguccccgacaucgccgaacucaucgaacaagccgaauccgaauccgccacacucuucaccgaaaucgccucaccacacagcgucugggucuucgccugcgccccggaucgaugcccacccacagcccucuacgucgcuggaguccccgaacucggugccuucuuugccauccuccaagacaugcgaaacacaauaauggccuccaaaucugugggcaccgccgaagaaaaacucaaaaagaaauccgccuucuaccaauccuaccuccgccgcacccaauccaugggcauccagcucgaccagaaaaucaucauccucuacaugcuuuccuggggcaaagaagccgucaaccacuuccaccuaggagacgacauggaccccgaacuccgccaacuugcacaagcccuaaucgacacaaaagucaaagaaaucucaaaccaagagccccuaaaacuauga

SEQ ID NO: 7684 - RNA, 1287 nt, Artificial Sequence
  derived and/or modified CDS sequence (opt11) from TUNV(FVB554)__JF750419.1__N
auguccaaucuccaagaacuacaagaaaacaucaccgcacacgagcaacagcuaguaaccgcccgccaaaaacuaaaagacgcagaaaaagcagucgaaauggaccccgacgacguuaacaaaagcacccuccaauccagacgcgccgccguaagcacccuagaaaccaaacuaggcgaacuaaaacgccaacucgccgacauggucgccgcacaaaaacucgccaccaaaccggucgaccccaccggccuggaaccagacgaccaccucaaagagaaaagcucccuacgauacgguaacguacuagacgugaacagcaucgaccucgaagaaccaagcggccaaacagcagacuggaaauccauaggcgccuacauccuaggauucgccaucccaaucauucugaaagcucucuacaugcucuccacccgcggacgccaaaccgucaaagacaacaaaggaacacgaauccgcuucaaagacgacucauccuucgaagaaguaaacggaauccgcaaacccaaacaccuauacguaagcaugccaacagcacaauccacaaugaaagcagaggaaaucacccccggccgguuccgcaccaucgcaugcggccucuucccagcacaaguuaaagcccgaaacauaauaucccccgucaugggcgucaucggauucucuuucuucguaaaagacuggauggaacgaaucgaagacuuccucgccgacgaaugcccauuccucccaaaacccaaauccccaagcgaagcauucauggcgacaaacaaagcauauuuccucaaccgacaaagacagguaaacgacuccaagguccaagacaucguagaccucaucgaccacgcagaaaccgaaagcgccacccucuucacagacaucgcaacaccccacagcgucuggguauucgccugcgcccccgaccgaugcccacccaccgcacucuacgucgccggcguccccgaacucggcgccuucuucgccauccugcaggacaugcgcaacaccauuauggcaucaaaguccgucggcaccgccgaagaaaaacucaaaaagaaaagcgccuucuaccaaagcuaccuccgccgcacccaauccaugggcauccagcuagaccagaaaaucaucauccucuacaugcuauccugggguaaagaagcaguaaaccacuuucaccuuggcgacgacauggaccccgaacuccgccaacucgcccaagcacuuauagacaccaaaguaaaagagaucagcaaccaagaaccccugaaacucuaa

SEQ ID NO: 7685 - RNA, 1287 nt, Artificial Sequence
  derived and/or modified CDS sequence (opt11) from BCCV(BCCV)__AB689163.1__N
augucaaaccuaaaagagguucaagacaacauaacaacccacgaacaacagcuaguagcagcccgacaaaaacucaaagacgcagaacgaaccgucggcguagacccggacgacgucaauaaauccacccuacaaaacagacgugccgccgucucggcacucgaagcuaaaauaggcgaacuaaaacgccaacucgcagaccucgucgccgcccaaaaacucgccacaaaaagcguagaccccaccggaauagaaccagacgaccaccucaaggaaaaauccucccucagauacggaaacguccuagacgucaacucaauugaccuagaagaacccucaggccaaaccgcagacuggaaagccaucggcaccuacauccuauccuucguccuccccaucguccuaaaagcccuauacaugcucucaacccgcggacgccaaacugucaaagaaaacaagggcacacgcaucagauucaaagacgacaguuccuacgaagacgucaacgggauucgcaaacccaaacaccucuacgucagccucccaaccgcccaauccacaaugaaagccgacgaaauaacccccggccgcuucagaaccaucgucuguggccucuuccccgcccaaauaaaagcccgcaacaucaucagccccgucaugggagucaucggcuucucauucuucgucaaagacugggucgacaaaaucgaagacuuccucagagccgaaugccccuuccucccaaaaccccgcgcccaagccgaauccuuccucucgaccaacggcgccuacuucaugaaccgccaaacccaagucgaagaauccaagguccaagacauccucgaccucauugacacagccgaauccggcggcgccacccuauucgacaacaucgccucuccccaauccgccuggaucuucgccugcgcaccagaccgaugcccacccaccgcccuguacgucgccggcgucccagaacucggugcauucuucuccauacuccaggacaugcgcaacacaaucauggccagcaaaagcgucggaaccgccgaagaaaaacucaaaaagaaaucagccuucuaccaauccuaccuacgccgaacgcagucuaugggcauccaacucgaccagaaaauaaucauccucuacaugauaaacuggggaaaagaagccguaaaccacuuccaccucggcgacgacauggaccccgaacuccggcaacuagcccaagcccuagucgacacaaaagucaaagaaaucucaaaccaagaaccccucaaaaucuaa

SEQ ID NO: 7686 - RNA, 1287 nt, Artificial Sequence
  derived and/or modified CDS sequence (opt11) from BCCV(BCCV)__L39949.1__N
augagcaaccucaaagaaguccaggacaacauaaccacccacgaacaacaacucguagcagcgcgccaaaaacuaaaagacgcagaacgcaccgucgaaguugauccagacgacgucaacaaaagcacccuccagaaccgacgcgcggcagucucagcccucgaggccaaaaucggagaacucaaacgccaacucgcagaucucguagccgcccaaaaacucgcaaccaaauccgucgauccaaccggcaucgaacccgaugaccaccucaaagagaaaagcucgcuccgcuacggcaacguccucgacgucaacuccaucgaccuagaagaacccuccggccaaacagcagacuggaaagcuaucggcaccuacauacucuccuucguacuacccauaguccuaaaagcccuauacaugcucagcacacgcggccgccaaacaguaaaagaaaacaaaggcacucgaauacgcuucaaagaugacucauccuacgaagacguaaacggcauccgcaaacccaaacaccucuacgucucccugccaaccgcccaauccaccaugaaagcagacgaaaucacacccggccgauucagaaccaucgucugcggccucuuccccgcccaaaucaaagccagaaacaucaucucccccgucauggggguaauagguuucuccuucuucguaaaagauuggguggacaaaaucgaagacuuccuccgcgccgaaugcccguuccugcccaaaccccgcgcccaagccgagagcuuccucuccaccaacggcgccuacuucaugaaccgacaaacccaaguagaagaauccaaaguacaagauauccuagaccucauagacacagccgaauccggcggcgcaacacuauucgacaacaucgcuuccccacaauccgcauggaucuucgccugcgcccccgaccgcugcccacccaccgcacucuacguugccggcguccccgaacuaggcgcauucuucagcauccugcaagacaugcgaaacacaaucauggcauccaaaagcguaggcaccgccgaagaaaaacucaaaaagaaauccgccuucuaccaauccuaccuacgacgcacccaaucgaugggcauccaacuagaccagaaaaucaucauccuguacaugaucaacuggggaaaagaagccgucaaccacuuccacuugggcgacgacauggacccagaacuacggcaacucgcacaagcacuugucgacaccaaagucaaagaaaucucaaaccaagaaccccucaaaaucuag

SEQ ID NO: 7687 - RNA, 1290 nt, Artificial Sequence
  derived and/or modified CDS sequence (opt11) from DOBV(DOBV/Ano-Poroia/Afl9/1999)__NC_005233.1__N
auggccacccuagaagaacuccaaaaagaaaucaacaaccacgaaggacaacucguaaucgcacgccaaaaagucaaagacgccgaaaaacaauacgaaaaagaccccgacgaucuuaacaaacgagcacucucagaccgcgaaagcaucgcccaaagcauccaaggaaaaauagacgaacuccgccgucaacucgcagaccgagucgcagcaggcaaaaacaucggaaaagaacgcgacccuaccggccuugacccaggcgaccaccugaaagaaaaaucaaugcuaagcuacggcaacgucaucgaccuuaaccaccuagacauugacgagccaacaggccaaaccgccgacuggcuauccaucgucguauaccugaccucauucguaguccccauccuccuaaaagcccucuacaugcucaccacccgcggcagacaaacaaccaaagacaacaaaggcaugagaauacgcuucaaagacgacaguuccuucgaagacguuaacggcaucagaaaacccaaacaccucuuucucuccaugcccaacgcacaauccucaaugaaagccgacgaaaucacaccuggccgcuuccgaaccgccaucugcggacucuaccccgcacaagucaaagccagaaaccucaucucccccgucauguccgucauaggauuccucgcccucgccaaaaacuggacagaacgcgucgaagaauggcuagaccuacccugcaaacucuuauccgagcccagccccaccucccucacaaaaggccccucaacaaaccgcgacuaccucaaccaacgccaaggugcacucgcaaaaauggaaacuaaagaagcccaagccguccgcaaacacgccaucgacgccggcugcaaccucaucgaccacaucgacagcccgagcuccaucugggucuucgccggcgcaccagaccgcugcccaccaaccugccucuucaucgccggcauggcagaacucggcgccuucuucgccguacuccaagacaugcguaacaccaucauggcaagcaagaccaucggaaccuccgaagaaaaacuuaagaaaaagucaucauucuaccaauccuaccuccgccgaacccaaagcaugggcauccaacuagaccagcgcauaaucguccucuucauggucgacuggggaaaagaagcagucgauuccuuccaccucggagacgacauggacccagagcuacgaggccucgcgcaagcccucauagaccaaaaaguaaaagagaucuccaaucaagaaccacucaaacucuaa

SEQ ID NO: 7688 - RNA, 1290 nt, Artificial Sequence
  derived and/or modified CDS sequence (opt11) from DOBV(DOB/Saaremaa/160V)__AJ009773.1__N
auggcuacacucgaagaacuccagaaagaaauaaacucccacgaaggccaacucgucaucgcccgacaaaaagucaaagacgccgaaaaacaauacgaaaaagaccccgacgaccucaacaaacgcgcacucagcgaccgcgagucuaucgcccaauccauacaaggcaaaauagacgaacuaagaagacaacucgccgaccgcguagccgccggcaaaaacauaggaaaagaacgcgaccccacaggccucgaucccggcgaccaccucaaagaaaaaucaaugcucuccuacggcaacgucaucgaccucaaccaccucgacaucgacgaacccaccggccaaaccgccgacugguuauccaucgucaucuaccuuaccuccuucgucgucccuauacuacucaaagcccucuacaugcucaccacccgaggccgccaaacaaccaaagacaacaaaggcaugcgaauccgcuucaaagacgacagcucauucgaggacguaaacggaauccggaaacccaaacaccucuuccucuccaugccaaacgcccaauccagcaugaaagccgacgaaaucacccccggccgcuuccgcaccgccgucugcggccucuaccccgcacaaguaaaagcccguaaccuaauaucccccguaaugucaguaaucggauuccucacccucgccaaaaacuggaccgaacgcgucgaagaauggcuagaccuccccugcaaacuacuauccgaaccaucccccaccucccucacaaaaggccccuccaccaaccgcgauuaccucucccagcgacagggcgcccucgccaaaauggaaaccaaagaagcccaagucguucgaaaacacgccaucgacgccggaugcaacaucauagaccacaucgauagccccuccucaauuugggucuucgccggagcacccgacagaugcccaccaaccugccucuucauugcaggcauggcagaacuaggcgccuucuucgccguacuacaagacaugcgcaacaccaucauggccagcaaaaccaucggaacaagcgaagaaaaacuccgcaagaaaucgagcuucuaccaaagcuaccuccgccguacccaaagcaugggcauacaacuagaccagcgaauaaucguccucuucaugaucgaauggggaaaagaagcaguagacuccuuccaucucggugacgacauggaccccgaaauccgaagccucgcccaagcacucaucgaccaaaaaguaaaagaaauauccaaccaagaaccccuaaaacuauaa

SEQ ID NO: 7689 - RNA, 1290 nt, Artificial Sequence
  derived and/or modified CDS sequence (opt11) from DOBV(Slovakia/400Af/98)__AY168576.1__N
auggccacccuagaagaacuccaaaaagaaauaaacaaccacgaaggacaacucgucauagcccgccagaaagucaaagacgccgagaaacaauacgagaaagaccccgacgaccuaaacaaaagagcccucuccgaccgcgaauccaucgcacaguccauacaagguaaaauagacgaacuccgccgccaacuagccgacagaguagccgccggcaaaaauauaggcaaagaaagagaccccacaggccucgacccaggagaccaccucaaagaaaaauccaugcugagcuacggcaacgucaucgaccucaaccaccuagacauagacgaacccacaggacaaacagccgacuggcuauccauaguaguuuaccuaaccagcuucgucgugccgauacuacucaaagcacuauacaugcucaccacuagaggccgccaaaccacaaaagacaacaaaggcaugcgcauccgcuucaaagacgacuccucauucgaggacgucaacggcauccgcaaaccaaaacaccuuuuccucuccaugccaaacgcccaauccuccaugaaagccgacgaaaucacccccggccgcuuccgcaccgcaauuugcggacucuaccccgcacaagucaaagcccgcaaccuaaucagcccaguaaugucagucauaggauuucucgcccucgccaaaaacuggaccgaacgcgucgaagaauggcucgaccuccccugcaaacuucugagcgaacccucaccaacaagccucacaaaaggccccuccaccaaccgcgacuaccuaaaccaacgccaaggagcacucgccaaaauggaaacaaaagaagcccaagccguccgcaaacacgccauagacgccggcugcaaccuaaucgaccacaucgacagccccagcuccauauggguguucgccggcgcccccgacagaugcccucccacaugccucuucauagcuggcauggccgaacucggcgccuucuucgccguacugcaagacaugcgaaacaccaucauggccuccaaaacaauuggaacauccgaagaaaaacucaaaaagaaauccagcuucuaccaaucccuacuccgacgcacccaaucaaugggaauccaacucgaccaacgcauaauuguccucuucauggucgacuggggcaaagaagcagucgacagcuuccaccucggcgaugacauggaccccgaacuacgaggacucgcccaagcacucauagaccaaaaagucaaagaaauauccaaccaagaaccccuuaaacucuaa

SEQ ID NO: 7690 - RNA, 1290 nt, Artificial Sequence
  derived and/or modified CDS sequence (opt11) from DOBV(Slovakia-856-Aa)__AJ269549.1__N
auggcaacacuagaagaacuccaaaaagaaaucaacucccacgaaggccagcuagucauagcccggcaaaaaguaaaagacgcagaaaaacaauacgaaaaagacccagacgaccuaaacaaacgagcccucuccgaccgagaauccgucgcccaauccauacaaucaaaaaucgacgaacuccgacgccaacucgccgaccgcgucgcagccggcaaaaacaucggaaaagaacgcgacccaacaggacucgaccccggagaccaccucaaagagaaaagcaugcuaucauacggcaacgucaucgaccucaaccaccucgauaucgacgaacccaccggccaaaccgcagacuggcucuccaucguugucuaccuaaccuccuucgucguccccauccuccuaaaagcccuuuacaugcucacuacccgcggucgacaaaccacaaaagacaacaaaggcaugcgcaucagauucaaagacgacuccagcuucgaagacgugaacggaauccgcaaaccuaagcaccuauuccucucuaugccuaacgcccaauccagcaugaaagccgacgaaaucaccccgggccgcuuccgcaccgccaucugcggccucuaccccgcacaagucaaagccagaaaccucgugagccccgucaugucaguaauaggauucauggcacucgccaaaaacuggaccgaacggguugaagaguggcuggaccugcccugcaaacuacuauccgaaccaagcccaaccucccucaccaaaggccccucaacaaaccgcgacuaccuaaaccaacgccaaggcgcccuagcaaaaauggaaaccaaagaagcccaagccguacgaaaacacgccaucgacgccggaugcaacaucaucgaccacauugacagccccuccuccauaugggucuucgcccccgcccccgaccgcugcccaccuacaugccuauucaucgcaggcauggcagaauugggagcguucuuuuccguacuacaagacaugcgaaacaccauaauggccucaaaaaccaucggcaccucagaagaaaagcuccgcaagaaaucauccuucuaccaauccuaucuaagacgaacccaauccaugggcauccaacuggaccaacgcauaaucguccucuucauggucgacuggggcaaagaagccgucgacuccuuccaccucggagacgacauggacccugaacuccgcggccuagcccaagcccuaaucgaccaaaaagucaaagaaaucuccaaccaggaaccccucaaacucuaa

SEQ ID NO: 7691 - RNA, 1290 nt, Artificial Sequence
  derived and/or modified CDS sequence (opt11) from DOBV(Slovakia-862-Aa)__AJ269550.1__N
auggccacacucgaagaacuacaaaaagaaaucaacagccacgaaggacagcuagucaucgcccgccaaaaaguuaaagaugccgaaaaacaauacgaaaaagacccggacgaccucaacaaacgagcccuaagcgacagagaauccguagcccaaucaauucaauccaaaaucgacgaacuacgacgccaacucgcagaccgcgucgccgccggcaagaacaucggaaaggaacgcgacccaaccggccucgacccaggagaccaccuaaaagaaaagucaaugcuaagcuacggcaacgucaucgaccuuaaucaccuagacaucgacgaacccacaggccaaaccgcugacuggcuaucaaucguaguauaccucaccucauucgucguccccauccuccuaaaagcacucuacaugcuaaccacaagagggcgccaaaccacaaaggacaacaaaggcaugcgcauaagauucaaggacgacuccuccuucgaagacgucaacggcauccgcaagcccaaacaccuauuccucucaaugcccaacgcccaaucaagcaugaaagccgacgaaauaacgccaggccgauuccgaaccgcaaucugcggccucuaccccgcacaagucaaagcccgcaaccuagucucaccagucaugagcguuaucggcuucauggcccuagccaaaaacuggaccgaacgcgucgaagaauggcucgaccugcccugcaaacuccucucagaacccuccccaacaucccuaacaaaaggacccuccacaaaccgagacuaccucaaccagcgacagggcgcauuagcaaaaauggaaacaaaagaagcacaagcaguacgaaaacacgccaucgacgccggcugcaauaucaucgaccacaucgacucacccagcucaaucugggucuucgccggccgccccgaccgcugcccacccacuugccucuucaucgcaggcauggccgaacucggagcauucuucucaguccuccaggacaugcgaaacaccaucauggccuccaaaaccauaggcaccagcgaagaaaaacuccgcaagaaaagcuccuucuaucaaagcuaccuacgacguacucaauccaugggcauccaacucgaccaacgcauaaucguacucuucauggucgacuggggcaaagaagcagucgacuccuuccaccuaggcgacgacauggacccggaacuacgaggccucgcccaagcgcuaaucgaccaaaaagucaaagaaauaagcaaccaggaaccccuaaaacuauaa

SEQ ID NO: 7692 - RNA, 1290 nt, Artificial Sequence
  derived and/or modified CDS sequence (opt11) from DOBV(Esl/29Aa/01)__AY533118.2__N
auggccacccucgaagaacuccaaaaagaaauuaauucccacgaaggccagcuagucaucgccagacaaaaagucaaagacgccgaaaaacaauacgaaaaagaccccgacgaccucaacaaacgcgcccucucagaccgcgaguccguagcacaaagcauccaaucaaaaaucgacgaacuacgccgccaacucgccgaccgugucgccgccggcaaaaacaucggaaaagaacgcgaccccacaggccucgaccccggagaccaccucaaagaaaaaucaaugcucuccuacggcaacgucaucgaccucaaccaccuagacaucgacgaacccacaggccaaaccgccgacuggcuaucaauagucgucuaccuaaccucuuucgucguccccauccuccucaaagcccucuacaugcuaacaaccagaggccgccaaaccaccaaagacaacaaaggcaugaggauacgcuucaaagacgacucaucauucgaagacgucaacggcauacgaaaacccaaacaccucuuccuaucaaugcccaacgcccaaagcuccaugaaagcagacgaaauaacccccggacgcuuccgcaccgcaaucuguggccuauaccccgcacaaguaaaagcacgcaaccucguaucaccagucauguccguaauuggauuccuagcucucgccaaaaacuggaccgaacgcgucgaagaauggcuagaccuccccugcaaacuccucuccgaacccucccccaccagccuaaccaaaggccccucaaccaaccgggacuaccucaaccaacgccaaggagcgcuagccaaaauggaaaccaaagaagcacaagcaguacgaaaacacgcaauagacgccggcugcaacauaaucgaccacaucgacucacccuccuccaucugggucuucgccggcgcaccagaccgaugcccaccgaccugccuauuuaucgccggcauggccgaacucggagccuucuucuccguccuccaagacaugcgcaacaccauaauggccagcaaaaccauaggcaccuccgaagaaaaacuccgcaagaaauccagcuucuaccagucauaccuccgccgcacacaaucuaugggcauccaacuagaccagcgaaucaucguccuauucaugguagacuggggcaaagaagccgucgacuccuuucaccuaggcgacgacauggaccccgaacuccgcggccucgcacaagcccucaucgaccaaaaaguaaaagaaaucuccaaccaagagccccucaaacucuaa

SEQ ID NO: 7693 - RNA, 1290 nt, Artificial Sequence
  derived and/or modified CDS sequence (opt11) from DOBV(Kurkino/44Aa/98)__AJ131672.1__N
auggcaacacuagaagaacuacagaaagagauaaacucacacgaaggacaacugguaaucgcaagacaaaaagucaaggacgcagagaaacaacacgaaaaagaccccgacgaccucaacaaacgcgcccucuccgacagagaauccgucgcacaauccauccaaagcaaaaucgacgagcucagacgacaacucgccgaccgaguagcagcaggcaaaaacaucggcaaagaacgcgacccaaccggccucgaucccggagaccaccucaaagagaaaagcaugcucagcuacggcaacgugauagaccucaaccaccucgacauagacgagcccaccggccaaaccgcagacuggcucuccaucguaguauaccuaaccagcuuuguaguacccauacuccuaaaagcacuauacaugcucaccacgcgcggccgacaaaccaccaaagacaacaaaggcaugcgcauccgcuucaaagacgauuccuccuucgaagacgucaacggaaucagaaagcccaaacaccucuuccucagcaugcccaaugcccaaagcuccaugaaagccgacgaaaucacucccggccgcuuccgcacggcaauaugcggacuauaccccgcccaagucaaagcccgcaaccucgucucaccagucaugucuguaaucggauuccuagcacuggcaaagaacuggaccgagcgcguagaagaauggcucgaucuccccugcaaacuccucucugaacccuccccaacaucccucacgaaaggacccuccaccaaccgcgacuaccucaaccaaagacaagccgcccucgccaaaauggaaacaaaagaagcacaagccguacgcaaacacgcaauagacgccggcugcacaaucaucgacuacaucgacucccccucauccaucugggucuucgccggagccccagaccgcugcccaccaaccugccucuuuaucgccggcauggccgaacucggcgcauucuucuccguccuccaagacaugcgcaacaccaucauggccuccaaaaccgucggaacuuccgaagagaaacuacgcaagaaauccucguucuaccaauccuaccuaagacgcacccaauccaugggaauccagcuugaccaacgcaucaucguccuauucauggucgacuggggcaaagaagcagucgacuccuuucaccugggagacgacauggacccugaacucagaggcuuagcacaagcacuaaucgaccaaaaagucaaagaaaucuccaaccgagaaccccucaaacuauaa

SEQ ID NO: 7694 - RNA, 1290 nt, Artificial Sequence
  derived and/or modified CDS sequence (opt11) from DOBV(Kurkino/53Aa/98)__AJ131673.1__N
auggcaacucucgaagaacuccaaaaagaaaucaacucccacgaaggccaacucgucaucgcccgacaaaaaguaaaagacgccgaaaaacaauacgaaaaagacccagacgaccuaaacaaacgagcccuaagcgaucgcgagucuguggcacagagcauccaaucuaaaaucgacgaacuccgccgccaacuagccgaccgagucgccgccggcaaaaacaucggcaaagaacgcgaccccaccggccuggacccaggagaccaccuaaaagaaaaaucaaugcucucuuacggcaacgucaucgaccugaaccacuuggacaucgacgagccaaccggccaaacagcagacuggcucagcaucgucguauaccucacauccuucgucguucccauccuccucaaagcacuauacaugcuaaccacacgaggccgacaaacaaccaaggauaauaaaggcaugcgcauccgcuucaaagacgacuccucauucgaggacgucaacggcauccgaaaacccaaacaccucuuccucucuaugcccaacgcucaauccuccaugaaagccgacgaaauaaccccaggcagguuccgaacagccaucugcggccucuacccagcccaaguaaaagcccgaaaccuagucucccccguaaugucagucaucggcuuccuagcccucgccaaaaacuggacagaacgcguagaagaauggcuugaccucccaugcaaacuccucuccgaacccucccccaccucccucaccaaaggccccuccaccaaccgcgacuaccucaaccaacgccaagccgcccucgccaaaauggaaaccaaggaagcccaggccguccgcaaacacgcaauagacgccggcugcaccaucaucgaccacaucgacagcccaagcagcaucugggucuucgccggcgcccccgacaggugcccaccaaccugccuauucaucgccggaauggcagagcuaggcgcuuucuucucaguacuccaagacaugcgcaacaccaucauggcauccaaaaccgucggcaccuccgaagaaaaacuucgaaagaaaagcucauucuaccaaagcuaccuccgccgaacccaauccaugggcauacaacucgaccaaaggauaauaguccuauucauggucgacuggggcaaagaagccgucgacucauuccaccuaggcgacgacauggaccccgaacucagaggccuugcucaagcccucaucgaccaaaaagucaaagaaaucucaaaccgcgaaccccuuaaacucuaa

SEQ ID NO: 7695 - RNA, 1290 nt, Artificial Sequence
  derived and/or modified CDS sequence (opt11) from DOBV(Saar/90Aa/97)__AJ009775.1__N
auggccacacucgaagaacuccaaaaagagaucaacucccacgaaggucaacucgucauagcccgacaaaaaguaaaagacgccgaaaaacaauacgaaaaagaccccgacgaccuaaacaaacgagcccucuccgaccgcgaauccaucgcccaaucaauccaaggaaaaaucgacgaacuccgccgacaacucgccgaccgcgucgccgcaggcaaaaacaucggacgcgagcgagaccccacaggccucgaccccggagaccaccucaaagaaaaauccaugcucagcuacggcaacguaauagacuuaaaccaccuugacaucgacgaaccaaccggccaaacagcagacuggcuaagcaucgucauuuaccuaaccuccuucgucguccccauccuacucaaagcccuauauaugcucaccacccgcggccgccaaaccaccaaagacaacaaagguaugcgcaucagauucaaagacgacuccuccuucgaagacgucaaugggauccgcaaacccaaacaccucuuccuauccaugccaaacgcacaauccucaaugaaggccgacgaaaucacccccggacgcuuccgaacugcagucugcggccucuaccccgcccaagucaaagccagaaaccucauauccccuguaauguccgucaucggcuuccucacccuagccaaaaacuggaccgaacgcguagaagaauggcucgaccuacccugcaaacuacucuccgaacccagccccacaucacuaaccaaaggcccauccaccaaccgcgacuaccucucacaacgccaaggcgcacucgcuaaaauggaaacuaaagaggcccaagccguccgcaaacacgccaucgacgccggaugcaauauaaucgaccacauagacuccccauccucaaucuggguauucgccggggcgcccgaccgaugcccacccacaugccucuucauagccggcauggccgaacucggagccuuuuucgccguccuccaagacaugcgaaacaccaucauggccucuaaaacaauaggcaccagcgaagaaaaacucagaaagaaauccuccuucuaccaauccuacuuacgccgcacccaaagcaugggcauacaacucgaccaacgcaucaucguccucuucaugauagaauggggcaaagaagccgucgacuccuuccaccuaggcgacgacauggaucccgaaauccgcucacucgcccaagcccucaucgaccaaaaagucaaagaaaucuccaaucaagaaccccuaaaacucuaa

SEQ ID NO: 7696 - RNA, 1290 nt, Artificial Sequence
  derived and/or modified CDS sequence (opt11) from DOBV(SK/Aa)__AY961615.1__N
auggccacccucgaggaacuacaaaaagaaaucaacucacacgaaggccaacucgucauagcccgacaaaaagucaaagacgccgaaaaacaauacgaaaaagaccccgacgaccuaaauaaaagaacccucagcgaccgcgaaagcguggcccaguccauccaaucaaaaaucgacgaacuacgacgccaacucgccgaccgcgucgcggccggcaaaaacauaggaaaagaacgcgaccccaccggccucgaccccggggaccaccucaaagaaaaaucaaugcugagcuacgguaacguaaucgaccucaaccaccucgacaucgacgaaccaacaggccaaaccgcagacuggcucagcauaguagucuaccucacauccuucgucguacccauccuccucaaggcccuauacaugcucaccaccagaggaaggcaaacaaccaaagacaacaaaggaaugcgcauacguuucaaggacgacuccuccuucgaagacguaaacggcauccgcaaacccaaacaccuauuccucucaaugccaaacgcccagagcucaaugaaagcagacgaaaucacacccggccgcuuccguaccgccauaugcggacucuaccccgcacaagucaaggcccgcaaccucguauccccaguaaugucagucaucggcuuccucgcacucgccaaaaacuggaccgaacgcgucgaagaauggcuagaccucccaugcaaacuccuaucagaacccucgcccacaucacucaccaaaggccccuccacaaaccgagacuaccucaaccaacgccaaggagcccucgccaaaauggaaaccaaagaagcccaggccguccgcaaacacgcaaucgacgccggcugcaacaucaucgaccacaucgacuccccuucaucaaucugggucuucgccggcgcccccgacagaugcccaccaaccugccuauucauagccggaauggcagaacuaggagccuucuucuccguacuccaagacaugcguaacaccaucauggccagcaaaaccauuggcacguccgaagaaaaacuccgcaagaaguccaguuucuaccaauccuaccuccgccgcacccaauccaugggcauccaacucgaccaacgaaucauuguccuuuucauggucgacuggggaaaagaagcaguagacuccuuccaccuaggagacgacauggaccccgaacuacgcggccucgcccaagcccuuaucgaccaaaaaguaaaagaaaucucaaaccaggaaccccuaaaacucuaa

SEQ ID NO: 7697 - RNA, 1290 nt, Artificial Sequence
  derived and/or modified CDS sequence (opt11) from DOBV(A35)__GU904030.1__N
auggcaacccuagaagaacuccaaaaagaaaucaacaaccacgaaggacaacuggucaucgcccgacaaaaagucaaagacgccgaaaaacaauacgaaaaagacccagacgaccucaacaaacgcgcccucuccgacagagaauccaucgcccaauccauacaaggaaaaauagacgaacucagacgccaacucgccgaccgcgucgccgccggcaagaacaucggcaaagaacgcgauccaacaggccucgaccccggcgaccaucucaaagaaaaauccaugcucuccuacggaaacgucaucgaccucaaccaccuagacaucgacgaacccaccggccaaaccgcagacuggcucuccaucgucaucuaccucacauccuucgucguuccaauccuucuaaaagcccucuacaugcucaccacccgcggccgacaaacaacaaaagacaacaaaggcaugcgaauacgcuucaaagacgacagcagcuucgaagauguaaacggcauccgcaaacccaaacaccucuuccuaagcaugccaaacgcccaauccagcaugaaggccgacgaaaucacccccggccgcuuccgcaccgccauaugcggccucuaccccgcucaagucaaagcccgcaaccucauauccccugucauguccgucaucggcuucguagcccuagccaaaaacuggacagaacgcgucgaagaauggcucgaccuaccaugcaaacuacuauccgaacccuccccuacuucccucacaaaaggaccaagcacaaaccgcgacuaccucaaccaaagacaaggcgcucucgccaaaauggaaaccaaagaggcacaagcaguccgcaaacacgccaucgacgcaggcugcaaccucauagaccacaucgacagccccagcucuaucuggguauucgccggugcaccagaccgaugcccacccacaugccucuucaucgcaggcauggccgagcuaggagcauucuucgccguccuccaagacaugcgaaacacaaucauggccagcaaaaccaucggcacguccgaagaaaaacucaagaagaaauccuccuucuaucaauccuaccuacgacgcacccaauccaugggcauccaacuagaccagcggauaauaguacucuucauggucgacuggggaaaagaagccguggacuccuuccaccucggagacgacauggaccccgaacuccgaggccucgcccaagcacucaucgaucaaaaagucaaagaaaucuccaaccaagagccacuaaaacuauaa

SEQ ID NO: 7698 - RNA, 1290 nt, Artificial Sequence
  derived and/or modified CDS sequence (opt11) from DOBV(3970/87)__L41916.1__N
auggccacacucgaagaacuccaaaaagaaaucaacaaccacgaaggacaacucguaaucgccagacaaaaagucaaagacgcagaaaaacaauacgaaaaagacccugacgaccucaauaaacgcgcccuuagcgaccgagaaucaaucgcgcaaucaauacaaggcaaaaucgacgaacuacgccgccagcuugccgauaggguagcagccggcaaaaacauaggcaaagaacgcgaccccaccggucuagacccuggcgaccaccuaaaagaaaaauccaugcucuccuacggcaacguaaucgaccucaaucaccucgacaucgacgaacccaccggacaaacagccgacuggcucucaaucgucauuuaccucaccagcuucgucgucccaauccuccucaaagcccuauacaugcucaccacccgcggcaggcaaaccaccaaagacaacaaagggaugagaauccgcuuuaaagacgacuccucauucgaagaugucaacggcauacgcaaacccaaacaccucuuccucuccaugccaaacgcacaaucauccaugaaagccgacgaaaucacacccggccgguuccgcaccgccaucugcggccucuacccggcacaaguaaaagcacgaaaccucauaucccccgucaugucaguaaucggcuucgucgcccucgccaaaaacuggacugaacgcgucgaagaguggcucgaccuacccugcaaacuacucagcgagccaucacccaccucacucacaaaaggccccuccacuaaccgcgacuaccucaaccaacgacagggcgcucucgccaaaauggaaaccaaagaggcccaagccguacgcaaacacgccaucgacgcgggaugcaaccuuaucgaccacaucgacucccccuccuccaucuggguauucgcaggagcccccgaccgaugcccgccaaccugccuauucauagccggcauggccgaacucggagccuucuucgcaugccuacaggacaugcgaaacacaaucauggccuccaaaaccaucggcaccagcgaagaaaaacuuaaaaagaaauccuccuucuaccaauccuaccuaagaagaacacaauccaugggcauccaacuagaccaacgcaucaucguccucuucaugguugacuggggaaaagaagccguagacuccuuccaccucggcgacgacauggaccccgaacuccgcggccucgcacaagcccuaauagaccaaaaaguaaaagaaaucucuaaccaagaaccacucaaacuauaa

SEQ ID NO: 7699 - RNA, 1290 nt, Artificial Sequence
  derived and/or modified CDS sequence (opt11) from DOBV(Klyuch-2000)__AF442622.1__N
auggccacccucgaagaacuccaaaaagaaaucaacucccacgaaggccaacucgucauagcccgacgcaaagucaaagacgccgaaaaacaauacgaaaaagacccagacgaccuaaacaaacgagcacucagcgaccgcgaaagcgucgcccaguccauacaaggaaaaauagacgaacucagacgccaacuagccgaccgggucgcagcaggcaaaaacauuggcaaagaacgcgaccccaccggccuagacccaggcgaccaccucaaagaaaaauccaugcuaucauacggaaacgucaucgaccucaaccaccuugacaucgacgaaccaaccggacaaacggcugacuggcuaagcauagucguauaccucaccucauucgucguaccaauauuacucaaagcccuauacaugcuaacaacacggggacgacaaacaaccaaagacaacaaaggaaugcgaauccgcuucaaagacgacuccucauucgaggacguaaacggaaucagaaaacccaaacaccucuuccuguccaugcccaacgcacaauccuccaugaaagccgacgaaaucacccccggccgcuuccgcacagcagucugcggccucuaccccgcccaaguaaaagcccgaaaccuaguaagccccguuaugagcgucaucggauucgugagccuagccaaaaacuggacagaacgagucgaagaauggcuagaucuccccugcaaacuccuuagcgaaccgagccccaccucgcuaacaaaaggccccuccacaaaccgcgacuaccucaaccaacgacaaggcgcccucgccaaaauggaaacaaaagaagcccaggccgucagaaaacacgccauaaacgccggcugcaaccucgucgaccacauugacagcccaagcuccauauggguauucgccggcgccccagaccgcugcccaccaaccugccuauucgucgcaggcauggccgaacuaggcgcauucuucgccguccuccaagacaugcgaaacacaaucauggcuagcaaaaccauaggaacaagcgaagaaaaacuccgcaaaaagucaucauucuaucaaucauaccuacgacgaacacaauccaugggcauacaacuagaccaaagaauaauaguccuauucauggucgacuggggcaaagaagccgucgacagcuuccaccuaggcgacgacauggaccccgaacuacgcggacuagcgcaagcccucaucgaacaaaaagucaaagaaaucagcaaccaagaaccccuaaaacucuaa

SEQ ID NO: 7700 - RNA, 1290 nt, Artificial Sequence
  derived and/or modified CDS sequence (opt11) from DOBV(10636/Ap)__KP878311.1__N
auggccacccuagaagaacuccaaaaggaaaucaacaaccacgaaggccagcucgucaucgcccgucaaaaagucaaagacgccgaaaaacaauacgaaaaagaccccgacgaccuaaacaaacgagcacuauccgaccgcgaaagcgucgcacaaagcauccaaggcaaaauagacgaacuacggcgccaacucgccgacagagucgcggcaggcaaaaacaucggaaaagaacgcgacccaacaggccucgaccccggcgaccaccuaaaagaaaaauccaugcuguccuacggcaacgugauagaccuaaaccaccucgauaucgacgaaccgaccggacaaaccgcagacuggcuaagcaucgucguauaccuaaccagcuucguagucccaauucuacucaaagcccuauacaugcuaacaacccgaggaagacaaaccaccaaagacaacaaaggaaugcgaauccgauucaaagacgacuccagcuucgaggacgucaacggaauacggaagccaaaacaccucuuccuauccaugcccaacgcacaaucaagcaugaaagcggacgaaauaacccccggccgauuccgaaccgcaguaugcggucucuaccccgcccaagucaaagcccgcaaccucguaucccccgucaugagcguaauaggcuucguaagccucgccaagaacuggaccgaacgcguagaagaauggcuggaccuccccugcaaacuccucuccgaacccagccccaccucacuaacaaaaggccccuccaccaaccgagacuaccucaaccaacgacaaggcgcccuagccaagauggaaaccaaggaagcccaagccguccgcaaacacgccaucgacgccggaugcaaccuagucgaccauaucgacagcccauccucaaucugggucuucgccggcgcacccgacagaugcccaccaaccugccucuucgucgccggcauggcagaacuaggcgcauucuucgcaguacuacaagacaugcgaaacaccaucauggcuuccaaaacaauaggcaccagugaagaaaaacuuagaaagaaaagcagcuucuaccaauccuaccugcgcagaacccaauccaugggcauccaacucgaccaacgcaucaucguacucuucauggucgacugggguaaggaagccgucgacagcuuccaccucggcgacgacauggaccccgaacuacgcagccuagcccaagcgcuaauagaccaaaaaguaaaagaaauaucaaaccaagaaccccucaaacucuaa

SEQ ID NO: 7701 - RNA, 1290 nt, Artificial Sequence
  derived and/or modified CDS sequence (opt11) from DOBV(10645/Ap)__KP878312.1__N
auggccacacucgaggaacuacaaaaagaaaucaacaaccacgaaggccaacucgucaucgccagacagaaagucaaagacgcagaaaaacaauacgaaaaagacccagacgaccucaacaaaagagcacuauccgaccgcgagucaguagcccaauccauccaaggcaaaauugacgaacucagacgccaacuagcagacagaguagccgccggcaaaaacaucggaaaagaacgagacccaaccggccucgaccccggcgaccaccugaaagaaaaauccaugcucuccuauggcaacgucaucgaccucaaccaccuagacauagacgaacccaccggccaaaccgcugacuggcucuccaucgucgucuaccuaaccucauucgucguccccauacuccucaaagcucucuacaugcuaaccacacguggccgccaaaccacaaaagacaacaaaggaaugcgcauccgauucaaagacgacuccucauucgaagacguaaacggaaucagaaaaccuaaacaccucuuccuaucaaugcccaacgcacaaaguuccaugaaagcugacgagaucacccccggccgcuuucgcaccgccguaugcggacucuauccagcccaagucaaagcacgcaaccucgucucccccguaauguccguaauaggcuucguaagccucgccaaaaacuggaccgaaagagucgaagaauggcucgaccuccccugcaaacuacucucagaacccagccccaccucacucaccaagggccccagcaccaaccgagacuaccuaaaccaaagacaaggugcccucgccaaaauggaaaccaaagaagcccaagccguacgcaaacacgccaucgacgccggcugcaaucuagucgaccacauagacagcccauccucaauauggguguucgcaggagcccccgaccgcugcccacccacgugccucuucgucgcaggcauggccgaacucggcgccuucuucgcaguacuacaggacaugcgcaacaccaucauggccuccaaaaccaucggcacaagcgaagagaaacuccgcaagaaaucauccuucuaccaauccuaccuucgccgcacacaaagcaugggcauccaacucgaccaacgcaucauaguacuauucaugguugacuggggcaaagaagcagucgacuccuuccaccucggcgacgacauggaccccgaacuccgcggccuagcacaggcccucaucgaccagaaaguaaaagaaauaagcaaccaagaaccccuaaaacucuaa

SEQ ID NO: 7702 - RNA, 1290 nt, Artificial Sequence
  derived and/or modified CDS sequence (opt11) from DOBV(Aa1854/Lipetsk-02)__EU188452.1__N
auggccacccuagaagaacuccagaaagaaaucaacucacaugaaggccaacuuguaaucgcccgccaaaaagucaaagacgcugaaaaacaauacgaaaaagauccagacgaccuaaacaaacgcgcccuuagcgaccgcgaauccguagcacaaagcauccaauccaaaaucgacgaacuccgccgccaacucgccgaccgcgucgcagcagguaaaaacaucggcaaagaacgagaccccacaggacucgacccaggagaccaccucaaagaaaaaucgaugcuauccuacggaaacgucauagaccuaaaccaccucgacaucgacgagccaaccggccaaaccgccgacuggcucuccauagucguauaccuaaccucauucguaguccccauccuacucaaagcccucuacaugcucacaacgcgcggccgacaaacaaccaaagacaacaaaggaaugcgaauccguuucaaagacgacuccucguuugaagacgucaacggcauacgaaaacccaaacaccuauuccuaucuaugcccaacgcccaauccagcaugaaagccgacgagaucacccccggacgcuuccgaaccgcuauaugcggccuauacccugcccaagugaaagcccgcaaccucgucucuccagucauguccgucauuggcuuccuagcccuagccaaaaacuggacagaacgagucgaagaauggcuagaccuacccugcaaacuccuauccgaacccuccccaaccucccuaacgaaaggaccaucaaccaaccgagacuaccucaaccagcgccaagcagcccuagcuaaaauggaaaccaaagaagcacaggccguccgcaaacacgcgaucgacgcgggcugcaccaucaucgaccacaucgacucccccuccucaaucugggucuucgccggagcccccgacagaugcccaccuaccugccucuucaucgcaggcauggccgaauuaggcgccuucuucuccguccuccaggacaugcgcaacaccaucauggccuccaaaccagugggcaccuccgaagaaaaacuccgcaagaaaaguuccuucuaccaauccuaccuccgccgaacccaauccaugggcauccaacuagaccaacgcaucauaguccucuucaugguagacuggggcaaagaagcaguggacagcuuccaccucggcgacgacauggacccagaacugcgcggacucgcccaagcucucaucgaccaaaaaguaaaagagaucucaaaccaagaaccacuaaaacucuaa

SEQ ID NO: 7703 - RNA, 1290 nt, Artificial Sequence
  derived and/or modified CDS sequence (opt11) from DOBV(Ap/Sochi/43)__JF920151.1__N
auggcgacacuagaagaacuccaaaaagaaaucaauaaccacgaaggacagcuaguaaucgcucgccaaaaagucaaagacgccgaaaaacaauacgaaaaagaccccgacgaccucaacaaacgggcccucagcgaccgcgaaagcguagcccaauccauccaaggcaaaauagacgaacuccgccgccaacuagccgaccgcgucgcagccggcaaaaacaucggcaaagaacgugaccccaccggacuggaccccggugaccaccuaaaagagaaaagcaugcuauccuacggcaacgucaucgaccucaaccaccucgacaucgacgaacccaccgggcaaaccgccgacuggcuaagcaucgucgucuaccuaaccucauucgucguccccauccuccucaaagcacuauacaugcucacaacccgcggccgccaaacuaccaaagacaauaaaggcaugcguauccgcuucaaagacgacagcagcuucgaagacgucaacggaauccgcaaacccaaacacuuauuccucucaaugccaaacgcacaauccuccaugaaagccgacgaaauuacccccggcagauucagaaccgccgucugcggccuauaccccgcacaaguaaaagcccgcaaccuugucuccccaguaaugagcgucauaggauucguaucccuugccaaaaacuggaccgaacgcgucgaagaauggcucgaccuccccugcaaacuccuauccgaacccucccccacaucacucaccaaaggaccuuccaccaaccgcgacuaccuaaaccaacgccaaggcgcccucgccaaaauggaaaccaaagaagcacaagccguacgaaaacacgccaucgacgccggcugcaaccucgucgaccacaucgacucaccaucauccauaugggucuucgcaggagcccccgaccgcugcccacccacaugccuauuuguagccggcauggccgaacuaggagccuucuucgccguccuccaagacaugcgaaacaccauuauggccuccaaaacaaucggcaccagcgaagaaaaacuccgcaagaaaagcucauucuaccaaagcuaccuccgccgcacccacagcaugggaauacaacuagaccagcgcaucaucguccucuucauggucgacuggggcaaagaagcaguugacuccuuccaccuaggcgacgacauggaccccgagcuacgcggccuggcgcaagcacucaucgaccaaaaagucaaagaaauaucaaaccaggaaccccuaaaacucuag

SEQ ID NO: 7704 - RNA, 1290 nt, Artificial Sequence
  derived and/or modified CDS sequence (opt11) from DOBV(Ap/Sochi/hu)__JF920150.1__N
auggccacccucgaagaacuacaaaaagaaaucaacaaccaugaagggcaacuggucaucgcccgccaaaaggucaaagacgccgaaaagcaauacgaaaaagaccccgacgaccucaacaaacgcgcccucucagaccgcgaaucagucgcccaauccauccaaggcaaaauugacgaacuccgccgccaacucgccgaucgaguagccgccgggaaaaacauagggaaagaaagagacccaaccggacuagaccccggcgaccaccugaaagaaaaauccauguuaagcuacggcaacguaaucgaccucaaccaccuggacaucgacgaaccgacuggccaaaccgccgauuggcuaagcauagucgucuaccucaccuccuucguagucccaauccuccuaaaagcccuauacaugcucacaacccgcggaagacaaacaaccaaagacaacaaaggaaugagaaucagauucaaagacgacagcuccuucgaggacguaaacggaauccgcaaaccaaaacaccuguuccucagcaugcccaacgcccaauccagcaugaaagccgacgaaauaacccccggacgguuccgaaccgcugucugcggccuuuacccagcccaagucaaagcacgcaaccucguaagccccgucaugagcgucaucggauuccuaucccucgccaaaaacuggaccgaacgcguagaagaauggcucgaccuccccugcaaacugcucucagaacccagccccaccagccucacaaaaggccccucaaccaaccgcgacuaucucaaccaacgccaaggcgcacucgcaaaaauggaaacaaaagaggcacaagcaguccgcaaacacgcgaucgacgcaggcugcaaccucguagaccacaucgacagccccagcucaaucugggucuucgcaggagccccagacagaugcccaccaaccugccucuucgucgcaggaauggccgaacugggcgcauucuucgccguacuacaagacaugcgcaacacgauuauggccagcaagaccauaggcaccagcgaagaaaaacuaagaaagaaaagcagcuucuaccaaucauaccuccgcagaacccacagcaugggcauccaacucgaccaaagaauaaucguacucuucaugguggacuggggcaaggaagccguagacagcuuccaccugggcgacgacauggacccagaacuccgcggccuagcccaggcacuaauagaccaaaaagugaaagaaauauccaaccaagaaccacucaagcuauag

SEQ ID NO: 7705 - RNA, 1290 nt, Artificial Sequence
  derived and/or modified CDS sequence (opt11) from DOBV(Ap1584/Sochi-01)__EU188449.1__N
auggccacacucgaagaacucaagaaagaaaucaacaaccaugaaggacaacucguaaucgcccgacaaaaaguaaaggacgccgaaaaacaauacgaaaaagaccccgaugaccucaacaaacgcgcacucagcgaccgcgaaagugucgcccaguccauccaagggaaaaucgacgaacuccgccggcaacuugcagaccgcgucgccgccggcaaaaacaucgggaaagaacgcgaccccacgggccuugaccccggcgaccaccuaaaagaaaaguccaugcuaagcuacggcaacguaaucgaccucaaccaccucgacaucgacgaacccacaggccagacagccgacuggcucuccauagucgucuaccucacauccuucgucguccccauccuacucaaagcacuguacaugcuaaccaccagaggccgccaaacgaccaaagacaacaaaggcaugcgaaucagauucaaagacgacuccucauucgaagacgucaacggcauacgaaaacccaaacaucucuuccucuccaugcccaacgcacaaucuuccaugaaagcagacgaaauaacacccggaagguuccgcacagcagucugcggccuauaccccgcccaagucaaagcacgcaaccuaguaagccccguuauguccgugaucggauucgucucacuggccaagaacuggaccgaacgcgucgaagaauggcuagaccuccccugcaagcuacuaagcgaacccucccccaccagccucacgaaaggccccuccaccaaccgcgacuaccucaaccaacgacaaggcgcccuagccaaaauggaaacaaaagaagcccaagcaguccgcaaacacgccaucgacgcaggcugcaaccucgucgaccauaucgacucccccucauccaucugggucuuugccggcgcaccggaccgaugcccaccaaccugccucuucguagccggcauggcagaacucggagcauucuucgccguucuccaagacaugcgaaacacaaucauggcauccaaaaccauaggcaccagcgaagaaaaacuccgcaagaaaagcucauucuaccaaagcuaccuccgacgcacccaaagcaugggcauacaacucgaccaacgcaucaucguacuauucaugguagacuggggcaaagaagcagucgacuccuuccaccuaggagacgacauggaccccgaacuaagaggccuagcccaagcccucauagaccaaaaagucaaagaaaucucuaaccaagaaccccuaaaacucuaa

SEQ ID NO: 7706 - RNA, 1290 nt, Artificial Sequence
  derived and/or modified CDS sequence (opt11) from DOBV(DOB/Gola/235Af/07)__KC848495.1__N
auggccacccucgaagaacuacaaaaggaaauaaacaaccacgaaggccaacuugucaucgcaaggcaaaaagucaaagacgccgaaaaacaauacgaaaaagaccccgacgaccuaaacaaacgagcccuuucagaccgagaauccaucgcccaaucaauccaaggcaaaauagacgaauuacgucgacaacuagccgaccgaguagcagccggcaaaaacaucggcaaagaaagagacccaacaggacucgaccccggagaccaccucaaagaaaaaucaaugcuauccuacggcaacgucauugaccucaaccaccucgacaucgacgaacccaccggccaaaccgccgacuggcuauccaucgucguauaccuaaccagcuucgucguccccauccuccucaaagcacucuacaugcuaaccacacgcggacgccaaaccaccaaagacaacaaaggcaugcgaauccgcuucaaagacgacuccuccuucgaagacgucaacgggauccgcaaacccaaacaccucuuccucagcaugcccaacgcacaaucaucccgcaaagcugacgaaaucaccccgggaagauuccgcacugccaucugcggacuguacccugcucaagucaaagcccgcaaccucaucucccccgucaugucuguaauaggcuuccucgcccuagccaaaaacuggacagaacgcguagaagaauggcucgaccucccgugcaaacuccuauccgaaccauccccaacuucacuaaccaaaggccccagcaccaaccgagacuaccucaaccaacgccaaggagcccucgcuaaaauggaaaccaaagaagcccaagccguuagaaaacaugccaucgacgccggcugcaaccuaaucgaccacauagacuccccaucauccauaugggucuucgccggcgcccccgaccgaugcccacccacaugccucuucaucgccggcauggcagaacucggagccuucuucgccguccuccaggauaugcgcaacaccauaauggccagcaaaaccauaggcaccucggaagaaaaacuaaagaagaaaagcagcuucuaccaauccuaccuccgccgaacccaaucaaugggcauacaacucgaccaacgcauaaucguacucuucauggucgacuggggcaaagaagccgucgacucauuccaccucggcgacgacauggaccccgagcuccgcggacucgcacaagcccuaaucgaccaaaaaguaaaagaaaucucaaaccaagaaccacucaaacuauaa

SEQ ID NO: 7707 - RNA, 1290 nt, Artificial Sequence
  derived and/or modified CDS sequence (opt11) from DOBV(DOB/Gola/343Af/07)__KC848498.1__N
auggcaacccuagaagaacuccaaaaagaaaucaacaaccacgaaggccagcuaguuauagcucggcaaaaagucaaagacgccgaaaaacaauacgaaaaagaccccgacgaccuuaacaaacgagcccucagcgaccgcgaauccaucgcccaaagcauccaaggcaaaaucgacgagcuccgccgccaacuagccgaccgcguugcagccggcaaaaacaucggaaaagaacgcgaccccacaggacuagaccccggcgaccaccuaaaagagaaaagcaugcuauccuacggaaacgucaucgaccucaaccaccucgacaucgacgaaccgaccggccaaaccgcagacuggcuauccauaguuguauaccuaacauccuucguagucccaaucuuacucaaagcccuguacaugcucacuaccagaggccgacaaacaaccaaagacaacaaaggcaugcgaauccgauucaaagacgacuccuccuucgaagacgucaacggcauccgcaaacccaagcaccucuuccuauccaugcccaacgcgcaauccuccaugaaagccgacgaaaucaccccaggacgcuuccgcaccgccaucugcggacuauacccagcacaagucaaagcacgcaaccuaaucucccccgucauguccguuauaggcuuccuagcccuagccaaaaacuggacagaacgcgucgaagaauggcuugaccugccaugcaaacuacuauccgaaccaucccccaccucccuaaccaaaggccccuccaccaacagagacuaccuaaaccagcgccaaggagcacucgccaaaauggaaacaaaagaagcccaagcaguccgcaaacacgccaccgacgccggcugcaaccuaauagaccacaucgacagccccagcucaaucugggucuucgcgggagcacccgacagaugcccacccacaugccucuucaucgccggaauggcagaacucggagccuucuucgcaguccuccaagacaugcgaaacaccaucauggccagcaaaaccaucgguaccuccgaagaaaaacucaaaaagaaaucguccuucuaccaauccuaccuccgccgcacucaaagcaugggcauacaacucgaccaacgcauaaucguacuauucaugguggacuggggcaaagaagcugucgacucauuccaccuaggagacgacauggaccccgaacuccgcggccuagcccaagcccuaaucgaccaaaaagucaaagaaaucuccaaccaagaaccccuaaaacuauaa

SEQ ID NO: 7708 - RNA, 1290 nt, Artificial Sequence
  derived and/or modified CDS sequence (opt11) from DOBV(DOB/Pecs/27Aa/06)__KC848499.1__N
auggccacacuagaagaacuccaaaaagaaaucaacagccacgaaggucaacucgucaucgcccgacaaaaagucaaagacgcagaaaaacaauacgaaaaagaccccgacgaccuaaacaaaagagcccuaagcgaccgcgaauccgucgcccaguccauccaauccaaaaucgacgaacuccgccgacaacucgccgaccgcgucgcagccgggaaaaacaucggaaaagaacgagaccccaccggucucgaccccggcgaccaccucaaagaaaaauccaugcuaagcuacggcaacguaaucgaccucaaccaccuagacaucgacgaaccaaccggccaaaccgcagacuggcucucaaucgucguguaccucacauccuucgucguacccauacuccucaaagcacuauacaugcucaccacacgcggccgucaaaccaccaaagacaacaaaggaaugcgcgugcgauucaaagacgacuccucuuuugaagacgucaacggaauacgaaagcccaagcaccuauuccuaucaaugcccaacgcccaaucaagcaugaaagcggacgaaaucacacccggacgcuuccgcacagcagucugcggacucuacccagcacaagucaaagcccgaaaccucgucucccccgucaugucaguuauaggauuucuugcccuugccaaaaacuggaccgaacguguagaagaauggcuugaccucccaugcaaacuccucucagaacccuccccaacaucccucaccaaaggacccuccaccaaccgcgacuaccuaaaccagaggcaaggagcccucgcaaaaauggaaacaaaagaagcccaagccgucagaaaacacgccauagaugcaggcugcaauaucauagaucacaucgacucccccagcucaaucugggucuucgccggagcccccgaccgaugcccuccaaccugccuauucauagccggcauggccgaacucggcgccuucuucuccguacuacaagacaugcgcaacaccaucauggcaagcaaaaccaucggaacauccgaagaaaaacuccgcaagaaaagcuccuucuaccaaagcuaccuacgacgcacccaaagcaugggcauccaacuagaccagcgcaucaucguacuauucaugguggacuggggcaaagaagccguagauucauuccaccucggcgacgacauggaccccgaacuacgaggacuagcacaagcacucaucgaccaaaaagucaaagaaaucuccaaccaagagccccugaaacuauaa

SEQ ID NO: 7709 - RNA, 1290 nt, Artificial Sequence
  derived and/or modified CDS sequence (opt11) from DOBV(DOB/Pecs/31Aa/06)__KC848500.1__N
auggccacccucgaagaacuacaaaaagaaaucaacucccacgaaggccagcuagucaucgcccgccaaaaagucaaagacgccgaaaaacaauacgaaaaagaccccgacgaccuaaacaaacgcgcccucucagaccgugaaagcgucgcccaaucaauacaauccaaaauagacgaacuacgacgccaacucgccgacagagucgccgccggcaagaacaucggcaaagaaagagacccaaccggccucgaccccggcgaccaccucaaagagaagucaaugcucuccuacggcaacgucaucgaccucaaccaccucgacauugacgaacccaccggccaaaccgccgacuggcucuccauagucgucuaccuaaccagcuucgucgucccaauccuccucaaagcccucuacaugcuaaccacacguggacgccaaaccaccaaagacaacaaaggcaugcgcauacgcuucaaagacgacucaucauucgaagacgucaauggcauaagaaaaccaaaacaccuauuucuauccaugcccaacgcccaaucaagcaugaaagccgacgaaauaaccccaggacgcuuccgcacagcugucugcggccucuaccccgcccaggucaaagccagaaaccucguaucccccgucaugagcguaauaggcuuccucgcccuagcgaaaaacuggaccgagcgcgucgaagaauggcuggaccuccccugcaaacuccuauccgaaccaagcccaaccucccucaccaaaggccccuccaccaaccgagacuaccucaaccaacgacaaggcgcccuagccaaaauggaaacaaaagaagcacaagccgucagaaaacacgccaucgacgccggcugcaauauaaucgaccacauagacuccccaagcucaaucuggguuuucgcaggagcccccgaccgaugcccaccaaccugccucuucaucgccggcauggcacaacuaggcgccuucuucagcgugcuccaagacaugcggaacaccaucauggccucuaaaacaaucggaaccuccgaagaaaagcuacgcaagaaauccagcuucuaccaauccuaccuacgcagaacccaauccaugggcauacaacucgaccaacgcaucauaguccucuuuaugguagacuggggaaaagaagccgucgacuccuuccaccucggcgacgacauggacccagaacuccgcggccucgcccaagcucucaucgaccagaaaaugaaagaaauaagcaaccaagaaccccucaaacucuaa

SEQ ID NO: 7710 - RNA, 1290 nt, Artificial Sequence
  derived and/or modified CDS sequence (opt11) from DOBV(DOB/Sarmellek/77Aa/06)__KC848501.1__N
auggcaacccuagaagaacugcaaaaagaaaucaacucccacgaaggccagcuaguaauagcccgacaaaaagucaaagaugcagaaaaacaauacgaaaaagauccagacgaccucaacaaacgcgcccuaagcgaccgcgaauccguagcacaaaguauccaaagcaaaaucgacgaacuccgccgccaacuagcagaccgcgucgccucuggcaaaaacaucggcaaagaacgcgacccgaccggccucgacccgggugaccaccuaacagagaaaagcaugcucuccuacggcaacgugaucgaccucaaccaccuagacaucgacgaacccaccggccaaaccgccgacuggcuauccaucguagucuaccuaaccuccuucguagucccuauccuccucaaagcccucuacaugcuaaccacacgcggccgacaaaccacaaaagacaacaaaggcaugcgaauccgauucaaagacgacuccucauucgaagacguaaacggcaucagaaaacccaaacaccucuuccucuccaugcccaaugcacaauccuccaugaaagcagacgaaaucacccccggccgcuuccgcaccgccaucugcggccuauaccccgcacaagucaaagcacgcaaccuagucagccccgucaugucagucaucggauuccucgcccuagccaaaaacuggaccgaacgagucgaagaauggcuagaccuacccugcaaacuacuauccgaacccuccccaaccucccugacgaaaggccccucuaccaauagagacuaccucaaucaacgccaaggcgcccucgccaaaauggaaaccaaagaagcccaagcuguacgaaaacacgccauagaugcaggcugcaacaucaucgaucacaucgacuccccaagcuccaucuggguauucgcaggcgcccccgacagaugcccuccaaccugccucuucaucgccggcauggccgaacucggcgcauucuucuccguccuacaagacaugcgcaacaccaucauggccuccaaaaccguaggaaccucagaagaaaagcuccgcaagaaauccaguuucuaccaauccuaccuacgacgcacccaauccaugggcauacaacucgaccaacgaaucaucguccuguucaugguagacuggggcaaagaagccgucgacuccuuccaccuuggcgacgacauggaccccgaauuacgcagccucgcccaagcacuaaucgaccaaaaaguaaaagaaaucuccaaucaagaaccccucaaacuauga

SEQ ID NO: 7711 - RNA, 1290 nt, Artificial Sequence
  derived and/or modified CDS sequence (opt11) from DOBV(GER/05/239/Aa)__GQ205405.1__N
auggccacccucgaggaacuccaaaaagaaauaaacucccacgaaggccagcucguaauagcgcgccaaaaagucaaagacgcagaaaagcaauacgaaaaagaccccgacgaccucaacaagcgcgcccucuccgacagagaauccguagcccaauccauccaaggcaaaaucgacgaacuccgccgccaacuagcagaccgcgucgccgccggcaaaaacaucggaaaagaacgagaccccaccggccucgacccaggcgaccaccucaaagaaaaaucaaugcuauccuacggcaacgucaucgaccucaaccaccuagauauugacgaaccaaccggacaaaccgccgacuggcucuccauaguagucuaccucacguccuucguaguccccauccuccucaaagcccucuacaugcucacaacucgcggacgccaaaccaccaaagacaacaaaggcaugcgcauccgcuucaaagacgacuccagcuucgaagacgucaacggaauccgcaaaccaaaacaccucuuccucucaaugcccaacgcccaauccucaaugaaagccgacgagaucaccccaggccgcuuccgaaccgcuauaugcggacucuaccccgcccaagucaaggcucguaaccucguuucccccgucauguccgucaucggauuucucgcccucgcuaaaaacuggaccgaacgcgucgaagaauggcucgaccuccccugcaaacuucucuccgagccaucucccaccucccucacaaaaggccccuccacaaaccgcgacuaccucagccaacgccaaggcgcccucgccaaaauggaaaccaaagaggcacaggccguccgcaaacacgccaucgacgcuggaugcaacaucauagaccacauagacucacccuccucaaucugggucuucgccggagcccccgacagaugcccuccgaccugccuauucauagccggcauggccgaacucggcgcauucuuugccguacuacaagacaugcgcaacaccaucauggcauccaaaaccaucggaaccucagaagaaaaacuacggaagaaaagcucauucuaccaauccuaccuccgcagaacccaaucaaugggaauacaacucgaccaacgcaucaucgugcuauucaugguggacuggggcaaagaagccgucgacuccuuccacuuaggcgacgacauggaccccgaacuacgcucacuagcccaagcccucaucgaccaaaaaguaaaagaaaucuccaaccaagaaccccucaaacucuag

SEQ ID NO: 7712 - RNA, 1290 nt, Artificial Sequence
  derived and/or modified CDS sequence (opt11) from DOBV(GER/05/477/Af)__GQ205406.1__N
auggcuacccuagaagaacuccaaaaagaaaucaacucgcacgaaggccaacucgucaucgcccgacaaaaagucaaagacgcagaaaagcaauacgaaaaagacccagacgaccucaacaaacgagcucucucagaccgcgaaucuguagcccaauccauccaaggcaaaaucgacgaacuccgacgccaacuagccgaccgcgucgcugccgggaaaaacauaggaaaagaacgagaccccacagggcucgaccccggagaccaccucaaggagaaauccaugcuauccuacggcaacgucauagaccucaaccaccucgacauagacgaaccaacaggccaaacagcagacuggcugucuauaguagucuaccuaaccucauucgucguaccaauucuccucaaagcgcucuacaugcuaaccacccgaggacgccaaaccaccaaagauaacaaaggcaugaggauacgcuucaaagacgacuccuccuucgaagacguaaacggcauccgaaaacccaaacaccuauuccucucaaugcccaacgcacaaagcuccaugaaagccgacgaaaucacccccggacgcuuccgcacagcaaucugcggccucuaccccgcacaagucaaagcacgcaaccucgucuccccagucaugagcguaaucggcuuccucgcccucgcuaaaaacuggacagaacgaguugaagaauggcucgaccucccgugcaaacucaucuccgaaccaucccccacuucccugaccaaaggccccagcacaaaccgcgacuaccucucccaacgccaaggcgcccuagcaaaaauggaaaccaaagaagcccaagcaguccgcaaacacgcuaucgacgccggaugcaacauaaucgaccacaucgacuccccauccuccauaugggucuucgcaggcgcccccgaccgcugucccccaaccugccuauucaucgcuggaauggcugagcuaggcgccuucuuugccguacuccaagacaugcgcaacaccaucauggccucaaaaaccaucggcacaagcgaagaaaagcuaagaaagaaauccuccuucuaccaauccuaccuacgcagaacccaaagcaugggcauacaacuagaccaacgaaucaucguccucuucauggucgacuggggcaaagaagccgucgacuccuuccaccucggcgacgacauggaccccgagcuccgaucacucgcacaagcccugaucgaccaaaaagucaaagaaauaagcaaccaggaaccacucaaacuuuaa

SEQ ID NO: 7713 - RNA, 1290 nt, Artificial Sequence
  derived and/or modified CDS sequence (opt11) from DOBV(GER/07/293/Aa)__GQ205401.1__N
auggccacccuagaagaacuacaaaaagaaaucaacucccacgaaggccagcuagucauagcaagacaaaaagucaaagacgccgaaaaacaauacgaaaaagacccagacgaccucaacaaaagagcccuaagcgacagagaauccguggcccaauccauacaaggcaagauagacgaacuccggcgccaacuagcggaccgcgucgcagcaggcaaaaacaucggcaaagaacgcgaccccacaggacucgacccaggcgaccaccuaaaagaaaaaucaaugcuauccuacggaaacgucaucgaccuaaaccaccuugacaucgacgaacccacaggccaaaccgcugacuggcucagcaucguaguguaccuaaccucauucgucguccccauccuccugaaagcccuauacaugcucaccacccgcggccgacaaacgaccaaagacaacaaaggcaugagaaucagauucaaagacgacagcucuuucgaagacgucaacggcauccgaaaaccaaaacaccuauuccuauccaugccaaacgcccaauccagcaugaaagcagacgagauaacccccggaagauuccgcaccgccauaugcggccuguacccagcccaaguaaaagcccguaaccucguaagcccagucauguccguaaucggguuccuggcccuagccaaaaacuggacagaacgugucgaagacuggcucgaccuacccugcaaacuacuauccgaacccucuccaacaucccucacgaaaggccccaguaccaaccgcgacuaccuaaaccaacgccaaggcgcacucgccaagauggaaacaaaagaagcccaggccguccgaaaacacgcaauagacgccggcugcaacaucaucgaccacaucgacucccccuccagcauaugggucuucgccggagcccccgaccgaugcccaccuaccugccucuucaucgccggaauggcagaacuaggagccuucuucgcagugcuacaagacaugcgaaacaccauaauggccagcaaaaccaucggcacaagcgaagaaaaacuacgcaagaaaagcagcuucuaccaaagcuaccuccgccgaacccaaagcaugggcauccagcuugaccaacgcauaaucguccuccuaaugguagacuggggaaaagaagcagucgacuccuuccaccuaggagacgacauggacccagaacuacgaggccucgcacaagcacuaauagaccaaaaagucaaagaaaucucaaaccaagaaccucucaaauuauga

SEQ ID NO: 7714 - RNA, 1290 nt, Artificial Sequence
  derived and/or modified CDS sequence (opt11) from DOBV(GER/07/424/Aa)__GQ205403.1__N
auggcaacccuggaagaacuccagaaagaaauaaacucacacgaaggacaauuaguaaucgccagacaaaaaguaaaagacgcagaaaaacaauacgaaaaagacccagaugaccucaacaaaagagcccucuccgaccgagaaagcguagcccagagcauccaaggcaaaaucgacgaacuccgacgccaacucgccgacagagucgccgccgggaaaaauauagggaaagaacgcgaccccacaggccucgaccccggcgaccaucuaaaagagaaaagcaugcucucauacggaaacgucaucgaccugaaucaccucgacaucgacgaacccaccggccaaacagcggacuggcuauccauugucguauaccucaccucauucgucgucccgauacuacucaaagcccuauacaugcucaccacccgcggccgccaaaccacaaaagacaacaagggcaugagaauccgcuucaaggacgacuccuccuucgaagacgucaacggcaucagaaaacccaaacaccucuuccuaucaaugcccaacgcgcaauccagcaugaaagccgacgaaauaacacccggucgcuuccgcaccgccauaugcggacuauacccagcacaagucaaagcacgcaaccucguaagccccguaauguccgucaucggcuuccucgcccucgccaaaaacuggaccgaacgcgucgaagacuggcucgaccuccccuguaaacuccucagcgaaccaagcccaacaagccuaaccaagggccccagcaccaaccgcgacuacuuaaaccaacgccaaggagcccuggcgaaaauggaaacaaaagaagcccaggcaguccgcaaacacgccaucgacgccggcugcaacauaauagaccacaucgacucccccagcagcaucugggucuucgcaggcgcccccgaccgcugcccaccaaccugccucuucaucgccggcauggcagaacucggcgccuucuucgccguacuccaagacaugcgcaacaccaucauggccuccaaaaccaucggaaccucagaagaaaaacuucggaagaaauccucauucuaccaaagcuaccuacgacgaacccagagcaugggcauacaacuagaccaacgaaucaucguccucuucaugguagacuggggcaaagaagccgucgacuccuuccaccuaggcgacgacauggaccccgaacuacgcggccucgcccaagcccucaucgaccaaaaagucaaagaaauuuccaaccaagaaccacuaaaacucuaa

SEQ ID NO: 7715 - RNA, 1290 nt, Artificial Sequence
  derived and/or modified CDS sequence (opt11) from DOBV(GER/08/118/Aa)__GQ205407.1__N
auggccacacucgaagaacugcaaaaggaaauaaacucccacgaaggccaauuagucaucgcacgccaaaaagucaaagacgccgagaaacaauacgaaaaagaccccgacgaccuaaacaaacgagcccucuccgaccgcgaaagcguagcccaauccauccaaggaaaaaucgacgaacucagacgacaacuggccgaccgcgucgcagccggcaaaaacaucggcaaagagcgcgaccccacaggucuagaccccggcgaccaccucaaagagaaauccaugcucuccuacggcaacgucauugaccuaaaccaccuagacaucgacgaacccaccggccaaacagccgacuggcuauccaucgucgucuaccuaaccuccuucgucguccccauccuccuaaaagcccuauacaugcuuaccaccagagggcgccaaaccaccaaagacaacaaaggcaugcgaauccgcuucaaggaugacagcagcuucgaagacgucaacggcauccgaaaaccaaaacaccucuuccucagcaugccaaacgcacaaagcucaaugaaagcugacgaaaucacgcccggacgguuccgcaccgccaucugcggacuuuaccccgcccaagucaaagcacgcaaccucgucuccccagucaugucaguuauaggauuccucgcccucgccaaaaacuggaccgaacggguagaagacuggcucgaccuacccugcaaacuacucagcgaacccucacccaccucacucaccaaaggacccuccaccaaccgagacuaccuaaaccaacgucaaggcgcacucgccaaaauggaaaccaaagaagcccaagcaguacgcaaacacgcaauugacgcaggcugcaacaucaucgaccacaucgacucacccagcucaauuuggguauucgccggcgcccccgaccgcugcccucccacaugccucuucauagccggcauggccgagcucggcgcauucuucgccguacugcaagacaugagaaacacaaucauggccuccaagacaguaggcacauccgaagagaaaaugcgcaaaaaguccuccuucuaccaaagcuaccuaagacgcacucaauccaugggcauccaacucgaccaacgaaucaucguacuauucauggucgacuggggaaaggaagccgucgacuccuuccaccucggcgacgacauggacccagaacuucgcggacucgcccaagcccuaaucgaucaaaaagucaaagaaaucuccaaccaagaaccccuaaaacuauaa

SEQ ID NO: 7716 - RNA, 1290 nt, Artificial Sequence
  derived and/or modified CDS sequence (opt11) from DOBV(GER/08/131/Af)__GQ205408.1__N
auggccacccuugaagaacuccaaaaagaaaucaacucacacgaaggacagcuaguaauagcccgccaaaaagucaaagacgcagaaaaacaauacgaaaaagaccccgacgaccucaauaaaagagcccucagcgaccgcgaguccgucgcacaauccauccaaggcaaaaucgacgaacuacgccgccaacuugccgaccgcgucgcagccggaaagaacaucggaaaagaacgcgaccccacuggccucgacccaggcgaucaccucaaagaaaagucaaugcuguccuacggcaacgucaucgaccuaaaccaccucgacaucgacgaacccaccggccaaaccgccgacuggcucucaaucgucgucuaccuaaccuccuucguaguccccauccuccuaaaagcacuauacaugcucaccaccagaggccgccaaaccacaaaagacaacaaaggcaugcgcauacgauucaaagacgacuccagcuucgaagacgucaacggcauucgcaaaccaaaacaccucuuccucuccaugcccaacgcccaaagcagcaugaaagccgacgaaaucacgcccggccgcuucagaaccgccgucugcggccuauacccagcccaaguaaaagcccgaaaccuagugucccccguaaugucagucaucggcuuccuugcccuagccaaaaacuggacagaacgcgucgaagacuggcuagaccuacccugcaaacuccuaucagaacccagccccaccucacucaccaagggacccuccaccaaccgcgacuaccucaaccaacgccaaggcgcacucgcaaaaauggaaacaaaagaagcccaggccguacgcaaacacgcuaucgacgccggcugcaacaucaucgaucacaucgacucaccaucaagcaucuggguauucgcaggcgcccccgacagaugcccaccaaccugccucuucauagcaggaauggcagaacucggcgccuuuuucgccguccuacaagauaugcgcaacacaaucauggcauccaaaaccauaggcacguccgaagaaaaacuccgcaagaaauccuccuucuaccaguccuaccuccgccgaacccaaucaaugggcauccaacuagaccaacgcauaaucguacucuucauggucgacuggggcaaggaagccgucgacucauuccaccuaggcgacgacauggaccccgaacuccgaggccucgcccaagcccucaucgaccaaaaagucaaagaaauauccaaccaagaaccccuaaaacucuaa

SEQ ID NO: 7717 - RNA, 1290 nt, Artificial Sequence
  derived and/or modified CDS sequence (opt11) from HTNV(76-118/POR)__KT885049.1__N
auggccaccauggaggaacuccaacgagagauaaacgcccacgaaggccagcuagucaucgccagacaaaaaguccgagacgccgaaaaacaauacgaaaaagaccccgacgaacucaacaagagagcccuaaccaaccgagaaggcgucgcagucuccauccaagcaaaaaucgacgaacucaaaaugcaacuagcagacagaauagcuaccggcaaaaaccucggaaaagagcaagaccccacaggcguagaacccggcgaccaccucaaagaaagauccaugcucucauacggcaacguacuagaccucaaccaccucgacauagacgaacccaccgggcaaacagccgacuggcucuccauaaucgucuaccucaccuccuucgucgucccaauccuccucaaagcacuauacaugcuaaccacccggggcagacaaacuaccaaagacaacaaaggcacccggaucagauucaaggacgacagcucauucgaagacgugaacggcauccgaaaacccaaacaccuuuacgucucccuccccaacgcacaaucaagcaugaaagccgaagaaaucacgccuggccgcuaccgaaccgcaguaugcggccucuaccccgcacaaaucaaagccagacaaaugaucucccccgucaugucaguaauagguuuccucgcccucgccaaagacuggagcgaccgcaucgaacaauggcugaucgaaccaugcaaacuccuccccgacacagccgcggucagccuccuaggcggaccagccacaaacagagacuaccucagacaacgccaagucgcccucggcaacauggaaaccaaagaaagcaaagcaauacgacagcacgccgaagcggccggaugcuccaugaucgaagacauagaaagcccaagcucaauaugggucuucgccggcgcccccgaccgcugcccaccaaccugccucuucaucgccggaaucgcagaacuuggcgccuucuucucuauccuccaagacaugcgcaacaccaucauggcaagcaaaacagucggcaccagcgaggagaaacuaagaaagaaauccuccuucuaccaaucauaccucagacgcacccaguccaugggcauacaacucgaccaacgaaucauaguccucuucaugguagcauggggcaaagaagcagucgacaacuuccaccuaggcgaugacauggaccccgaacuccgcacccucgcccaaagccucaucgacguaaaagucaaagaaaucuccaaccaagaaccccucaaacucuaa

SEQ ID NO: 7718 - RNA, 1290 nt, Artificial Sequence
  derived and/or modified CDS sequence (opt11) from HTNV(A16)__AF288646.1__N
auggccaccauggaagaacuacaacgggaaaucaacgcccacgaaggccagcuagucaucgcacgccaaaaaguccgagacgcagaaaaacaauaugaaaaagacccagacgaacuaaacaaacgcgcacugacagaccgcgaaggccucgccgccagcauccaagccaaaauagacgaacuaaaacgccaacuagccgaccgcauagcuaccgguaaaaaccuaggcaaagaacaggacccaacaggcguagaaccgggagaccaccuaaaagaacguuccaugcucuccuacggcaacguccucgaccuuaaccaccuagacauagacgaacccacaggacaaacagcagacuggcuauccaucguaaucuaccucaccagcuucguaguccccauccuccucaaagcccucuacaugcucacaacccgcggccgccaaaccaccaaagacaacaaaggcacgcgaauacgcuucaaagacgacuccucauucgaagacguaaacggcauccgaaaacccaaacaccuauacgucucacuacccaaugcccaauccucaaugaaagccgaagaaaucaccccaggccgauaccgcaccgcgaucugcggccuauacccugcacaaaucaaggcccgccaaaugaucagcccgguaaugucaguaaucggauuccucgcacucgccaaagacuggucagaccgcaucgaacaauggcucucagaacccugcaaacuacuccccgacaccgccgccgucagccuacacggcggccccgcaaccaaccgcgacuaccuccgccaacgccaagucgcccucggcaacauggaaaccaaagagucuaaagcaauccgacaacacgccgaauccgcgggaugcucaauggucgaagacaucgaaucacccagcucaaucugggucuucgcaggagcaccaaaccgaugcccacccacaugccucuucauagccggcauagccgaacucggcgcauucuucuccauccuccaagacaugcgcaacacaauaauggccuccaaaaccgucggcacaucggaagaaaaacuacgaaagaaaucaucguucuaccaaucuuaccuccgccgcacacaauccaugggaauccagcuagaccaacggaucauaguccucuucaugguagccuggggaaaagaagccguagacaacuuccaccucggcgacgacauggaucccguccuacgcacacuagcgcaaagccucaucgacgucaaaguuaaagaaauuucaaaccaagaaccccucaaacucuaa

SEQ ID NO: 7719 - RNA, 1290 nt, Artificial Sequence
  derived and/or modified CDS sequence (opt11) from HTNV(CA09082007)__HQ834499.1__N
auggcaaccauggaggaacuucaacgggaaaucaacgcccacgagggccaacucgucaucgcccgacaaaaaguccgcgacgccgaaaaacaauacgaaaaagacccagacgaacuaaacaaacgcgcccuaaccgaccgcgaaggcgucgccgcgagcauacaagccaagaucgacgaacuaaaacgccaacucgccgacagaaucgcaaccggcaaaaaccucggaaaagaacaagaccccaccggagucgaacccggagaccaccucaaagaacgcuccaugcuaagcuauggcaacguccuagaccucaaccaccucgacauagacgaacccaccggacaaaccgccgacuggcucucgaucguaauauaccucaccuccuucgucgucccuauacuccuaaaagcccucuacaugcuaacaacccgcggcagacaaacaaccaaagacaacaaaggaacaaggauccgauucaaagacgacagcucauucgaagacgucaacggcauccgcaaacccaaacaccuauacgucucacucccuaacgcacaaucguccaugaaagccgaagagaucacuccaggccgcuaccgcaccgccauaugcggccuauaucccgcacaaaucaaagcccgccaaaugauaucccccgucaugagcgucauaggcuuccucgcucucgcaaaggacugguccgaccgcauagaacaauggcucucagaacccugcaaacuacucccagacaccgcagcggucucccugcacggcggaccugcaaccaacagagacuaccuccgccagcgccaaguugcacucgguaacauggaaacaaaggaauccaaagccauccgccaacacgcugaauccgcaggaugcucaauggucgaagacaucgaaagccccagcucaaucuggguauucgccggcgcccccgaccgcugcccaccaaccugccucuucaucgccggcaucgcagaacugggcgcauucuucagcauccuccaagacaugcgaaacaccaucauggccucaaaaaccgucggaacaagcgaagaaaaacuccgcaagaaaucaucauucuaccaauccuacauccggcgcacacaaucaaugggcauccaacuagaccaacgcaucauaguacucuucaugguagccuggggcaaagaagcuguagacaacuuccaccucggagacgacauggaccccgaacuacgcacccuugcccaaucccuaaucgaucucaaaguaaaagaaauaucaaaccaagaaccacucaaacucuaa

SEQ ID NO: 7720 - RNA, 1290 nt, Artificial Sequence
  derived and/or modified CDS sequence (opt11) from HTNV(CA10081109)__HQ834500.1__N
augcccaccucaggagaacuacaacgagaaaucaacgcacacgaaggccaacuugucaucgcccgucaaaaaguccgugacgccgaaaaacaauacgaaaaagaccccgacgaacuaaacaaacgagcccucacagaccgagaaggcguagccgcauccauacaagccaaaaucgacgaacucaaacgccaacucgcagacagaaucgccaccggcaaaaaccucggcaaagaacaagaccccaccggcguagaaccaggcgaucaccucaaagaacgcuccaugcuauccuacggcaacguacuggaccucaaccaccucgacaucgacgaaccaaccggccaaacagccgacuggcucuccaucguaaucuaccucaccuccuucguagucccaauccuacucaaagcccucuacaugcucacgacacgcggccgccaaaccaccaaagacaacaaaggcacccguauucgcuucaaagacgacuccagcuucgaagacgugaacggcaucagaaaacccaaacaccucuacgucucccuacccaacgcccaaucaagcaugaaagcagaagaaaucaccccaggacgauaccgcacagccaucugcgaacucuacccagcccaaauaaaagccagcaaaaugaucagccccguaaugucaguaaucggcuuccuggcacuagccaaagacuggagcgacagaaucgaacaauggcuguccgaaccaugcaaacuccuacccgacaccgcagccguaucccuacacggcggccccgcuacaaaccgcgacuaucuccgccaacgccaagucgcccuaggaaacauggaaacaaaagaauccaaggccauccgacaacacgccgaguccgccggcugcucaaugguugaagacaucgaaagcccauccucaaucugggucuucgccggagcccccgaccgcugcccgccaaccugccuguucauagccggaaucgccgaacucggcgccuucuucuccauccuccaagacaugcgcaacaccauaauggcaagcaaaacagucggcaccuccgaggaaaaacuccgaaagaaauccuccuucuaccaaucauaccugcgaaggacccagagcaugggcauacaacuagaccaacgcauaaucguccucuucauggucgccuggggaaaagaagccgucgacaacccccacgccggcgacgauguagaucccucccuaggcaugcucgcacaaucccucaucgacgugaaagucaaagaaaucuccaaccaagaaccccuaaaacucuga

SEQ ID NO: 7721 - RNA, 1290 nt, Artificial Sequence
  derived and/or modified CDS sequence (opt11) from HTNV(CA10081113)__HQ834501.1__N
auggcaaccuccggcgaacuccaacgcgaaaucaacgcccacgaaggccaacucguuaucgcccgccaaaaaguccgcgacgccgaaaaacaauacgaaaaagaccccgacgaacuaaacaaacgcgcccuaaccgaccgcgaaggcgucgccgccuccauccaagccaaaaucgacgaacuaaagcgacaacucgccgaccgcaucgcaaccggcaaaaaccucggaaaagaacaagaccccaccggcguggaaccaggagaucaccucaaagaacgcucgaugcuaagcuaugguaacguacucgaucuaaaccaccucgacaucgacgaaccaacaggccaaaccgcagacuggcucucaauagucauauaccucaccuccuucgucguaccaauacuccucaaagcacuauacaugcuaaccacccgcggccggcaaaccacaaaagacaacaaaggcacccgcauacgauucaaagacgacagcuccuucgaagacgucaacggaauccgaaaaccaaaacaccucuacgucucccuaccaaacgcccagagcuccaugaaagcagaagaaaucacccccggccgauaucgcaccgcaaucuucgaacuauaccccgcccaaauaaaagcccgacaaaugauaagcccagucaugagcgucaucggcuuccuagcccuggccaaagacuggagcgaccgaauagaacaauggcucagcgaaccuugcaaacuacuccccgacacagccgccgucucccuccacggcggccccgcaacaaaccgcgacuaccuccgccaaagacaagucgcccucggaaacauggaaaccaaagaaagcaaagccaucagacaacacgccgaaucagccggcugcuccauggucgaagacauagaaagcccaagcagcauuuggguauucgccggcgcaccagaccgaugcccaccaaccugccuguucaucgccggcaucgccgaacucggcgccuucuucuccauccuacaagacaugcgcaacacgaucauggcaagcaaaacagucggcacauccgaagaaaaacuuagaaagaaauccagcuucuaccaaagcuaccuccgcagaacacaauccaugggcauccaacucgaccaacgcauaauaguacuauucaugguagcauggggaaaagaagccguagacaacagacaccuaaugaacaucgucgaccccgaaccccgcgcccuagcacaaucccucaucgacguaaaaguaaaagaaaucagcaaccaagaaccccucaaacucuaa

SEQ ID NO: 7722 - RNA, 1290 nt, Artificial Sequence
  derived and/or modified CDS sequence (opt11) from HTNV(CA10081203)__HQ834502.1__N
auggcaacaaacggcgaacuccaacgcgaaauaaacgcccacgaaggacaacuugucauagccagacaaaaaguccgagacgcggaaaaacaauacgaaaaggaccccgaugaacuaaacaaaagagcacugaccgaccgagagggcgucgccgcauccauccaagccaaaauagacgaacuaaaacgacaacucgcagaccgcauagcaacaggcaaaaaccucgggaaagaacaagaccccaccggagucgaaccaggcgaccaucuaaaagaacgcuccaugcucuccuacggcaacguucucgaccucaaccaccucgacaucgacgaaccaacaggccaaaccgcagacuggcucagcaucguaaucuaccucaccuccuucguaguccccauccuccucaaagcacuguacaugcuaaccacccgcggccgacaaaccacaaaagacaacaaaggcacccgaauccgauucaaagacgacagcucguucgaagacguaaacgguauccgcaaacccaagcaccuauacguaucacucccaaacgcacaauccuccaugaaagccgaagaaauaacacccggcagauaccgaaccgcaaucuucggacuauaccccgcccaaauuaaagcccgacaaaugaucagcccggucauguccguaauaggauuccuggcccuagccaaagacuggagcgaccgcauagaacaauggcuaagcgaacccugcaaacuacugccagacacagcagccgucucacuccacggcgggcccgccaccaaccgcgacuaccucagacagagacaagucgcccucggcaacauggagaccaaagaauccaaagccauccgccaacacgcagaauccgccggcugcucaaugguagaagacaucgaauccccaagcuccaucugggucuucgccggcgccccagaccgcugcccaccaaccugccuauucauagccgggaucgccgaguuaggagcauucuucuccauacuccaagacaugagaaacacaauaauggccucaaaaaccgucggaaccagcgaagaaaaacuccguaagaaaagcuccuucuaccaaagcuaccuacgccgcacccaauccaugggcauacaacucgaccagcgcaucaucguacuauucaugguagcauggggcaaagaagccgucgacgagcuacacaguggcgacggcgaacaccacgccucccgaacccucgcccaaucccuaauagacguuaaagucaaagaaaucagcaaccaagaaccccucaaacucuaa

SEQ ID NO: 7723 - RNA, 1290 nt, Artificial Sequence
  derived and/or modified CDS sequence (opt11) from HTNV(CA10081206)__HQ834503.1__N
auggcaaccaucgaagaacuccagcgcgagaucaacgcccacgaaggacaacucgucauagcccgccaaaagguacgcgacgccgaaaaacaauacgaaaaagaccccgacgagcuaaacaaacgcgcacugaccgacagagaaggagucgccgccagcauccaagccaaaauagacgaacuaaaacgacaacucgccgaccgcaucgccacaggcaaaaaccuaggaaaagaacaagaucccacaggcguagaaccaggcgaccaccucaaagaacgcagcauguuaagcuacgguaacguccucgaccucaaccaccuagacauugacgaacccacaggacaaaccgccgacuggcucagcauagucaucuaccugaccuccuucgugguacccauccuccugaaagcccucuacaugcuaaccaccagaggacgacaaacaaccaaagacaacaaaggaacccgcauacgcuucaaagacgacuccagcuucgaagacguaaacggaauccgcaaacccaaacaccucuacgucucccuccccaacgcccaaucauccaugaaagcggaagaaaucacgcccggacgcuaucgcaccgcaaucugcggccucuacccagcucagauaaaagcccgacaaaugaucucacccguaauguccguaaucggguuccucgcacuagccaaggacuggagcgauagaauagaacaauggcuauccgaaccaugcaaacuccuccccgacaccgcagccgucucgcuccacggcggcccagccaccaacagagacuaccugcgacaacgccaagucgcccuaggaaacauggaaacaaaagaaagcaaagccaucagacaacacgccgaaucagccggauguucgauggucgaagacaucgaaagccccuccucaaucugggucuucgccggcgcucccgaccgaugucccccaaccugccucuucauagcaggcauagcggaacucggagcauucuuuagcauccuccaagacaugagaaacacaauuauggccucaaagaccgucggcaccagcgaagagaaacuacggaagaaaagcucauucuaccaauccuaccuccgccgcacccaauccaugggcauccaacucgaccaacgcaucaucguauuauucauggucgccuggggaaaagaagcaguagacaacuuccacgcaugggacggcauggaccccgaacuaagaacacucgcccaaucacucauagacgucaaagucaaagaaaucucaaaccaggaaccgcucaaacucuaa

SEQ ID NO: 7724 - RNA, 1290 nt, Artificial Sequence
  derived and/or modified CDS sequence (opt11) from HTNV(CA10081708)__HQ834504.1__N
augcccacaucaggagaacuccaacgagaaauuaaugcccacgaaggacaacuggucaucgcccgccagaaaguacgcgacgccgaaaaacaguacgaaaaagaccccgacgaacuaaacaaaagggcccucaccgaccgcgaaggaguagccgccagcauacaagcaaaaauagacgaacuaaaacgacagcucgcggaccgcaucgcaacuggcaaaaaccucggaaaagagcaagaccccaccggcgucgaacccggcgaccaccucaaagaacgcuccaugcucagcuaugguaacguccucgaccuuaaccaccucgacaucgacgaaccaacaggccaaacggcagacuggcuauccaucgucaucuaccucaccuccuucguggucccaauacuacucaaagcccuguacaugcucacaacccgcggcagacaaacaaccaaagacaacaaagggacccgaauccgauucaaggacgacuccuccuucgaggacguaaacggcauaagaaagccgaaacaccucuacgucucgcucccaaacgcacaauccucaaugaaagccgaagaaaucaccccaggccgcuaccgcacagccaucuucgaacucuaccccgcacaaaucaaagcacgcaaaaugaucagcccuguaaugagcgucauaggauuccuagcccucgccaaagacuggagcgaccgcaucgaacaauggcucagcgaacccugcaaauuacuccccgacacugccgccgucagccuccacggcggccccgcgaccaaccgagacuaccuacgccaaagacaaguagcccucggcaacauggaaaccaaagaaagcaaagccauacgccagcacgcggaaucugccggcugcucaauggucgaggacaucgaaagcccauccucaaucugggucuucgccggggccccagaccgaugcccacccacaugccuguucaucgccggcaucgccgaacuaggagccuucuucagcauacuccaagacaugcgaaacaccauaauggcgagcaaaaccgucggcacgagcgaagaaaaacuccgcaagaaaagcucauucuaccaaucauaccuccgccgaacacaauccaugggcauacaacuagaccaacgaaucaucguccuauucaugguggccuggggcaaagaagcagucgacaacccccacacaggcgacgacgccgacccggaacuccgcacccucgcccaaucacuaaucgacgucaaaguaaaagaaaucuccaaccaagaaccccuaaaacucuaa

SEQ ID NO: 7725 - RNA, 1290 nt, Artificial Sequence
  derived and/or modified CDS sequence (opt11) from HTNV(CA10081905)__HQ834505.1__N
auggcgacauccggagaacuccaacgagaaaucaacgcccacgaaggccagcuagucauagcacgccaaaaaguccgcgacgccgaaaaacaauacgaaaaagaccccgacgaacucaauaaaagagcacucaccgaccgcgaaggagucgccgcaucaauccaggccaaaauagaugaacuuaaacggcaacucgccgaccgcaucgcaaccggcaaaaaccuaggaaaagaacaagaccccaccggagucgaaccgggcgaccaccuaaaagaacgauccaugcucuccuacggaaacguccucgaccucaaccaccuagacauagacgaacccaccggucaaacagcagacuggcucagcauagucaucuaucucacaucauucguagugccaauccuccucaaagcccuauacaugcuuacaacccgaggacgccaaacaaccaaagacaacaaaggcacacgcauccgauucaaagacgacagcagcuucgaagacgucaacggaauacgaaaaccaaaacaccucuaugucagccuccccaacgcgcaaucgaguaugaaagccgaagaaaucacccccggacgauaccgcaccgcaaucuucgagcuauaccccgcccaaaucaaagccagaaaaaugaucucccccgucauguccgucaucggauuccuagcccuagcaaaagacuggagcgaccgcaucgaacaauggcucuccgaaccaugcaaacuucucccagacaccgcagccgucucacuccacggcggaccagccacaaaucgagacuaccuaagacaacgacaaguggcccucggaaacauggaaacaaaagaauccaaggccauccgccaacacgcagaaagugccggaugcagcauggucgaagacaucgaaagcccauccucaaucuggguauucgccggggcacccgacagaugcccacccacgugccuauucaucgccggcaucgccgaacugggcgccuucuucuccauccuccaagacaugcgcaacaccaucauggccuccaaaaccguaggaaccucagaagaaaaacuccgaaagaaaagcuccuucuaucaaagcuaccuaagaagaacccaauccaugggcauacaacuagaccaacgcaucaucguacuguucaugguagcauggggcaaagaagccgucgacaaccaccaccucaucaacgccggcgaccacgaacuacgcacccucgcccaaagccucaucgacgucaaaguaaaagaaauauccaaccaagaaccccuaaaacuuuaa

SEQ ID NO: 7726 - RNA, 1290 nt, Artificial Sequence
  derived and/or modified CDS sequence (opt11) from HTNV(E142)__AF288644.1__N
auggccaccauggaagaacuccaacgcgaaaucaacgcacacgaaggccaacucgucaucgcgcgacaaaaggucagagacgccgagaaaagauacgaaaaggaccccgacgaacuaaacaagcgcacccucaccgaccgagaaggcguagccgccucaauccaagccaaaaucgacgaacuaaaacgccagcuagcagaccgcauagccaccggaaagaaccucggcaaggaacaagaccccaccggggucgaacccggagaccaccuaaaagaacgauccaugcucagcuacggcaacguccuggaccuaaaccaccuagacaucgacgaaccaaccggacaaaccgcagacuggcucagcauugucauauaccuaaccuccuucgucgucccaauacuccucaaagcacuauacaugcucacaacccggggccgccaaacgacaaaagacaacaaaggaacccgcauccgauucaaagacgacuccucaucagaagacgucaacggaauccgcaaacccaagcaccuauacguaucccuccccaacgcccaaaguagcaugaaagccgaagaaauaacccccggccgcuacagaaccgccaucugcggccucuaccccgcgcaaauaaaagcccgccaaaugaucagccccguaauguccgucaucgguuuccucgcccuagccaaagacuggagcgaccgcauagaacaaugguuauccgaacccuguaaacuacucccagacaccgcagcggucucccuacacggcggacccgcuacaaacagagacuaccuccgacaacgccaagucgcacucggcaacauggaaaccaaagaaagcaaggccauccgccaacacgcagaaucagcaggcugcagcaugauagaagacaucgaaucacccagcucuaucuggguauucgcaggagccccugaccgcugcccuccaaccugccucuucaucgccggcaucgccgaacucggcgccuucuucuccauccugcaagacaugcgcaacaccaucauggccucaaaaaccgucggcaccuccgaagaaaaacuacgcaagaaauccuccuucuaucaauccuaccuaagacgcacacaaucaaugggcauccaacuugaccaacgcaucaucguccuauucauggucgcauggggcaaagaagucgucgacaacuuccaccucggagacgacauggaccccgaacuacguacccuagcccaaucacucaucgacgucaaagucaaagaaauaucaaaccaagagccccuaaaacucuaa

SEQ ID NO: 7727 - RNA, 1290 nt, Artificial Sequence
  derived and/or modified CDS sequence (opt11) from HTNV(H10150)__HQ834506.1__N
auggcuaccaugggcgagcuccagcgcgaaaucaacgcacacgaaggccaacucgucaucgcacgccaaaaaguacgugacgccgaaaaacaauacgaaaaagacccagacgagcucaacaaacgcgcccuaaccgaccgagagggaguagccgccucaauccaagccaaaaucgacgaacuaaaacgacaacuagcagaccgcaucgccaccggcaaaaaucuaggaaaagaacaagaccccaccggcgucgagcccggagaccaccucaaagaaagaucaaugcuaagcuacggcaacguccucgaccugaaccaccucgacauagacgaaccaaccggccaaaccgccgacuggcucuccaucgucaucuaccucaccagcuucguagucccaauccuccucaaagcccuauacaugcucaccacccgaggccgccaaacaaccaaagacaacaaaggaacccgaauccgcuucaaagacgacuccagcuucgaagacgucaacggcauacgcaagccaaaacaccucuacgucagccucccaaacgcccaaucauccaugaaagcagaagaaauaaccccaggccgcuaccgaaccgccaucuucggacuauaccccgcccaaaucaaagcacgccaaaugaucucccccguaaugagcguaauaggauuccuagcacucgcuaaggacugguccgaucggaucgaacaauggcucagcgaaccaugcaaacuacuccccgacaccgccgcgguaucgcuccacggcgggcccgccaccaaucgcgacuacuuacgucaacgacaagucgcccucggcaacauggaaacgaaagaaagcaaagccauacgccaacacgccgaauccgccggcugcucaauggucgaagacaucgagucccccagcuccaucugggucuucgccggcgcccccgaccgcugcccaccaaccugccuauucauagcaggcaucgcugaacucggagccuucuucuccauccuccaagacaugcgcaacaccaucauggcaucaaaaaccguuggcaccagcgaagaaaagcuacgaaagaaaagcuccuucuaccaaagcuaccuacgcagaacacagucaaugggcauccaacuagaccaacgcaucauaguccucuuuauggucgccuggggcaaagaagcagucgacaaccaccacugggcaaacgccaucggauccgaacuccgcacccucgcucaaucacucauagacguaaaagucaaagaaauauccaaccaagaaccacuaaaacucuaa

SEQ ID NO: 7728 - RNA, 1290 nt, Artificial Sequence
  derived and/or modified CDS sequence (opt11) from HTNV(Aa03-161)__KT935024.1__N
auggcgacaauggaagaacuacaacgcgaaaucaacgcccacgaaggacaacuggucauagccagacaaaaggucagagacgccgaaaaacaauacgaaaaagacccagacgaacucaacaaaagggcucuaaccgaccgcgaaggaguagcaguaagcauacaagccaaaauagacgaacucaaacgacaacuagcagaccggaucgcaacugggaaaaaccucggaaaagagcaagaccccacgggcgucgaaccaggagaccaccugaaagaacgauccaugcuaagcuacggaaacguccuggaccucaaccacuuagacauagacgaaccgaccggacaaacagccgacuggcuaagcauagucguauacuuaacaucauucguagucccaauccuccuaaaagcacucuacaugcuaacaacccgcggcagacaaacaaccaaagacaacaaagggacaaggaucagauucaaagacgacagcucauucgaagacguaaacgggauccgaaaacccaaacaccucuacgucucacucccgaacgcacaaagcucaaugaaagcagaagaaaucacacccggcagauaccgcacagccguaugcggccuauacccagcgcaaauaaaagcacgccagaugaucucaccagucaugagcgugaucggauuccuagcacuagccaaagacuggagcgacagaauagaacaauggcucagcgaacccugcaaacuccuaccagacgcggcggcagucagccuccucggcggccccgcaaccaacagagacuaccuacgccaaagacaggucgcacuaggaaacauggaaaccaaagaaagcaaggcaauucgacagcacgcggaagcagccgggugcucaaugauagaagacaucgaaagcccgagcuccaucuggguauucgccggcgccccggaccgcugcccacccacaugccucuucaucgccggaaucgccgaacugggcgccuucuuuuccauacuccaagacaugcgaaacaccauaauggcgagcaaaaccguaggaaccagcgaagaaaaacuccggaagaaaagcucauucuaccaaucauaccuacgaagaacccaaagcaugggcauccaacuagaccagcgaauaaucguucucuuuaugguggccuggggcaaggaagccgucgacaacuuccaccuaggcgacgacauggaccccgaacuacgaacacucgcacaaucccucauagacguaaaaguaaaagaaaucucgaaccaagaaccgcucaaacuauga

SEQ ID NO: 7729 - RNA, 1290 nt, Artificial Sequence
  derived and/or modified CDS sequence (opt11) from HTNV(Aa04-722)__KU207190.1__N
auggcgaccauggaggaacuccagcgcgagaucaacgcccacgaaggccaacuggugauagcccgacaaaaaguaagggacgcggaacgucaauacgaaaaagacccagacgagcuuaacaaacgagcacucaccgaccgagagggcguagccguaucaauccaagcaaaaauagacgaacucaaacgacaacucgcggaccgcaucgcgaccggcaaaaaccucggaaaagaacaggacccaacuggcguggaacccggcgaccaccucaaagaacgcucaaugcuauccuacggcaacguacuagaccucaaccaucucgacaucgacgaacccacagggcaaacagccgauuggcugagcauagucguguacuugacauccuucgugguaccaauccuacucaaagcccuauacaugcucacaacccgggguagacaaaccaccaaagacaacaaaggaacaagaauaagauucaaagacgacagcagcuucgaagacgucaacggcauaaggaaaccgaaacaccucuacgucucacucccaaacgcccaaucgagcaugaaagccgaggaaaucacgcccggccgcuaucgcacagccguaugcggacucuacccagcacaaauaaaagcacgacaaaugaucagcccaguaaugagcguaaucggcuuccuagcacuggccaaagacuggagcgaccgcauugaacaauggcuuagcgaaccaugcaaacuccucccagacaccgccgcgguaucacuccuaggcgggcccgcaaccaaccgcgacuaccuccgccaacgccaagucgcccucggcaacauggaaaccaaagaaagcaaagccauccgacaacacgcagaagcagcuggaugcucaaugauagaagacaucgaauccccaagcucgaucugggucuuugccggcgccccagacagaugcccacccacaugccucuucauagccggaaucgccgaacucggcgcauucuucaguauacuccaagacaugcgcaacaccauaauggcaagcaaaaccgucggaacaagcgaagaaaaacuacgcaagaaaagcagcuucuaccaaucguaccuacgaagaacccaaagcaugggcauacaacuagaccaacgcauaauaguccucuucauggucgccuggggcaaagaagccgucgacaacuuccaccugggcgacgacauggacccggaauuacgaacacucgcgcaaucacuaauagacguaaaagucaaagaaaucucgaaucaagaaccccucaaacucuaa

SEQ ID NO: 7730 - RNA, 1290 nt, Artificial Sequence
  derived and/or modified CDS sequence (opt11) from HTNV(Aa05-190)__KT935027.1__N
auggcaaccauggaagaacuccaacgcgaaauaaacgcccacgaaggacaacugguaauugccagacaaaaaguccgagacgcagaaaaacaauacgaaaaagacccagaugaacucaauaaaagagcccucaccgaccgcgaaggcguggcaguaagcauacaagcaaaaauagacgaacucaaacgacaacucgcggaccggaucgccaccggcaaaaaccucggaaaagaacaagaccccacagguguagagccaggagaccaccuaaaagaacgcuccaugcugagcuacggcaacguacucgaccucaaccaccucgacaucgacgaaccaaccggccaaaccgcagacuggcuaagcaucguaguguaccuaaccucauucgucguccccauccuacucaaagcccucuacaugcucacaacccgcggcaggcaaacaaccaaagacaauaaaggcacccguaucagauucaaagacgacaguucuuucgaagauguaaacgggauacggaaacccaaacaccucuacgucucacucccaaacgcacaauccagcaugaaagccgaagaaauuacccccggacgauaccguacagcaguaugcggacucuaccccgcacaaauaaaagcacgccaaaugauaagcccggucaugagcgugaucggauuccuggcccucgccaaagauuggagcgaccgcaucgaacaauggcuauccgaacccugcaaacuacuccccgacacagccgccgucucccuacuaggcgggccagcaaccaaccgcgacuaccuacgacaacgacaagucgcgcucggaaacauggaaacaaaagaaagcaaagccaucagacaacacgcggaagccgccggcugcucaaugaucgaagacauugagagcccaagcucaaucugggucuucgccggagccccggacagaugcccgccgacaugccuauucaucgccggcauagcagaacucggagcguucuucagcauacuacaagacaugcgcaacaccaucauggcaagcaaaaccguaggcacauccgaggaaaagcuacgaaagaaauccucguucuaccaauccuaccuacgccgcacacaaucaaugggcauacaacuagaccaacgaaucauugugcuauucaugguagccuggggaaaagaagcggucgacaacuuccaccuuggcgacgacauggacccagaacuacgcacacucgcccaaucguugauagacguaaaaguaaaagagaucucgaaccaagaaccccucaaacucuag

SEQ ID NO: 7731 - RNA, 1290 nt, Artificial Sequence
  derived and/or modified CDS sequence (opt11) from HTNV(Aa10-123)__KT935036.1__N
auggcaaccauggaagaacuccagcgcgaaaucaacgcccacgaaggacaacucgucauagcccgacaaaaagucagagacgcagaaaaacaauacgaaaaggaccccgacgaacucaacaaaagagcccucacugaccgcgaaggcgucgccguaagcauccaagcaaaaaucgacgaacucaaacgccaacucgcagacagaauagccaccggcaaaaaccucggaaaagaacaagaccccaccggagucgaaccgggcgaccacuuaaaagaacgcuccaugcucuccuacggcaacguccucgaccucaaccaccuagacaucgacgaacccaccggccaaaccgccgacuggcuaagcauaguaguauaccugaccuccuucguagucccaauccuacucaaagcacuguacaugcucaccacccgaggaagacaaacaaccaaggacaacaaaggaacaagaaucagauucaaggacgacuccuccuucgaagacgucaacggcaucagaaaaccaaaacaccucuacgucucacuaccgaacgcacaauccuccaugaaagcagaagaaauaacaccagggcgcuaccgcacagcaguaugcggccuauaccccgcacaaauaaaagcccgccaaaugaucagcccagucaugagcgugaucggguuccuagcacuagccaaagacuggucagaucgaauagaacaauggcuaagcgaaccaugcaaacugcucccagacaccaccgcaguaucccuccuaggcgggcccgcgaccaaccgcgacuaccuaagacagcgccaagucgcccucggaaacauggaaacgaaagaaagcaaggccauccgacaacacgcagaagcggccggaugcucgaugaucgaagacaucgagagccccuccagcauaugggucuucgccggggccccagaccgcugcccacccacaugccuguucguggccggaaucgcagaauuaggagcauucuucagcauacuacaagacaugcgaaacaccauaauggcaagcaagaccguaggcacgagcgaagaaaaacucagaaagaaaagcucauucuaccaaagcuaccuccgcagaacccaguccaugggaauacaacuagaucaacgcaucaucguacucuucauggucgccuggggcaaagaagcggucgauaacuuccaccucggugacgacauggacccagaacuccgcacccuagcgcaaucccucauagacgucaaagugaaagaaaucuccaaccaagagccccuuaaacucuaa

SEQ ID NO: 7732 - RNA, 1290 nt, Artificial Sequence
  derived and/or modified CDS sequence (opt11) from HTNV(Aa10-265)__KU207194.1__N
auggccaccauggaagaacuccaacgagaaauaaacgcccacgaaggacaacucgucauagcccgacaaaaaguccgcgacgccgaaaaacaguacgagaaagaccccgacgaacucaacaaacgcgcccucaccgaccgcgaaggcgucgccguauccauccaagcaaaaaucgacgaacucaaacgacaacuagccgaccgaaucgccaccggcaaaaaccucggcaaagaacaagaccccaccggagucgaacccggagaccaccucaaagaacgcucuaugcucuccuacggcaacguucucgaccuuaaccaccucgacaucgacgaaccaaccggacagacggcggacuggcucuccaucgucgucuaccuaaccucauucgucgucccaauccuacuaaaagcacuauacaugcucaccacccgcggccggcagaccacaaaagacaacaaagggacccgcauccgauucaaagacgacagcucauucgaggacgucaacggcauacgcaaaccaaaacaccuauacgucucccuacccaacgcucaguccucaaugaaagcagaagaaaucacacccggccgcuacagaaccgccgucugcggccuuuaccccgcacaaauaaaagcccgccagaugauaucacccguuaugagcguaaucggauuucuagcccucgccaaagacuggagcgaccgaaucgaacaauggcucuccgaacccugcaaacuccucccagacacagcagcaguaucccuacucggaggacccgcaaccaaccgagacuaccuccgccagcgccaagucgcccucggcaacauggaaaccaaagaaagcaaagccaucaggcagcacgccgaagccgcaggcugcuccaugauagaagacaucgagagccccuccagcauauggguauucgccggcgcccccgaccgaugccccccaacaugccuguucguagcaggaaucgccgaacucggcgccuucuucucaauccuccaagacaugagaaacaccaucauggccagcaaaaccgucggcaccuccgaagaaaaacuccguaaaaaaagcuccuucuaccaaucuuaccuccgucgaacccaauccaugggcauacaacuagaccaacgcauaaucguccucuucauggucgccuggggcaaagaagccgucgacaacuuccaccucggcgacgacauggacccagaacuccgcacacucgcccaaucccuaaucgacguaaaagucaaagaaaucucaaaccaagaaccccuaaaacuauag

SEQ ID NO: 7733 - RNA, 1290 nt, Artificial Sequence
  derived and/or modified CDS sequence (opt11) from HTNV(AA1028)__AF427318.1__N
auggccacaauggaggaacuacagcgagaaaucaacgcacacgaagggcagcuagucauagcacgccaaaaaguacgcgacgccgaaaaacaauacgaaaaagaccccgacgaacucaacaaaagagcccucacagauagagaaggcguggcaguguccauacaggcaaaaauagacgagcucaaacgccagcucgccgacaggaucgccaccggcaaaaaccuaggcaaagaacaagaccccacaggcgucgagcccggagaccaccuaaaagaacgaagcaugcuauccuacggcaacguccucgaccuaaaccaccucgacaucgacgaacccaccggccaaaccgcagacuggcuaagcaucgucguauaucuaaccagcuucguagucccaauccuacuaaaagcacuauacaugcuaaccacaaggggcagacaaacaacaaaagacaacaaaggaacacgcaucagauucaaagacgacagcucauucgaagacgucaacggaauacgaaaacccaaacacuuauacgucucacuccccaacgcccagucaagcaugaaagccgaagaaaucacgcccggccgcuaccgaacagccauaugcggacuguacccagcacaaauaaaagcccgccaaaugaucagccccguaaugagcguaaucggguuccuagcccuagccaaagacuggagcgaccgcauagaacaauggcucagcgaaccaugcaaacuacuacccgacacggccgccguaagccuacucggaggccccgccaccaacagagacuaccuacgccaacgacaggucgcccucggaaacauggaaaccaaagaaagcaaagcaauccgacagcacgcagaagccgcuggaugcucaaugaucgaagacaucgaaucacccuccuccaucugggucuucgccggcgcaccagaccggugcccgcccacaugccuauucaucgccggaaucgccgaacuaggcgccuucuuuagcauccuccaagacaugcgaaacaccaucauggcgucaaaaacaguaggcaccagcgaggaaaaacuacgcaagaaaagcucauucuaccaaucauaccuccgccgaacacaaagcaugggcauccaacuggaccaacgaauaaucguacuauuuaugguagccuggggcaaagaagccgucgacaacuuccaccucggcgacgacauggaccccgaacuccgaacccucgcacaaucacucaucgacgucaaagucaaagaaaucuccaaccaagaaccccugaaacuauaa

SEQ ID NO: 7734 - RNA, 1290 nt, Artificial Sequence
  derived and/or modified CDS sequence (opt11) from HTNV(Aa10-434)__KT935038.1__N
auggccaccauggaagaacuccaacgcgaaauaaacgcccacgaaggacagcuagucaucgcacgccaaaaagucagagacgcggaaaagcaauauggcaaagaucccgacgaacucaacaaacgagcccuuacagaccgcgaaggugucgcaguaagcauacaagccaaaauagacgaacucaaaagacaacucgcagaccgaaucgccaccggcaaaaaccuagggaaagaacaagacccaacaggcgucgaacccggcgaccaccucaaagaacgcucaaugcucagcuacggcaacguccuagaccugaaccaccuagauaucgacgaaccaaccggccaaacagcugacuggcucagcaucgucguauaccuaaccucauucgucguacccauccuccucaaggcccucuacaugcuaaccacccgcggccgacaaaccaccaaagacaacaaaggaacccgaauccgcuucaaggacgacagcuccuucgaagacgucaacggaaucagaaaaccaaaacaccucuacguaucccuaccaaacgcccaaucauccaugaaagccgaagagaucacccccggccgcuaccgaaccgccgucugcggccucuaccccgcacaaauaaaagcccgacaaaugauauccccagucaugagcgucaucggauuccuagcacuagccaaagacuggagcgaccgaaucgaacaauggcucuccgagccaugcaaacuccucccggacaccgccgccguaucacuccuaggaggccccgcaacaaaccgcgacuaccuacgccaaagacaaguagcccuaggcaacauggaaacaaaagaaagcaaggccauacgccaacacgccgaagcggcaggaugcucaaugaucgaagacaucgaaagcccgagcucaauuugggucuucgccggugcccccgaccgaugcccaccaaccugccuauucauugcgggcaucgcagaacuuggcgcauucuucagcauccuccaagacaugcgcaacaccaucauggcaagcaagacagucggaacgucagaagaaaaacuacgcaagaaaagcucauucuaccaaagcuaccuccgacgcacccaaagcaugggcauacaacucgaccaacgaaucaucguccucuucauggucgcauggggaaaagaagcggucgacaacuuccaccucggggacgacauggaccccgaacucagaacccuagcccaaucccuuaucgacgucaaagucaaagaaaucuccaaccaagaaccccucaaacuauaa

SEQ ID NO: 7735 - RNA, 1290 nt, Artificial Sequence
  derived and/or modified CDS sequence (opt11) from HTNV(Aa14-362)__KT935049.1__N
auggcaaccauggaggaacuccaaagagagaucaacgcccacgaaggacagcuagucauagcgcgccaaaaaguacgagacgcagaaaaacaauacgaaaaagacccagacgaacugaauaaacgagcuuuaaccgaccgcgaaggcguagccguaagcauacaagccaagaucgacgaacucaaacgccaacuagccgaccgaaucgcaaccggcaaaaaccuaggaaaagaacaagaucccacaggcguggaaccaggcgaccaccuaaaagaacgcucaaugcucagcuacggcaacguccucgaccuuaaccaccucgacauagacgaacccaccggacaaacugccgacuggcucagcauagucguauaccugaccucguucgucguaccgauccuacucaaagcccuauacaugcucacaacccgaggacggcaaacaacaaaagacaacaaaggcaccagaaucagauucaaggacgacagcuccuucgaagacguaaacgggauccgaaaaccgaaacaucucuaugucagccuccccaacgcccaauccagcaugaaggcagaagaaaucacaccaggacgcuaccgcacagcagucugcggacucuaccccgcacaaauaaaagcacgacaaaugauauccccggucaugagcgugaucggauuucucgcacucgccaaagacuggagcgaccgagucgaacaauggcuaagugaacccuguaaacuauuaccagacacggccgcggucucccuccugggcggacccgcgacaaaccgcgacuaccugcgacaacgccaaguagcccucggcaacauggaaaccaaagaaagcaaagcaauccgccaacacgcugaagcagccggcugcucaaugaucgaagauauagagagcccgagcagcaucugggucuucgccggggcaccagaccgcugcccacccacaugccucuucaucgcaggaaucgcagaacucggcgcauucuucaguauccuccaagacaugcgaaacacaauuauggcgagcaaaaccguaggcacaagcgaagaaaaacuccgcaagaaaagcucauucuaccaaucauaccuacgcagaacccagagcaugggaauccaacucgaccagcgcauaauaguccucuucauggucgccuggggcaaagaagccgucgacaacuuccaccugggcgacgacauggacccagaacuaagaacccucgcacaaucacuaauagacgugaaaguaaaagaaaucucaaaccaagaaccgcucaaacucuag

SEQ ID NO: 7736 - RNA, 1290 nt, Artificial Sequence
  derived and/or modified CDS sequence (opt11) from HTNV(Aa14-404)__KT935052.1__N
auggccaccauggaagaacuacaacgcgagauaaacgcacacgaagggcaacucgucaucgcccgccaaaaagugagagacgcagaaaaacaauacgaaaaggaccccgacgaacucaacaaacgcgcccucacagaccgggaaggcguagcagucucaauccaagccaaaauagacgagcuaaaaagacaacuagccgaccgcauagccaccggcaaaaaccuaggaaaagaacaggaucccacaggagucgaacccggcgaccaccuaaaagaacgauccaugcucuccuacggaaacguucucgaccuaaaccaccuagacaucgacgagccaaccggccaaaccgccgacuggcuaagcauugucguauaccucacauccuucgucguacccauccuacucaaagcccuauacaugcugaccacccgcggccgccaaaccaccaaagacaacaaaggcacacgaauccgauucaaagacgacuccucguucgaagacgucaacggcauccgcaaacccaaacaccuauacgucucccuaccaaacgcccaauccagcaugaaagccgaagagaucacacccggaagauaccgcacugccguaugcggccucuaucccgcccaaauaaaagcaagacaaaugauaucccccguaaugagcguaaucggcuuccucgcccucgcaaaagacuggucugaccgaauagaacaguggcuaagcgaacccugcaaacuccuccccgacaccgccgcaguaagccuacucggcggaccagccacaaaccgagacuaccugcgccaacgacaaguagcccucggcaacauggaaaccaaggaauccaaagcaauccgccaacacgccgaagccgccggcugcagcaugaucgaagacaucgagaguccaucauccaucuggguauucgcaggcgcccccgaccgcugcccacccaccugucucuucaucgccggaaucgccgaacuaggcgccuucuucagcauacugcaagacaugcgaaacaccaucauggcguccaaaaccgucggcaccucagaagaaaaacucagaaagaaaucaucuuucuaccaaucauaccuacgccgcacccaauccaugggaauacaacucgaccaacgcaucaucgugcuauucauggucgcauggggcaaagaagccguagacaacuuccaccugggagacgacauggaccccgagcuccgcacacucgcccaaucacugaucgacgucaaagugaaagaaauauccagccaagaaccacuaaaacucuaa

SEQ ID NO: 7737 - RNA, 1290 nt, Artificial Sequence
  derived and/or modified CDS sequence (opt11) from HTNV(Aa15-56)__KU207195.1__N
auggcaaccauggaagaacuccaaagagaaaucaacgcccacgaaggccagcuagucaucgcccgccaaaaaguccgcgacgccgaaaaacaauacgaaaaagaccccgacgaacuaaacaaacgagcccucaccgaccgagaaggcguagccgucaguauccaagcaaaaaucgacgaacucaaacgccaacuagcagaccgaaucgccaccggcaaaaaccucgggaaagaacaagaccccaccggagucgaacccggagaccaccucaaagaaagaagcaugcucuccuacggcaacguccucgaccucaaccaccucgacauagacgaacccaccggccaaaccgccgacuggcucagcaucguaguauaccuaacaucauucgucgucccaauccuacuuaaagcccucuacaugcuaaccacccgaggcagacaaacaaccaaagacaacaaaggcacacgcauaagauucaaagacgacagcuccuucgaagacguaaacggcauacgcaaacccaaacaccucuacguaagccuaccaaacgcgcaauccuccaugaaagccgaagaaaucaccccaggccgcuaccgcacagcaguaugcggacucuacccagcgcaaaucaaagcacgccaaaugaucucacccguaauguccgucaucggcuuccuagcccuagcaaaagacuggagcgaccgcaucgaacaauggcucaacgaaccaugcaaacuccuacccgacacagcugcggucucccuccuaggaggacccgccacaaaccgcgauuaccuacgccaacgccaaguagcccugggcaacauggaaaccaaagaauccaaggccauccgacaacacgcggaagccgccggaugcucaaugaucgaagacauagaaagccccucauccaucugggucuucgcaggcgcccccgaccgcugcccgcccacaugccuguucaucgccgggaucgccgaacugggcgcguucuucagcauacuacaagacaugcgcaacaccauaauggccuccaaaacaguaggaaccagcgaagaaaaacuacgcaagaaaucauccuucuaccaauccuacuuacgcagaacacaaucaaugggcauccaacucgaccaacgaaucaucguacuauucaugguggccuggggaaaagaagccguggacaauuuccaccucggagacgacauggaccccgaacuccgcacacucgcacaaucccucaucgacguaaaagucaaagaaauaucaaaccaagaaccccuaaaacucuaa

SEQ ID NO: 7738 - RNA, 1290 nt, Artificial Sequence
  derived and/or modified CDS sequence (opt11) from HTNV(AA1719)__AF427319.1__N
auggccaccauggaagaacuccaacgugaaaucaacgcccaugaaggacaacucgucauagcacgccaaaaaguccgggacgccgaaaaacaauacgaaaaggaccccgacgaacucaacaaacgagcccuaaccgaccgcgaaggcgucgcgguauccauccaagcuaaaauagacgaacucaaaagacaacuagccgaccgcaucgcuacaggcaaaaaccucggaaaagaacaagacccaaccggcgucgaaccgggagaccaccucaaagaaagauccaugcucagcuacggcaacguccuagaucuaaaccaccuagacaucgacgagcccacaggccaaacagccgacugguuauccaucgucguauaccucaccucauucguagucccaauccuacuuaaggcccucuacaugcucacaacacgcggccgccaaacaacaaaggacaacaaaggaacaagaauacgcuuuaaagacgacuccucauucgaagacgugaacggcauacgcaaaccuaaacaccuauacgucucccuacccaacgcucaaucaagcaugaaagcagaagagauaacaccaggacgcuaccgcacagcuaucugcggacucuaccccgcccaaaucaaagcccgacaaaugaucagcccagucaugucagucaucggcuuccucgcccuagcaaaagacugguccgaccgcaucgaacaguggcugagcgaacccuguaaacuacucccagacaccgccgccgucucccuccucggcggcccagccacuaaucgagacuaccuccgccaacgccaagucgcacucggcaacauggaaaccaaagaaucaaaagccauacgccaacacgccgaagccgccggaugcucaaucaucgaagacaucgaaagcccgucauccaucugggucuucgcaggagcccccgaccgcugcccacccacaugccuauucaucgccggaauagcggaacuaggagcauucuucagcauacuacaagacaugcgcaacaccauaauggcauccaaaaccgucggcaccagcgaagaaaaacuucgcaagaaaucgucauucuaccaauccuaccuacgccgcacccaaagcaugggcauccaacuggaccaacgcauaaucguccucuucaugguggccuggggcaaagaggccgucgacaacuuccaccuaggagacgacauggacccggaacuacgcacccucgcccaaagccucauagacgucaaagucaaggaaaucucuaaccaggaaccccuaaagcuauaa

SEQ ID NO: 7739 - RNA, 1290 nt, Artificial Sequence
  derived and/or modified CDS sequence (opt11) from HTNV(AP1168)__AF427323.1__N
auggccacaauggaagaacuccaaaaagaaaucaacgcccacgaggggcaacucguaaucgcacgccaaaaaguccgcgacgccgaacgacaauacgaaaaagaccccgacgagcucaacaagcgcgcucuaacagaccgcgaaggcgucgccgccuccauucaagcaaagauagacgagcugaaacgacaacuagccgaccgaaucgcaaccggaaagaaccucggaaaagaacaagaucccacaggagucgaaccaggcgaccaccucaaagaacgaucaaugcucuccuacggcaacguucuagaccucaaccaccuagacauagacgaacccacaggacaaaccgccgacuggcuauccaucguagucuaccucaccuccuucgucguaccaauacuccucaaagcacucuacaugcucaccacccgcggccgccagaccaccaaagacaacaaaggaacccgcauacgauuuaaagacgacucuucauucgaggacguaaacggcaucagaaaacccaaacaccucuacgucucacuccccaacgcccagagcuccaugaaagccgaagaaauaacccccggccgcuaccgcaccgccaucugcggccuuuacccagcacaaaucaaagcccgccaaaugguaucccccgucaugucagucaucggcuuccucgcccucgccaaagacuggggagaccgcauagaacaauggcuuucagaacccugcaagcuccuccccgacaccgcagcugucagccuccacggaggcccagcuacaaaccgagacuaccucagacaacgacaagccgcccucggcaacauggaaacaaaagaauccaaagcaauacgccaacacgccgaaacagccggcugcucaaugaucgaagacaucgaaagccccuccagcauaugggucuucgccggcgcacccgaccgaugcccgcccacaugccuauucauagccggcaucgccgaacucggcgcauucuucucaauacuccaagacaugcgcaacaccaucauggcauccaaaaccguaggcaccagugaagaaaaacuaagaaagaaauccuccuucuaccaaucauaccuccgacgcacacaaucuaugggaauccaacuagaccaacgcaucaucguccuauucauggucgccuggggcaaagaagcaguagacaacuuccaccuaggcgacgacauggaccccgagcucagaacacuagcccaaucccucaucgacuuaaaagucaaagaaauaucgaaccaagaaccccuaaaacuguaa

SEQ ID NO: 7740 - RNA, 1290 nt, Artificial Sequence
  derived and/or modified CDS sequence (opt11) from HTNV(AP708)__AF427322.1__N
auggcaaccauggaagaacuccaaaaagaaauuaacgcccacgaaggacaacucgucauagcccgccaaaaaguccgggacgccgaacgccaauacgaaaaagaccccgaugaacuaaacaagcgagcccucaccgaccgcgaaggcgucgccgccagcauccaggccaaaauagacgaacucaaacgucaacucgccgaccgcauagcaaccggcaaaaaccuugguaaagaacaagaucccacaggcgucgaacccggagaccaucuaaaagaacgcucaaugcuaucauacggcaacguccuugaccucaaccaccucgacauagacgaaccaacaggccaaaccgcagauuggcucuccaucgucguauaccuaacaucuuucgucguacccauccuauuaaaagcacucuacaugcucacaacacgcggccgucaaaccacgaaggacaacaaaggcacacgaauacgcuucaaagacgacuccucuuucgaagacgucaacggcauccgcaaacccaaacaucuauacgucucccucccgaacgcacaaucauccaugaaagccgaagaaauaacacccgggcgcuacagaaccgccaucugcggccucuacccggcccaaaucaaagcccggcaaauggugagccccgucauguccguaauuggguuccuggcccuagcaaaagacuggggcgaucgcauagaacaauggcucagcgaacccugcaaacuccuacccgacacagccgccgucucgcuccacggcggccccgccaccaaccgcgacuaccuccgccaacgacaagccgcacuaggcaacauggaaaccaaagaaucaaaagccauacgacagcacgccgaaaccgccggaugcagcaugaucgaagacauagaauccccguccuccgucuggguauucgccggcgcccccgaccgaugcccgccaaccugccucuucauagccggaaucgccgaacuaggcgcauucuucuccauccuccaagacaugcgcaacaccaucauggccuccaaaaccgucggcacaucagaagaaaaacuccgcaagaagucauccuucuaccaauccuaccuccgacgcacacaaagcauggguauccagcucgaccaacgcaucaucguacucuuuauggucgccuggggaaaagaagccgucgacaacuuccaccucggcgacgacauggaccccgaacugcgcacccuagcacaaucccuaauagaccucaaaguaaaagaaaucuccaaccaagaaccccucaagcucuaa

SEQ ID NO: 7741 - RNA, 1290 nt, Artificial Sequence
  derived and/or modified CDS sequence (opt11) from HTNV(DandongHu-32)__KC570386.1__N
auggccaccauggaagaacuacaacgcgaaaucaacgcccacgaaggccagcuaguaaucgcccgccaaaaaguccgcgacgcagaaaaacaauacgaaaaagacccagacgaacuaaacaaacgagcccuaaccgaccgagaaggagucgccgucuccauccaagcaaaaaucgacgaacuaaaacgccaacucgccgaccgcaucgccacagggaaaaaccuaggaaaagaacaagaccccaccggaguagaaccgggcgaccaccugaaagaacgcucaaugcuaagcuacggcaacguccucgaccucaaucaccuagacaucgacgaacccaccggacaaaccgcagacuggcucagcaucgucgucuaccucacauccuucgucguacccauccuacucaaagcccucuacaugcucacuacccgaggccgccaaacgaccaaggacaacaaaggaacccgaaucagauucaaagacgacagcuccuucgaggacgucaacggaauccgcaaacccaaacaccucuacgucagccuacccaacgcccaauccuccaugaaagcggaagaaauaacgcccggccgcuaccgcaccgcaaucugcggacuauaccccgcgcaaaucaaagcacgacaaaugaucucccccguaauguccguuaucggcuuccucgcccucgccaaagacuggagcgaccgcaucgaacaauggcucuccgaaccaugcaaacuccuccccgacacagcagccgucucccuccuaggcggaccagccaccaaccgagacuaccuacgacaacgccaagucgcgcucgguaacauggaaacaaaggaaagcaaagccauacgccagcacgccgaagcagccggcugcuccaugaucgaagauauagaaucacccucauccauaugggucuucgccggcgcaccggaccggugcccgcccacaugccuauucaucgccggcaucgccgaacucggcgcguucuucuccauccuccaagauaugcgcaacaccauaauggcgagcaaaacagucggcaccucagaggaaaaacuaagaaagaaaagcucauucuaccaaucauaccuucgccgcacccaauccaugggaauacaacuagaccaacgaaucaucguacuauucaugguggcguggggcaaagaagccgucgacaacuuccaccuaggcgacgacauggacccagaacuacgcauacuagcccaaucccucaucgacguaaaaguaaaagagauauccaaccaagaaccccugaaacucuaa

SEQ ID NO: 7742 - RNA, 1290 nt, Artificial Sequence
  derived and/or modified CDS sequence (opt11) from HTNV(DandongHu-34)__KC570387.1__N
auggccaccauggaagaacuccaacgagagauaaacgcccacgaaggccaacucgucaucgcacgccaaaaaguaagagacgcggaaaaacaauacgaaaaagaccccgacgaacuaaacaaacgagcacucacagaccgagaaggcgucgccgucucaauacaagccaaaauagacgaacucaaacgccaacucgccgaccgcaucgccaccgggaagaaccucggaaaagagcaagaccccacaggagucgaaccaggugaccaccugaaagaacgcagcaugcucagcuacggcaacguacuagaccuaaaccaccuugacaucgacgaaccaaccggacaaaccgcagacuggcucucaauagucgucuaccucaccuccuucguagugcccauccuacucaaggcccuauacaugcucacaacccgcggcagacaaaccacaaaggacaacaagggcacccgaauaagauucaaagaugacagcuccuucgaagacguaaacggcauccgaaaacccaaacaccuauacguaagccuccccaacgcgcaguccucaaugaaagccgaagaaaucacccccggacgauaccgcaccgccauaugcggccuauaccccgcccaaauaaaagcacgccaaaugaucuccccagucauguccgucauaggauuccuagcacuagcaaaagacuggagcgaccgaaucgagcaauggcucucagaacccugcaaacuccucccagacacugccgcaguaagccuccuaggaggccccgccacaaaccgcgacuaccugcgucaacgccaagucgcccuaggcaacauggaaaccaaagaauccaaagccauacgccaacacgcagaagcagcuggaugcaguaugaucgaagacauagaaagcccauccuccaucuggguauucgccggcgcccccgaccgcugcccacccacaugccucuucauagcagggauggccgaacucggcgcauucuucagcauccuucaagacaugcgaaacaccaucauggcaucaaaaaccgucggcacauccgaagaaaaacuacggaagaaaagcucauucuaccaauccuaccuccgccgcacacaaagcaugggcauacaacucgaccagcgaauaaucguacucuucaugguggccuggggcaaagaagcaguagacaacuuccaccucggagacgacauggaccccgaacuacgcacccucgcacaaucacucauagacgucaaagugaaagaaaucucaaaccaggaaccacucaaacucuag

SEQ ID NO: 7743 - RNA, 1290 nt, Artificial Sequence
  derived and/or modified CDS sequence (opt11) from HTNV(DandongHu-89)__KC570389.1__N
auggccaccauggaagaacuccaacgcgaaaucaacgcccacgaaggccaacucgucaucgcccgacaaaaagucagagacgccgaaaaacaauacgaaaaagaucccgacgaacucaacaagcgugcacucaccgaccgcgaaggcgucgccgucuccauccaagcaaaaaucgacgaacucaaacgccaacuggcagaccgaaucgccacaggcaaaaaccuaggcaaggaacaagaccccaccggcgucgaaccaggcgaccaccucaaagaacguucaaugcucagcuacggcaacguccuagaccuaaaccaccucgauaucgacgaacccacaggccaaaccgccgacuggcucuccauaguagucuaccugaccuccuucgucguaccaauacuacuaaaagcacucuacaugcuaaccacccgcggcagacaaacaaccaaagacaacaaagggacccgcauacgcuucaaggacgacaguagcuucgaggacguaaacggaauccguaaacccaaacaccucugcgucagccucccaaacgcacaaucaucaaugaaggcagaagaaauaaccccaggccgcuaucgcaccgccaucugcggccucuacccagcccaaaucaaagccagacaaaugaucuccccggucauguccguaaucggcuuccucgcccucgccaaagacuggagcgacagaauagaacaauggcucuccgaacccugcaaacuccuaccagacacagccgccgucucacuccucggcgggcccgccaccaaccgcgacuaccuacgacaacgccaagucgcccucgggaacauggagacaaaagaaagcaaagccauccgccaacacgccgaggcagccgggugcagcaugaucgaagacauagaaagcccauccuccaucugggucuucgccggcgcccccgaccgaugcccgcccacaugccuauucauagcaggaaucgcggaacucggcgccuucuucucaauacuccaagacaugcgcaacaccauaauggccuccaaaaccgucggaacauccgaagaaaaacuacgaaagaaauccucauucuaccaaagcuaccuacgacggacccagagcaugggcauccaacucgaccaacgaaucauaguacuauucaugguagcauggggcaaggaagccguagacaacuuccaccuaggcgacgacauggaucccgaacuacgcacccuagcccaaucacuaaucgacguaaaaguaaaagaaaucagcaaccaggaaccccuaaaacuuuaa

SEQ ID NO: 7744 - RNA, 1290 nt, Artificial Sequence
  derived and/or modified CDS sequence (opt11) from HTNV(DandongHu-91)__KC570390.1__N
auggccaccauggaggaacuacaacgagaaaucaacgcacacgaaggucagcuagucaucgcccgccaaaaaguccgcgacgcagaaaaacaauacgaaaaagaccccgacgaacuaaacaaacgcgcccucacagaccgcgaaggcgucgcaguauccauacaagcaaaaaucgacgaacuaaaaaggcaacucgccgaccggaucgccaccggcaaaaaccucggaaaagaacaagaccccaccggcgucgaacccggcgaccaccucaaagaacgcucaaugcucucauacggaaacguccucgaccuuaaccaccucgacauagacgaaccaaccggccaaacagcagacuggcucggcaucgucaucuaccucaccuccuucgucgucccaauacuccucaaagcccuauacaugcucaccacccgcggccgacaaaccaccaaagacaacaaaggcacccgcauucgauucaaagacgacuccuccuucgaagacgucaacggcauccgaaaaccaaaacaccucuacgucagccuccccaacgcacaauccagcaugaaagccgaagaaaucaccccaggacgcuaccgaaccgccaucugcggacucuacccagcccaaaucaaagcccgccaaaugaucuccccuguaaugucagucaucggcuuccuagcccucgcaaaagacuggucagaucgcaucgaacaauggcuauccgaaccuugcaaacuccucccagacacagccgccguaucccuacucggaggccccgccacuaaccgcgacuaccuaagacaacgccaagucgcccucggcaacauggaaaccaaagaauccaaagccauacgacaacacgcagaagcagcaggaugcuccaugaucgaagacaucgaaucaccgagcagcauaugggucuucgccggcgcccccgaccgcugcccuccaaccugccucuuuaucgccggcauggccgaacuaggagccuucuucagcauccuccaagacaugcgcaacacaaucauggccuccaaaaccguaggcaccuccgaggaaaaacuccgaaagaaauccuccuucuaccaaagcuaccuccgacgcacucaaagcaugggcauacaauuagaccaacgaauaaucguacuauucauggucgccuggggcaaagaagcaguggacaacuuccaccuaggagacgacauggacccagaacucagaacccuagcacaaagccucaucgacguaaaaguaaaagaaaucagcaaccaagagccccucaaacucuaa

SEQ ID NO: 7745 - RNA, 1290 nt, Artificial Sequence
  derived and/or modified CDS sequence (opt11) from HTNV(Fuyuan-Aa-145)__KJ857349.1__N
auggccaccauggaagaacuucaacgcgagaucaacgcccacgaaggacaacucgucauagcucgccaaaaagucagagacgccgaaaaacaauacgaaaaggacccagacgaacucaacaaaagggcccuaacagaccgcgaaggcguagcaguaagcauacaagcgaaaaucgacgaacucaaacgacagcucgcagacagaaucgcuaccgggaaaaaccucggaaaagaacaagacccaacaggcguagaaccaggagaccaucucaaagaacgauccaugcuauccuacggaaacguacuggaccucaaccaccuagacauagacgaaccaacaggacaaacagcagacuggcuaagcauagucguauaccucaccuccuucguaguaccaauccuacucaaagcucuguacaugcucaccaccagaggccgacaaaccaccaaagacaacaaaggcacccgcaucagauucaaggacgauagcucguucgaagacgucaauggaauuagaaaaccaaaacaccucuaugucagccucccaaacgcccaauccagcaugaaagcagaagaaaucacacccggacgcuaccgaacagccauaugcggccuccacccagcacagauaaaagcacgccaaaugaucucucccgucaugagcguaaucggauuccuggcccuagccaaagacugguccgaccgcauagaacaauggcucagcgaacccugcaaacugcucccagacaccgccgccgucucccuccucggcggccccgccacaaacagagacuaccucagacaacgccagguagcacucgggaacauggaaaccaaagaaagcaaggccauacgccaacacgccgaagccgccggaugcucgaugaucgaagacauagaaagcccaagcuccaucuggguauucgccggcgccccagaccgaugcccgcccacaugucuguucaucgccggaaucgccgaacucggcgcauucuucagcauacuccaagacaugagaaacaccauaauggccagcaaaaccgugggcaccagcgaggaaaaacuccgaaagaaauccagcuucuaccaauccuaccugcgccgcacccagagcaugggcauacaacuugaccaacgcauaaucgugcuuuucauggucgccuggggcaaagaagcagucgacaacuuccaccugggcgacgacauggaccccgaacuacgcacgcuagcgcaaucacucauagacguaaaaguaaaagaaaucuccaaccaagaaccacucaaacucuaa

SEQ ID NO: 7746 - RNA, 1290 nt, Artificial Sequence
  derived and/or modified CDS sequence (opt11) from HTNV(Fuyuan-Aa-26)__KJ857347.1__N
auggcaacaauggaggaacuccaacgcgagaucaacgcacacgaaggccaacugguaaucgccagacaaaaaguccgcgacgcagaaaaacaauacgaaaaagacccagacgagcucaacaaaagagcacucaccgaccgcgaaggaguagcaguguccauccaagcaaaaauagacgagcucaaacgacaacuugccgacaggaucgccaccgggaaaaaccucggaaaagaacaagaccccaccggcguggaaccaggcgaccaccuaaaagaacgaucaaugcuaagcuacggaaacguccucgaccuaaaccaucucgacaucgacgaacccaccggacaaacagccgacuggcucagcauagucgucuaucuaaccuccuucgcgguucccauccuacucaaagcccuguacaugcucacgacccgaggccggcaaacgaccaaagacaacaaagggacccgaaucagauucaaagacgacuccucacucgaagacguaaacggaauccgaaaaccaaaacaccucuacgucucccucccaaacgcacaaagcagcaugaaagccgaagagaucacacccggccgcuaccgcacagccauaugcggacucuacccugcccaaaucaaagcgcgacaaaugaucagcccggucaugagcguaauaggcuuccucgcccuagccaaggacuggagugaccgcauagaacaauggcuaagcgagccaugcaaacuacucccagacacagcugcagucucccuccuaggcggccccgccacaaaccgcgacuaccugcgccaacgucaagucgcccucggaaacauggaaacaaaagaaagcaaggcaauacgccaacacgcagaagccgcugguugcucaaugauagaagacaucgaaagucccagcucaauaugggucuucgccggagcaccagacaggugcccaccgaccugccccuucaucgccgguaucgccgaacugggcgcauucuucagcauacuccaggacaugcgaaacaccauaauggccagcaaaaccgucggcacaagcgaagaaaaacuuagaaagaaaagcuccuucuaucaaucauaccuccgccgcacccaauccaugggcauccaacuagaccagcgcauaaucguacucuucaugguagccuggggaaaagaagccgucgauaacuuccacuuaggagacgacauggaccccgaacuccgcacacucgcccaaucccuaauagacgugaaagucaaagaaaucuccaaccaagaaccgcucaaacucuag

SEQ ID NO: 7747 - RNA, 1290 nt, Artificial Sequence
  derived and/or modified CDS sequence (opt11) from HTNV(JS1)__KP970572.1__N
auggccaccauggaagaacuacaacgcgaaauaaacgcccacgaaggccagcuagucaucgcccgacaaaaaguccgcgaugccgaaaaacaauacgaaaacgacccggaugaacucaacaaaagagccuuaaccaaccgcgagggcgucgcaguauccauccaagcaaaaaucgacgaacucaaacgccaauuagcagaccgcaucgcaaccggcaaaaaccuuggcaaagaacaagaccccaccggugucgaacccggagaccaccuaaaggagcgaucgaugcuaucauacggcaacguccucgaccuaaaccaccucgacaucgacgaaccaaccggacaaaccgccgacuggcucagcauaaucguauaccucaccucauucguagucccaauacuccucaaagcccucuacaugcuaaccacacgcggcagacaaaccaccaaagauaacaaaggcacccgcauacgauucaaagacgacucauccuucgaagacgucaacggcaucagaaagcccaaacaccucuacgucucccuccccaacgcccaauccucaaugaaagccgaagaaaucacccccggccgcuaccgcacagccgucugcggccucuaucccgcccaaauuaaagcacgucaaaugauaucccccgucaugagcguaauaggauuccucgcccucgccaaagacugguccgaccgaaucgaacaauggcucaucgaaccaugcaaacuccuaccagacacagccgccgucucccuccucggcggucccgccaccaaccgggacuaccuccgccaacgccaagucgcccucggaaacauggaaaccaaggaauccaaagccauacgccaacacgccgaagccgcaggcugcagcaugaucgaggacaucgaaucaccaucaucuauaugggucuucgccggagccccagaccgcugcccacccacaugccucuucauagccggcaucgccgaacuaggcgccuucuucuccauccuccaagacaugcgcaacaccauaauggccuccaaaaccgucggcaccagcgaagaaaaacuccgaaagaaaagcucauucuaccaaucauaccuccgacgcacccaguccaugggcauccaacuagaccaacgcaucaucguccucuucaugguagccuggggcaaagaagccgucgacaacuuccaccucggcgacgacauggacccugaacuccgcacccuagcccaaagccuaaucgacguuaaaguaaaggaaauaagcaaucaagagccccucaaacuauag

SEQ ID NO: 7748 - RNA, 1290 nt, Artificial Sequence
  derived and/or modified CDS sequence (opt11) from HTNV(LongquanAa-08-150)__JQ912697.1__N
auggcaaccauggaagaacuacaacgcgaaaucgaugcccacgaaggccagcucgucauagcccgccaaaaaguccgugaugcagaaaaacaauacgaaaaagaccccgacgaacucaacaaacgcgcccuaaccgacagagaaggcgucgccgccagcauucaagcaaaaaucgacgaacuuaaacgccagcucgcagacaggaucgccaccggcaaaaacuuaggcaaagagcaagacccaaccggagucgaacccggcgaccaccucaaagaacgcucaaugcucuccuacggaaacguccuagaccucaaccaccucgacaucgacgaacccaccggccaaaccgccgauuggcucuccaucgucgucuaccucaccucauucgucguacccauccuacucaaagcccucuacaugcucaccacccgcggccgucaaacaacgaaagacaacaaaggcacccgcaucagauucaaggacgacagcucauucgaagacgucaacggcauccgcaaacccaaacaccucuacgucagccucccaaacgcccaaagcagcaugaaggcagaagaaaucacccccggacgcuaucgcaccgcaauaugcggccucuaccccgcccaaaucaaagcccgacaaaugauuagccccgucauguccgucaucggauuccucgcccuagccaaagacugggcagaccgcauagaacaauggcucuccgagcccugcaagcuacuacccgacacagccgccgucucccuccacggcggaccagccaccaaccgcgacuacuuacgacaacgccaaguagcccuaggcaacauggaaaccaaagaaucaaaagccauccgccaacacgcagaaaccgccggaugcucaaugaucgaagacaucgaaagucccuccuccaucugggucuucgccggcgcccccgaccgaugcccacccacuugccuauucaucgccggcauagcagagcuaggcgcauucuucucaauccuacaagacaugcgaaacaccauaauggccucaaagacggucggcaccagcgaagaaaaacuacgaaagaaauccuccuucuaccaguccuaccuucgacgcacccaaucgaugggcauccaacuagaccagcgcaucaucguccucuucauggucgcauggggcaaagaagcagucgacaacuuccaccucggagacgacauggacccagaacuacgcacacucgcccaaagccucauagacguuaaagucaaagaaaucuccaaccaggagcccuuaaaacuauaa

SEQ ID NO: 7749 - RNA, 1290 nt, Artificial Sequence
  derived and/or modified CDS sequence (opt11) from HTNV(LongquanAa-08-157)__JQ912698.1__N
auggcaacaauggaagaacuccaacgcgaaaucaacgcccacgaaggacagcuaguaauagcacgccaaaaaguccgagacgccgaaaaacaauacgaaaaagaccccgacgaacucaacaaacgcgcccucaccgacagagaaggcgucgccgccagcauccaagccaaaaucgacgaacucaaaagacaacucgcagaccgcaucgcaaccggcaaaaaccuaggcaaagaacaagaccccaccggcgucgaacccggcgaccaccuaaaggaaagaagcaugcuauccuacggcaacguccucgacuuaaaccaccucgacaucgacgagcccacaggccaaaccgccgacuggcucagcauagucgucuaccucacauccuucgucguaccaauacuacucaaagcccucuacaugcuaaccacucgaggcagacaaaccacuaaagacaacaaaggcacccgcauccgcuucaaagacgacucauccuucgaagacgucaacggaauccgcaaacccaaacaccuauacgucagccuuccuaacgcacaaagcagcaugaaagccgaagaaaucaccccaggccguuaccgaacagcuaucugcggccucuacccagcacaaaucaaagcccgccaaaugauaucaccagucaugucagucaucggauuccucgcacuagcaaaggacugggcagaccgcaucgaacaauggcucagcgaacccugcaaacuccuccccgacaccgccgccgucucacuccacggcggccccgccaccaaccgcgacuaccuacgacaacgccaagucgcccucggcaacauggaaaccaaagaaucgaaagccauccgacaacacgccgaaaccgcuggcugcagcaugaucgaagacaucgaaucaccaucaagcaucuggguauucgcaggcgccccagaccgaugcccuccaaccugccuauucaucgccggcaucgcagaacucggcgccuucuucucaauccuacaagacaugcgcaacacuauaauggccuccaaaacgguaggaaccucagaagagaaacuccgcaagaaauccucauucuaucaaagcuaccucagaagaacacaauccaugggcauccaacucgaccaacgaaucauuguacucuucaugguagccuggggcaaagaagcugucgacaacuuccaccucggagacgacauggaccccgaacuccguacccucgcacaaagccuaaucgacgucaaagucaaagaaaucagcaaccaagagccccuaaaacuauaa

SEQ ID NO: 7750 - RNA, 1290 nt, Artificial Sequence
  derived and/or modified CDS sequence (opt11) from HTNV(LongquanAa-08-314)__JQ912709.1__N
auggccaccauggaagaacuccaacgagaaaucaacgcccacgaaggccaacuggucaucgcccgacaaaaaguccgagacgccgaaaaacaauacgaaaaagaccccgacgaacucaacaaacgugcccucaccgaccgcgaaggcguagccgccuccaugcaagccaaaaucgacgaacugaaacggcagcuagccgaccgcaucgccaccggcaaaaaccucggaaaagaacaagacccuaccggcgucgaaccaggagaccaccugaaagaacgcagcaugcugucauacggaaacguccucgaucuaaaccaccucgacauagacgaaccaacaggccagacagccgacuggcucagcauaguugucuaccuaaccagcuucgucguaccaauccuccucaaagcacuauacaugcuaacaaccagaggccggcaaaccacaaaagacaacaaaggcacccgaauccgcuucaaagacgacagcucauucgaagacguaaacggcauccgcaaacccaaacaccucuacgucagccuacccaacgcccaauccucaaugaaagccgaagaaaucacaccaggccgauaccgaaccgccaucugcggacuauaccccgcccagaucaaagcacgacaaaugaucucccccgucauguccgugaucggcuuccucgcccuagcaaaagacugggccgacagaaucgaacaauggcucuccgaacccugcaaacuacuccccgacacagccgccgucucccuccauggcggacccgcgaccaaccgcgacuaucuccgccaacgccaagucgcccucggcaacauggaaacgaaagaaagcaaggccauccggcagcacgcugaaaccgccggcugcuccaugauagaagacaucgaaucacccuccucaaucuggguauucgccggcgccccagaccgcugcccaccgaccugccuguucaucgcagggaucgcagaacuaggagccuucuucucaauccuacaagacaugcgcaacaccauaauggccagcaaaacggucggaaccuccgaagaaaaacuccgaaagaaaagcuccuucuaccaaagcuaccuacgcagaacccaaucaaugggcauccaacucgaccaacgcauuauaguccucuucaugguagcauggggcaaagaagccgucgacaacuuccaccucggcgacgacauggaccccgaacuccgcacccucgcccaaucacucaucgacgucaaaguaaaagagaucuccaaccaggaaccccucaaacucuaa

SEQ ID NO: 7751 - RNA, 1290 nt, Artificial Sequence
  derived and/or modified CDS sequence (opt11) from HTNV(LongquanAa-08-573)__JQ912714.1__N
auggccaccauggaagaacuacaacgggaaauaaacgcccacgagggacaacucguaauagcacgacaaaaaguccgcgacgccgaaaaacaauacgaaaaagaccccgacgaacuaaacaaaagagcccuaaccgacagagaaggcguagccgccagcauacaagcaaaaaucgacgaacucaaacgccaacuggcagaucgaaucgccaccggcaaaaaccucggcaaagaacaggaccccaccggugucgaacccggagaucaccucaaagaacguuccaugcuauccuacgguaacguucucgaccuaaaccaccucgacauagacgaacccacaggccaaaccgcagacuggcucaguaucgucgucuaccugaccagcuucguaguccccauccuccucaaagcccucuacaugcucacaacacgcggccgccaaacgaccaaagacaacaaaggaacccggauacgauucaaagacgacuccagcuucgaagacgucaacggcaucagaaaacccaaacaccucuacguuucccuaccaaacgcccaaagcuccaugaaagccgaagaaaucacccccggacgcuaccgcaccgcaauaugcggccucuacccagcccaaauaaaagcacgccaaaugaucucaccaguaaugucagucauaggauuccucgcccuagccaaagacugggccgaccgaaucgaacaauggcucuccgaacccuguaaacuccuaccagacaccgccgcagucagccuacacggcggaccugccaccaaccgcgacuaccuacgccaacgccaagucgcccuaggaaacauggaaaccaaagaaagcaaagccauccgccaacacgccgcaacagcaggaugcuccaugaucgaggacaucgaaucccccucauccaucugggucuucgccggcgcacccgaccguugcccaccaaccugccucuucauagcaggcaucgccgagcucggcgccuucuucagcauccuacaagacaugcgcaacacaaucauggcaagcaaaacaguaggaacauccgaagaaaaacuccgcaagaaaagcucauucuaccaaagcuaccuacgccgcacccaauccaugggaauccaacucgaccagcgaaucaucguacucuucaugguggcauggggcaaagaagcagucgacaacuuccaccucggagacgacauggacccagaacugagaacacuagcccaaucacucauagacgucaaagucaaagaaaucuccaaccaggagccccuaaaacucuaa

SEQ ID NO: 7752 - RNA, 1290 nt, Artificial Sequence
  derived and/or modified CDS sequence (opt11) from HTNV(LongquanAa-09-113)__JQ912716.1__N
auggcaacaauggaagaacuccaacgagaaauaaacgcccacgaaggacagcuagucaucgcccgucaaaaaguccgcgacgcagaaaaacaauacgaaaaagaccccgacgaacucaacaaacgcgcacucaccgaccgcgaaggaguagccgccucaauacaggcuaaaaucgacgagcucaaaagacaacucgcagacagaaucgcaacggguaaaaaccucggaaaagaacaagaccccacaggcguagaacccggcgaccacuuaaaagaaagaucaaugcuauccuacggaaacguacuagaccuuaaccaccucgauaucgacgaacccaccggccaaaccgccgacuggcucagcauagucguauaccucaccuccuucgucgucccaauacuacucaaagcccucuacaugcucaccacacgaggcagacaaaccacaaaagacaauaaagggacccggauacgcuucaaagacgacuccagcuucgaagacgucaacggcacccguaaaccaaaacaccuauacguaucccucccaaacgcccaauccagcaugaaagccgaagaaaucacgcccgggcgcuaccgcaccgcaaucugcggacuguaccccgcccaaaucaaagcccgacaaaugaucucccccgucaugagcgucaucggauuccucgcccuagccaaagacugggcagaccgaauagaacaauggcuauccgaaccaugcaaacuccuaccagacacagccgcagucucccuacacggcggccccgcaaccaacagagacuaccuacgccaacgacaggucgcacucggaaacauggaaacaaaagagagcaaagccauacgacaacacgccgaaacagccggcugcucaaugauugaagacaucgagucacccucaucaauaugggucuucgccggcgccccagaccgcugcccaccaacaugccuauucauagccggaaucgcagaacuaggagcauucuucucaauccuacaagacaugcgaaacaccaucauggccucaaaaaccguaggcacauccgaagaaaaacuucgcaagaaaagcucguucuaccaaucuuaccugcgccgcacccagagcaugggcauccaacucgaccaacgaaucaucguccuauucaugguagccuggggaaaagaagccgucgacaacuuccaccugggagacgacauggaccccgagcuccgcacccuagcccaaagccuaauagacgucaaaguaaaagaaaucagcaaccaagaaccccucaaacuauag

SEQ ID NO: 7753 - RNA, 1290 nt, Artificial Sequence
  derived and/or modified CDS sequence (opt11) from HTNV(LongquanAa-09-191)__JQ912719.1__N
auggcaaccauggaggaacuccaacgcgaaaucaacgcccacgaaggccaacucgucaucgccagacaaaaaguccgcgacgccgagaaacaauacgaaaaagacccggacgaacucaacaaacgcgcccucaccgaccgcgaaggcgucgcagccucaauccaggcaaaaaucgacgaacugaaacgccaacuagccgaccgaaucgccaccggcaaaaaccucggaaaagaacaagaccccaccggcgucgaacccggcgaccaccuaaaagaacgcucaaugcuaagcuacggaaacguacucgaccucaaccaccucgacaucgacgaaccaaccggccaaaccgcggacuggcucucaaucgucguauaccucacgagcuucgucguccccauccuacucaaagcccuuuacaugcucacaacccgaggccgacaaacaaucaaagacaacaaaggaacccguauacgauucaaagacgacuccucauucgaagacgucaacgguauacgcaaaccaaaacaccucuacguaagccuacccaacgcccaauccucaaugaaagccgaagaaaucacccccggccgcuaccgaacagccauaugcggcuuauaccccgcccaaaucaaagcccgccagaugauaucccccguaauguccguaaucggauuccuagcccucgcaaaagacugggccgaccgcaucgaacaauggcuaucggaaccaugcaaacuccucccagacaccgccgccguaucacuccacggcggucccgcaaccaaccgcgacuaccucagacaaagacaagucgcccucggaaacauggaaaccaaagaauccaaagccauccgccaacacgcagaaaccgccggcugcucgaugaucgaggacauagaaucccccucaucaauaugggucuucgccggcgcccccgaccgcugucccccaacaugccucuucaucgccggaauagccgaacucggcgcauuuuucucaauccuacaagacaugcgaaacacaaucauggcaucgaaaaccgucggcaccuccgaagaaaaacuacgcaagaaaucauccuucuaccaauccuaucuucgccgaacccaaagcaugggcauacaacucgaccaacgcaucauuguccucuucauggucgccuggggaaaagaagccgucgacaacuuucacuuaggcgacgacauggaccccgaacuccgaacccuagcacaaucucucaucgacguaaaaguaaaagaaaucucaaaccaggagccccucaaacuauaa

SEQ ID NO: 7754 - RNA, 1290 nt, Artificial Sequence
  derived and/or modified CDS sequence (opt11) from HTNV(LongquanAa-09-192)__JQ912720.1__N
auggccaccauggaagaacuccaacgcgaaaucaacgcacacgaaggccaacucgucaucgcccgccaaaaaguccgggacgccgaaaaacaguaugaaaaagacccagacgaacucaacaaacgcgcccuaaccgacagagagggcguagccgcaagcaugcaaggcaaaauagacgagcucaaacgccagcuugcagaccgaauagccacaggcaaaaaccucggaaaagagcaagaccccacaggcguagaaccaggugaccaccucaaagagcguagcaugcuaucauacggcaacguccucgaccucaaccaccucgacaucgacgaacccaccggacaaacagcagacuggcuaagcauagucgucuaccugaccucauucgucguccccauacuccucaaagcacucuacaugcucacgacccgaggaagacaaaccaccaaagacaacaaaggaacccgcauccgcuucaaagacgacagcuccuucgaagacguaaacggaauccgaaaaccaaaacaccuauacguaucacucccgaacgcgcaaucaagcaugaaagccgaagaaaucacacccggacgcuaccgcacagcaauaugcggacucuaccccgcccaaauaaaagcacgacagaugauaagcccagucaugagcguaaucggauuccuagcccuagcaaaagacugggccgacagaaucgaacaguggcucuccgagcccugcaaacuccuaccagacaccgcagcaguaucccuacacggcggaccagccacaaaccgcgacuaccuucgccaacgccaagucgcgcucggcaacauggaaaccaaagaaagcaaagcaauccgccaacacgcagaaacagcagggugcuccaugauagaagacaucgaaucccccucaagcaucuggguauucgccggagcaccagaccgcugcccaccaacaugccuguuuaucgccggcaucgcagaacuaggagcguucuuuaguauccuacaggauaugcgcaacaccaucauggcaagcaaaacggucggcaccagugaggaaaaacucaggaaaaaaucaucauucuaccaaagcuaccuccgaagaacccaaagcaugggcauccaacuagaccagcgcauaauaguacucuucaugguagccuggggaaaagaagcagucgacaacuuccaccuaggcgacgacauggacccggaacuccgaacgcuagcacaaucacucauagacguaaaaguaaaagagaucucaaaccaggaaccccucaaacucuag

SEQ ID NO: 7755 - RNA, 1290 nt, Artificial Sequence
  derived and/or modified CDS sequence (opt11) from HTNV(LongquanAa-10-46)__JQ912754.1__N
auggcgaccauggaagaacuacaacgagaaaucaacgcccacgaaggccagcucguaauagcaagacaaaaaguccgcgacgcagaaaaacaauaugaaaaagaccccgacgaacuaaacaaacgggcccucaccgaccgcgaaggcgucgccgcaucaauacaagccaaaauagacgagcucaaacgacaacucgccgaccgcauugccaccggcaaaaaccucggcaaagaacaagaccccaccggcgucgaaccaggcgaccaccucaaagaacgaagcaugcuaagcuacggcaacguccuagaccucaaccaccuagacauagacgaacccacaggacaaacggccgacuggcucagcauagucguauaccucaccuccuucgucgucccaauacuccucaaagcccuguacaugcucaccacgagaggccgccaaaccacaaaagacaacaaaggaacaagaauccgcuuuaaagacgacagcuccuucgaagacguaaacggcauccgcaaaccagaacaccucuacgucucgcucccaaacgcccaauccucuaugaaggccgaagaaauaaccccaggccgauaccgcaccgccaucugcggccuauaccccgcccaaauaaaagcacgccaaaugaucagcccaguaaugagcgucaucggauucuuagcccucgcaaaagacugggccgaccgcaucgaacaauggcuguccgaacccugcaaacuacuccccgacaccgcggccguaucacuccacgguggcccagccaccaaucgcgacuaccuccgccaacgccaagucgcccucggcaacauggaaaccaaagaaagcaaagcaauccgccaacacgccgagacagcaggcugcucaaugaucgaagacaucgaaagccccagcagcaucugggucuucgcaggcgcccccgaccgcugcccaccaaccugccuauucaucgcaggcaucgccgaacucggcgcauucuucucaauccuucaagacaugcgcaacacaaucauggccuccaaaacaguaggaacaagcgaagaaaaacuccgcaagaaauccagcuucuaccaaagcuaccuacgccguacgcaaucaaugggaauccaacuugaccaacgcauaaucguccuauucauggucgcauggggcaaagaagccgucgacaacuuccaccucggcgacgacauggaccccgaacugcgcacacucgcccaaucccucaucgacgucaaagucaaagaaaucucgaaccaagaaccccuaaaacucuaa

SEQ ID NO: 7756 - RNA, 1290 nt, Artificial Sequence
  derived and/or modified CDS sequence (opt11) from HTNV(LongquanAa-11-745)__KC344237.1__N
auggccaccauggaagaacuacaaaaagagaucaacgcccacgaaggccaacucgucauagcccgacaaaaaguacgagaugccgaaaaacaauacgaaaaagaccccgacgaacucaacaaacgcgcccucacagaccgagaaggcgucgccgccagcauccaggccaaaaucgacgaacuaaaacgccaacucgccgaccgcaucgccaccggcaaaaaccucggcaaagaacaagaccccaccggcgucgaacccggcgaccacuuaaaagaacgcuccaugcucuccuacggcaacguauuagaucucaaccaccucgacaucgacgaaccaacaggacaaaccgcagacugguuaucaaucguaguauaccucaccucauucguagucccgauacuacugaaagcccuauacaugcuaaccaccaggggacgacaaacaaccaaagacaacaaaggcacacgcauccgcuucaaagacgacuccuccuucgaagacgucaacggcauccgaaagccaaaacaccuauacguauccuuaccaaacgcacaauccuccaugaaagccgaagaaaucacccccggccgcuaccgaaccgccaucugcggccucuacccagcccagaucaaagcccgccaaaugaucucaccggucauguccgucauaggcuuucucgcccuagcaaaagacugggccgaccgcaucgaacaaugguuguccgaacccugcaaacuacuucccgauaccgcugcugucucacuccacggaggcccagccaccaaccgcgacuaccuccgacaacgacaagucgcccuaggaaacauggaaaccaaagaauccaaagcaauacgccaacacgcagaaaccgcuggaugcucaaugaucgaagacaucgagagccccuccucaaucugggucuucgccggugcaccagaccgaugcccacccaccugucucuucauagcuggcaucgccgaacuaggggccuucuucuccauccuccaggacaugcgcaacaccauaauggcgagcaaaaccgucggcaccagcgaagaaaaacuaagaaagaaaagcuccuucuaccaaucauaccuccgacgaacccaaucaaugggaauccaacuagaccaacgcaucaucguccucuucaugguagcauggggaaaagaagccgucgacaacuuccaccucggcgacgacauggaccccgaacuccgcacacuagcccaaucacucaucgacguaaaaguaaaagaaaucucaaaccaagaaccccucaaacucuaa

SEQ ID NO: 7757 - RNA, 1290 nt, Artificial Sequence
  derived and/or modified CDS sequence (opt11) from HTNV(ROKA14-11)__KU207207.1__N
auggccaccauggaagaacuacaacgagaaauaaacgcccacgaaggacaacuggucaucgcccgacaaaaagucagagacgccgaaaaacaauacgaaaaggaccccgacgaacucaacaaacgcgcacuaacagaccgagaaggcguagccgucuccauccaagccaagauagacgaacuaaaacgccaacucgccgaccgcaucgcgaccggcaaaaaccucggcaaagaacaagacccaacaggcguggaaccaggcgaccaccuaaaagagcggucgaugcucucauacggaaacguccuugaccucaaccaccucgacaucgacgaaccgaccggacaaacagcagacuggcugagcaucguaguauaccuaaccuccuucgucgucccaauacuccucaaagcccuauacaugcucaccaccaggggccgccaaacaaccaaagacaauaaaggcaccagaauacgauucaaagacgacagcagcuucgaagacgucaacggcauacgaaaaccaaaacaccuauacgucucccuaccgaacgcgcaaucaagcaugaaagccgaagaaauaacaccaggcagauaccgaacagccgucugcggacuauaccccgcccaaauaaaagcacgccaaaugauauccccaguaauguccguaaucggguuccuagcccucgccaaagauuggucagaccgcauagaacaauggcuauccgaacccugcaaacuacuacccgacaccgcagccgucucacucuuaggcggccccgcgaccaaccgcgacuaccuacgccaacgccaagucgcccuagggaacauggaaaccaaagaauccaaggcaauccgccaacacgccgaagccgccggcugcucuaugaucgaagauauagaaagccccucaucaaucugggucuucgccggcgcacccgaccgaugcccacccacaugccuauucguagccggcaucgcagaacucggagccuucuucagcauccuacaggacaugcgaaauacaaucauggcauccaaaaccguaggcacaagcgaagagaaaaugcgcaagaaaagcucauucuaccaaucguaccuccgucgcacccaaagcauggguauacaacuggaccaacgcaucauaguccucuucaugguagccuggggcaaagaagccguggacaacuuccaccuuggcgacgacauggaccccgaacuccgcacccuagcacaaucgcuaaucgacguaaaagucaaagaaaucagcaaccaagaaccacucaaacucuaa

SEQ ID NO: 7758 - RNA, 1290 nt, Artificial Sequence
  derived and/or modified CDS sequence (opt11) from HTNV(US8A14-2)__KU207208.1__N
auggcgaccauggaagaacuacaaagagagaucaacgcccacgaaggacagcuagucauagccagacaaaagguaagagacgcagaaaaacaagauggcaaagacccggacgaacucaacaaacgcgcacuaaccgaccgcgaaggcgucgccguaagcauacaagcgaaaauugacgaacucaagcgucagcucgccgacagaaucgccaccggcaaaaaccucggaaaagaacaagaccccacaggaguagaaccgggagaccaccuaaaagagagaucaaugcucagcuacggcaacguccuggaccuaaaccaccucgauauagacgagccuacaggacaaaccgccgacuggcucagcauagucguauaccucacgucauucguagucccaauccuacucaaggcccuauacaugcuaaccacccgaggccgacaaacaaccaaagacaacaaaggaacccggaucagauucaaagacgacagcucauucgaagacgugaacgggaucagaaaacccaaacaccucuacgucucacuacccaacgcccaaucgagcaugaaagccgaagaaauuacacccggacgauaccgcacagccguaugcggacucuaccccgcccaaauaaaagcacgacaaaugauaagccccguaaugagcguaaucggauuccuagcgcuagccaaagacuggagcgaccgcaucgaacaauggcucagcgagcccugcaaacuccucccagacacagccgccgucucacuccucggcggacccgcaaccaaccgagacuaccuacgacagcgacaagucgcacucggaaauauggaaaccaaagaaagcaaagccauacgccagcacgcagaggccgccggaugcucaaugauagaagacauagagagcccgagcuccaucugggucuucgccggagccccagaccgaugcccacccacaugccucuucauagccgggaucgcagaauuaggagcauucuucagcauacuccaggacaugagaaacaccauaauggcgagcaagaccgucggcaccagcgaagaaaaacucagaaagaaaagcucauucuaccaaucguaccuacgccgcacacagagcaugggcauacaacuggaccaaagaauaaucgugcuauucaugguagccuggggcaaagaagcuguagacaacuuccaccugggcgacgacauggaccccgaacuacgcacacucgcacaaucccucauagacguaaaagucaaagaaaucucaaaccaagaaccccuaaaacucuag

SEQ ID NO: 7759 - RNA, 1290 nt, Artificial Sequence
  derived and/or modified CDS sequence (opt11) from HTNV(US8A15-1)__KU207209.1__N
auggcaaccauggaagaacuacaacgcgagaucaaugcccacgaaggacagcuaguaaucgcucgccaaaaagucagagacgccgaaaaacaauacgaaaaagaccccgacgaacucaacaaacgcgcccugaccgaccgagaaggagucgccgucuccauacaagccaaaaucgacgaacuaaaacgacaacucgccgacagaaucgcgacaggcaaaaaccuaggaaaagaacaagacccaaccggagucgagccaggagaccaccuaaaagagcgcucaaugcucuccuauggcaacguacucgaccuaaaccaccucgacaucgacgaacccacaggccaaacggcagacuggcuuuccaucgucguauaccucaccagcuucguaguacccauccuccuaaaagcacucuacaugcucacaaccagaggcagacaaaccaccaaagacaacaaaggaacacgcauacgauucaaagacgacucaucauucgaagacgucaacggaauccgaaaaccaaaacaccucuacgucucacucccaaacgcccaauccuccaugaaagccgaagaaaucacccccggccgauaccgaaccgccgucugcggccucuaccccgcacaaauaaaagcgagacaaaugaucagccccgucaugagcgugauaggcuuccucgcccucgcaaaggacugguccgaccgcauugaacaauggcucucagaacccugcaagcuccuccccgacaccgcagccguaucacuacucggaggcccugccacgaacagagacuaccuacgacagcgccaagucgcgcuaggcaacauggaaaccaaagaauccaaagcaauccgccaacacgccgaagccgccggaugcagcaugauagaggacauagaauccccaagcagcaucugggucuucgccggagcaccagaccgaugcccacccacaugccuauucauagccggcaucgccgaacucggcgccuucuucagcauacuccaagacaugcgcaacaccauaauggcauccaaaaucguaggcaccagcgaagaaaaacuccgaaagaaaagcuccuucuaccaauccuaccuccgccgaacucaaagcaugggcauucaacucgaccaacgaaucaucguacucuucaugguagcuuggggaaaagaagcagucgacaacuuccaccucggcgacgacauggaccccgaacuacgcacccucgcacaaucacucauagacguaaaagucaaagaaaucuccaaccaagaaccacucaaacucuaa

SEQ ID NO: 7760 - RNA, 1290 nt, Artificial Sequence
  derived and/or modified CDS sequence (opt11) from HTNV(YaluRiver13)__HQ611981.1__N
auggccaccauggaagaacuccaacgcgagaucaacgcccaugaaggacaacucguaaucgccagacaaaaaguacgcgacgccgaaaaacaauacgaaaaagaccccgacgaacucaacaaaagagcccuaacagaucgugaaggcguagccguaagcauccaagccaaaauagacgaacucaaacgccaacuagcggaccgcauagcaaccgggaaaaaccucggcaaagaacaagacccaaccggagucgaacccggcgaccaccucaaagaacgcuccaugcucagcuacggcaaugucuuagaccuaaaccaccucgacauagacgaacccaccggccaaaccgcagacuggcucagcaucgucgucuaucucacauccuucgucguccccauccuacucaaagcccuauacaugcucacaacccgcggcggacaaacaaccaaggacaacaaaggcacccggauccgguucaaagacgacagcucauucgaagacguaaacggcauccgaaaaccaaaacaccucuacgucucccucccaaacgcccagucaagcaugaaagcagaagaaaucacucccggccgcuaccguacagccauaugcggucuauaccccgcacaaauaaaagcccgccaaaugaucuccccagucaugagcgucaucggauuccucgcccucgcaaaagacuggagcgaccgcauagaacaauggcucagcgagcccugcaaacuccuccccgacaccgcagccguaucacuccugggaggcccagcgacaaaccgcgacuaccuacgucagcgccaggucgcacucggaaacauggaaaccaaagaaucaaaagccauccgacaacacgccgaagccgccggcugcuccaugauagaagacaucgaauccccauccuccaucugggucuucgccggugccccagacaggugcccacccacaugccucuucauagccuccaucggagagcucggcgcguucuucuccauccuucaagacaugagaaacaccauuauggcaagcaaaaccgugggcaccucagaagaaaaacuucgaaagaaaagcucauucuaccaaucuuaccugcgucgcacacaaagcaugggcauacaacuagaccagcgaaucaucguccucuucauggucuccuggggcaaagaagcagucgacaauuuccaccuaggcgacgacauggacccggaacuccgcacucucgcccagucacuaaucgacgucaaaguaaaagaaauccccaaccaagaaccgcucaaacuauaa

SEQ ID NO: 7761 - RNA, 1290 nt, Artificial Sequence
  derived and/or modified CDS sequence (opt11) from HTNV(84FLi)__AY017064.1__N
auggccacaauggaagaacuccaacgagaaaucaacgcacacgaaggccagcuaguuaucgcccgccaaaaagucagagacgcugaaaaacaauaugaaaaagaccccgacgaacucaacaaacgcacccucaccgaccgcgaaggcgucgcagccuccauacaagccaaaauagacgaacucaaacgccaacuagcagaccgcaucgcaacaggcaaaaaccucggaaaagagcaagaccccaccggcgucgaaccaggcgaccaccuaaaagaacgauccaugcucagcuauggaaacguccucgaccucaacuaccucgacaucgacgaacccaccggacaaaccgcagacuggcucuccaucgucauauaccucaccucauucgucguccccauccuccuaaaagcccuguacaugcucaccaccagaggccgccaaaccacaaaagacaacaaagguacccgcauccgcuucaaagacgacuccuccuucgaagacgucaacgggauccgaaaacccaaacaccucuacgucucccuacccaacgcccaaucaagcaugaaagccgaagaaauuacaccaggccgauaccgcacugccaucugcggacucuaccccgcacaaauaaaagcgagacaaaugaucuccccaguaaugagcguaaucggcuuccucgcccuggccaaagacugguccgaucgaaucgaacaauggcucuccgaacccugcaaacuccuccccgacaccgccgccgucucccuccacggcggccccgcaaccaaccgagauuaccuacgccaacgacaagucgcacucggaaacauggaaacgaaagaaagcaaagccauccgacaacaugccgaaucagccggaugcuccaugauagaagacauagaaucacccagcagcaucugggucuucgccggcgccccagaccgcugcccaccaacaugccuauucaucgccggcauagccgaacugggagccuucuucuccauccuccaggacaugcgaaacaccauaauggccagcaaaaccgucggaaccagcgaagaaaaacucagaaagaaauccucguucuaccaaucguaccuacgccgcacccagagcaugggcauccaacuagaccaacgcaucaucgugcuauucauggucgccuggggcaaagaagcggucgacaacuuccaccuaggagacgacauggacccagaacuccgcacgcucgcccaaucacucaucgacgucaaaguaaaagaaaucucaaaccaagaaccacucaaacuuuag

SEQ ID NO: 7762 - RNA, 1290 nt, Artificial Sequence
  derived and/or modified CDS sequence (opt11) from HTNV(Bao14)__AB127998.1__N
auggccacaauggaagaacuccaacgcgaaaucaacgcccacgaaggccaacucgucaucgcacgccaaaaaguccgugacgcggaaaaacaauacgaaaaggaccccgacgaacucaacaaacgaacccugaccgaucgagaaggagucgcaguaagcauacaagcaaaaauagacgaacucaagcgccaacuagccgaccgcauagcaaccgguaaaaaucucggaaaagagcaagaccccaccggugucgaacccggcgaccaccucaaagaaagauccaugcucucauauggcaacguccucgaccuaaaccaccucgacaucgacgaaccaacaggccaaaccgccgacuggcucagcaucguaguauaccucaccuccuucgucguccccauccuccuaaaagcccuuuacaugcuaaccacacgcggccgacaaacaaccaaagacaacaaaggcacacgcauacgcuucaaagacgacucauccuucgaagacguaaacggcauaagaaaaccaaaacaccucuacgucucccuuccaaacgcccaaucaagcaugaaggcagaagagaucacgcccggacgcuaccggaccgccauaugcggacuauaccccgcccagauaaaagcccgacaaaugaucagcccagucaugagcguaaucggguuccuagcccucgccaaagacuggucagaccgcauagagcaauggcucagcgagcccugcaaacuccucccagacacagccgccgucucacuacuaggcggcccagccacaaaccgcgacuaccuccgccaacgccaggucgcacucggcaacauggaaaccaaagaaagcaaagccauacgccaacacgcagaagcagccggaugcuccaugaucgaagacaucgaaucccccuccucaauauggguauucgccggggcccccgacagaugcccgccaaccugccuauucaucgccggcaucgcugaacucggcgccuucuucucaauucuccaagacaugagaaacaccaucauggccucgaaaaccgucggcaccuccgaagaaaaacuacgaaagaaaagcuccuucuaccaaucguaccugcgacgcacccaaucaaugggcauccaacucgaccaacgcaucaucguucucuucauggucgccuggggaaaagaagccguagacaacuuccaccucggcgacgacauggaccccgaacuccgcacccuagcacaaucccucaucgacguaaaaguaaaagagauaucaaaccaagaacccuuaaaacucuaa

SEQ ID NO: 7763 - RNA, 1290 nt, Artificial Sequence
  derived and/or modified CDS sequence (opt11) from HTNV(Chen4)__AB027101.1__N
auggccaccauggaagaacuccaaagagagauaaacgcacaugaaggccaacucgucauagcacgacaaaaaguacgcgacgcagaaaaacaauacgaaaaagaccccgacgaacucaacaaacgaacacugaccgacagagaaggcgucgccgccuccauccaagccaaaauagacgaacuaaaacgccagcucgccgaccgaaucgcaaccggcaaaaaccuaggaaaagaacaagaccccacgggcguagaacccggcgaccaccuaaaagaacgaucaaugcucuccuacggaaacguccuagaccucaaccaccucgacaucgacgaaccaaccggccaaacagcagacuggcucucaaucgucauuuaccuaaccucauucgucguccccauacuccucaaagcccuauacaugcucaccacccgaggcagacaaaccaccaaagacaacaaaggcacccgcauccgcuucaaagacgacuccuccuucgaagacguaaacggcauccgcaaacccaaacaccucuacgucucccuccccaacgcacaaagcuccaugaaagccgaagaaauaacccccggccgcuaccgcaccgccaucugcggccucuaccccgcgcaaaucaaagcacgccaaaugaucagccccgucaugagcguaaucggcuuccuagcccucgcaaaagauuggagcgaccguauagaacaauggcucagcgcacccugcaaacugcucccagacacagcagcaguaucacuccacggaggacccgccaccaaccgcgacaaccuacgccaacgccaagucgcacucggcaacauggaaaccaaagaaagcaaagcaauccgccaacaugccgaaagcgccgggugcuccaugaucgaagacauagagucaccauccucaaucugggucuucgccggcgcacccgaccggugcccacccacgugccucuucaucgcuggaaucgccgagcugggcgcauucuucuccauacuucaagacaugcgaaauaccauaauggccagcaaaacaguaggcacauccgaagaaaagcuccgcaagaaauccucauucuaccaaucauaccuacgccgcacccaauccaugggaauacaacucgaccaacgaaucaucguacucuucauggucgccuggggcaaagaagccgucgacaacuuccgccuaggcgaugacauggacccagaacuccgcacacucgcacaaucacucaucgacguaaaagucaaagagaucagcaaccaagaaccccuaaaacuauga

SEQ ID NO: 7764 - RNA, 1290 nt, Artificial Sequence
  derived and/or modified CDS sequence (opt11) from HTNV(Hu)__AB027111.1__N
auggcaacaauggaagaacuacagcgcgaaauaaacgcucacgaaggacaacucgucaucgcacgccaaaaaguccgagacgccgaaaagcaauacgaaaaagaccccgacgaacucaacaaaagagcccucaccgaccgcgaaggcgucgccgcaagcauacaggcaaaaaucgaugaacucaaacgacaacuggccgaccgaaucgcaaccgggaaaaaccuaggaaaggaacaagaccccaccggcgucgaacccggcgaccaccuaaaagaacgauccaugcuuuccuacggcaacguccucgaccuaaaccaccucgacauagacgaaccgaccggccagacagccgacuggcuaagcauaguaaucuaccucacauccuucgugguacccauccuccucaaagcccucuacaugcuaaccaccaggggcagacaaaccaccaaagacaacaaaggcacccggauccgcuucaaagacgacuccucauucgaagacguaaacggaauccgcaaaccaaaacaccucuacgucucccuccccaacgcucaauccagcaugaaagcagaagaaaucacccccggcagauaccguaccgccaucugcggacucuaccccgcccaaaucaaagcacgacaaaugaucucccccgucaugagcgucauaggcuuccucgcccucgccaaagacugguccgacagaaucgaacaauggcuaagcgaacccugcaaacuacucccagacacggccgcagucagccuacacggaggccccgcaacaaaccgagacuaccuccgccaacgccagguagcacuaggcaacauggaaacaaaagaaagcaaagcaaucagacaacacgcagaagccgccggcugcucaaugaucgaagacauagaauccccaagcucaauauggguauucgccggcgcacccgaccgcagcccacccacaugcauguucaucgccggcauagacgaacucggcgcauucuucagcauccuccaagacaugcgcaacacaaucauggccuccaaaacaguaggcacauccgaagaaaaacuccggaagaaauccuccuucuaccaaagcuaccuacgaagaacacaaagcaugggcauccaacucgaccaaagaaucauaguacuguucauggucgccuggggaaaagaagcagucgacaacuuccaccugggcgacgacauggacccggaacugcgaacacucgcacaaucccuaauagacaucaaaguaaaagagauaucaaaccaggaaccccucaaacucuga

SEQ ID NO: 7765 - RNA, 1290 nt, Artificial Sequence
  derived and/or modified CDS sequence (opt11) from HTNV(HubeiHu02)__JQ665905.1__N
auggcgacaauggaagaacuucaaaaagaaauuaacgcccacgaaggacaacucguaaucgcccgccaaaaaguccgcgacgccgaaaaacaauacgaaaaagaccccgacgaacucaacaaaagaacacuuacagacagagaaggagucgcagcaagcauccaagcaaaaauagacgaacucaaacgccaacuagcggaucgcaucgcaacaggcaaaaaccucggcaaagaacaagaccccacaggagucgaacccggagaccaccucaaagaacgcucaaugcucagcuacggcaacguacucgaccuaaaccaccuagacaucgacgaaccaaccggccaaacagccgacuggcuuagcauagucaucuaccucacauccuucgucguacccauacuacuaaaagcccuauauaugcucaccacccgcggccgucagacaaccaaagacaacaaaggcacccgaauacgcuucaaagacgacuccagcuucgaagacgugaacggcauccgaaaacccaagcaccucuacgucucacuccccaacgcccaauccagcaugaaagccgaagacauaacgcccggacgcuacagaaccgcaaucugcggacuguaccccgcccaaaucaaagcacgccaaaugaucucccccgucaugucagucaucggauuccuagcccuagccaaagacuggagcgaccgcaucgaacaauggcuauccgaacccuguaaacuccuccccgacacagcagccguaagccuacacggcggccccgcaaccaaccgcgacuaccuacgccagagacaagucgcccuaggaaacauggaaacaaaagaauccaaagcaauacgacaacacgcggaauccgccggauguagcaugaucgaagacauagagucccccuccuccaucugggucuucgccggagccccagaccgcugcccuccaaccugccucuucauagccggaaucgccgaacuaggcgcuuucuucagcauucuccaagacaugagaaacaccauaauggcgucaaaaaccguaggaaccagcgaagagaaacuccgcaagaaaucuuccuucuaccaaagcuaccuaagaagaacccaauccaugggcauccaacuagaccagcgcauaaucguacucuucauggucgccuggggcaaagaagccgucgacaacuuccaccuaggcgacgauauggaccccgagcuacguacccuagcccaaucacuaauagacgucaaagucaaagaaaucagcaaccaagaaccccucaaacucuaa

SEQ ID NO: 7766 - RNA, 1290 nt, Artificial Sequence
  derived and/or modified CDS sequence (opt11) from HTNV(HV004)__JQ083395.1__N
auggccaccauggaagaacuacaaaaagaaaucaacgcgcaugaaggccaacucgucauagcacgccaaaaaguccgcgacgccgaaaaacaauacgaaaaagacccagacgaacucaacaaacgagcccuaacagaccgcgaaggaguagccgcaucuauccaagccaaaaucgacgaacucaaacgccaacuagccgacagaaucgccaccggcaaaaaccuaggaaaagaacaagaccccacaggcgucgagcccggcgaccaccucaaagaacgcuccaugcuaucauacggaaacguacucgaccuaaaccaccucgacauagacgaaccaacaggccaaacagccgacuggcuauccaucgucaucuaccuaaccuccuucguagucccaauccuacuaaaagcgcuauacaugcucacaacccgaggacgccaaaccacaaaagacaacaaagguacccgcauacgcuucaaagacgacuccucauucgaagacguaaacgguauccgcaaacccaaacaccucuacgucucccuaccaaacgcacaaucuagcaugaaagccgaagaaaucaccccaggacgcuaccgcaccgcuaucugcggccucuaccccgcacaaauaaaagcccgacaaaugaucucaccagucauguccguaauaggcuuucuagcacucgccaaggacugguccgaccgcaucgaacaauggcucagcgaacccugcaaacuacucccagacacugccgcagucucucuccacggaggccccgccaccaaccgcgacuaccuacgacaacgccaagucgcccucggaaacauggaaaccaaagaaucaaaagcaauccgacaacacgccgaauccgcaggcugcucgaugaucgaagacaucgaaucccccuccucaaucugggucuuugccggcgccccagacagaugcccgccaaccugccucuucauagccggcaucgccgaacucggcgccuucuucuccauccuacaagacaugcgaaacaccaucauggccagcaaaacagucggaaccucagaagaaaaacugcgcaagaaaucauccuucuaccaauccuaccuacgccgcacacaguccaugggcauacaacuagaccaacgcauaauuguacuauucaugguagccuggggcaaagaagcagucgacaacuuccaccucggcgacgacauggaccccgaacuucgcacccuagcccaaagccucaucgacgugaaagucaaagaaaucagcaaccaagaaccccucaaacuauaa

SEQ ID NO: 7767 - RNA, 1290 nt, Artificial Sequence
  derived and/or modified CDS sequence (opt11) from HTNV(Maaji-1)__AF321094.1__N
auggcaacaauggaagaacuccaaaaagaaauuaacgcacacgaaggccaacucguaaucgcccgacaaaaggucagagacgcagaacgccaauacgaaaaagauccggacgaacucaacaaacgaacccuaacagaccgagagggcguagccgcauccauccaagcaaaaaucgacgaacucaaacgacaacuagcagaccgcaucgccacaggcaaaaaccucggaaaagaacaagaccccacaggcgucgaaccgggcgaucaccugaaagaacgcucaaugcuaagcuacggaaacguccucgaccucaaccaccucgacaucgacgaacccaccggccaaaccgcagacuggcuaagcauagucaucuaccuaaccucguucgucguccccauccuccucaaagcccuauacaugcuaaccacuagaggccgacaaaccaccaaagacaacaaaggaacccguauacgauucaaagacgacagcagcuucgaagacgucaacggcauacgaaaacccaaacaccucuacgucucacuacccaacgcccaaucgucaaugaaagcagaagaaaucacccccggcagauaccgaacagccgucugcggacucuaucccgcacaaaucaaagcacgccaaaugauaagccccguaauguccguaauaggauucauggcccucgccaaagacuggagcgaacgcaucgaacaauggcuaagcgaacccugcaaacuccucccggacaccuccgcagucucccuccugggaggccccgcaacaaacaaagacuaccugcgccaacgccaggucgcccucggcaacauggaaaccaaagaauccaaagccaucagacaacaagccgaagcauccggcugcucuaugaucgaagacaucgaaagccccagcucaaucuggguauucgcaggcgcccccgaccgaugcccacccacaugccucuucauagcaggcauggccgaacucggagcauucuucucgauccuacaagacaugcgcaacaccaucauggccagcaaaaccgucggcaccuccgaagagaaacuccgcaagaaaucaucauucuaccaauccuaccuccgccgcacccaaagcaugggaauacaacucgaccaacgcaucaucguacuauuuaugguugccuggggaaaagaagccgucgacaacuuccaccuaggcgacgacauggaccccgaacuccgcacccuagcccaaucccucaucgacgucaaaguaaaagaaauauccaaccaagaaccacucaagcuauaa

SEQ ID NO: 7768 - RNA, 1290 nt, Artificial Sequence
  derived and/or modified CDS sequence (opt11) from HTNV(Maaji-2)__AF321095.1__N
auggccaccauggaagaacuccaacgcgaaaucaacgcacacgagggacaacucgucauagcacgccaaaaaguacgggacgccgaaaaacaauacgaaaaagaccccgacgaacuaaacaaacgcacacucaccgaccgcgaaggcguugccguauccauccaagcaaaaaucgacgaacucaaacgacaacucgcagaccgcauagcaaccggcaaaaacuucggaaaagaacaagaccccaccggcgucgagcccggcgaccaccucaaagaacgcuccaugcuaagcuacggcaacguccuagaccucaaccaccuagacaucgacgaacccaccggacaaaccgccgauuggcucuccauagucguauaccucacauccuucguaguccccauccuucucaaggcccucuacaugcucaccacccgcgguagacaaaccaccaaagacaacaaaggcacccggauaagguucaaagacgacucaucuuucgaagacgucaacggaauccgcaaacccaagcaccuauacgucucccuccccaaugcccaaucauccaugaaagcagaagaaaucacccccggacgcuaccgcacagccguaugcggccuuuacccagcccaaaucaaagcccgccaaaugaucucccccgucauguccgucauaggauuccucgcccucgcaaaagacuggagcgaccgcaucgaacaauggcucagcgaacccugcaaauuacuacccgacacagccgccgucagccuccuaggaggccccgccaccaaccgcgacuaccuacgccaacgccaagucgcccucggaaacauggaaacaaaagaauccaaagcaauacgacaacacgcggaagcagcaggcugcucuaugaucgaagacaucgaguccccauccuccaucugggucuucgccggcgcccccgaccgcugcccaccaaccugccuauucaucgccggcaucgccgaacuaggcgcauucuucagcauccuccaagacaugcgaaacaccaucauggccuccaaaaccguaggcaccuccgaagaaaaacuaagaaagaaaagcagcuucuaucaauccuaccuacgacgcacccaacuaaugggcauccaacuggaccaacgaaucauaguccucuucaugguggcauggggcaaagaagccguggacaacuuccaccuaggagacgacauggaccccgaacugcgaacccucgcccaaucgcucaucgacgucaaaguaaaagaaaucagcaaccaagaaccccuuaaacucuag

SEQ ID NO: 7769 - RNA, 1290 nt, Artificial Sequence
  derived and/or modified CDS sequence (opt11) from HTNV(N8)__DQ658415.1__N
auggcgaccauggaagaacuacaaagagaaauaaacgcccacgaaggacaacucguaaucgcccggcaaaaaguccgcgacgcugaaaaacaauacgaaaaagacccagacgaacucaacaaacgcacccuaacagaccgcgaaggcgucgccgccagcauacaagcgaaaaucgacgaacucaaacgccagcuugccgaccgcauagcgacaggcaaaaaccucgggaaagaacaagacccaaccggcguggaacccggagaccaccuaaaagaacgaagcaugcuaagcuacggcaacguccuagaccucaaccaccucgacaucgacgaacccaccggccaaaccgccgacuggcuuagcaucgucaucuaccuaaccuccuucguaguccccauccuccucaaagcacucuacaugcuuaccaccaggggccgccaaacaaccaaagacaacaaaggcaccagaauccgauucaaagacgacagcucauucgaagacgucaacggaauccgcaaacccaaacaccuauaccucucgcuccccaacgcgcaaucaagcaugaaagccgaagaaauaacccccggccgcuaccgaacagccaucugcggccucuaucccgcccaaauaaaagccagacaaaugauauccccaguaaugagcgucaucggcuuucucgcccucgccaaagacuggagcgaccgcaucgaacaauggcucagcgaaccaugcaaacuccucccggacgccgccgcgguaucgcugcacggcggcccagccaccaacagagacuaccuccgccaacgccagguagcacucggcaacauggaaacaaaggaaagcaaagccauccgccaacacgccgaaaccgcaggcugcuccaugaucgacgauaucgagagccccuccucgauaugggucuucgccggcgccccagaccgaugcccacccacaugccucuucauagcagggaucgccgaacuaggcgccuucuucagcauccuucaagacaugcgaaacaccaucauggcauccaaaaccguaggaacaagcgaagaaaaacuccgcaaaaaguccucauucuaccaaagcuaccuaagaagaacccaauccaugggcauccaacucgaccaacgaaucaucguccucuucaugguggcauggggcaaagaagccgucgacaacuuccaccuaggcgacgacauggaccccgaacucagaacacucgcccaaagccuaauugacgucaaaguaaaagaaaucucaaaccaagaaccccucaaacucuag

SEQ ID NO: 7770 - RNA, 1290 nt, Artificial Sequence
  derived and/or modified CDS sequence (opt11) from HTNV(Q32)__AB027097.1__N
auggcaaccauggaagaacugcaacgagaaaucaacgcccacgagggacaacucgucaucgcccgacucaaaguacgcgacgcagaaaaacccuacgaaaaagacccagacgaacucaauaugcgaacccucacagaccgagaaggcgucgccgcaagcauccaggccaaaaucgacgaacuaaaacgccaacucgcagaccgcaucgccaccggcaaaaaccucgguaaagaacaagacccaaccggcguagagcccggcgaccaccucaaagaacgcucaaugcuaucauacggcaacguacucgaccuaaaccauuuagacaucgacgaacccaccggccaaaccgcagacuggcuauccauaguaauauaccucacaucauucgucguaccaauccuccugaaagcacucuacaugcuaaccacccgaggccgccaaaccaccaaagacaacaaaggaaccagaauacgcuucaaagacgacucauccuucgaagacgucaacggcauacgaaaacccaaacaccucuacguaucgcuaccaaacgcccaauccucaaugaaagccgaagaaaucaccccuggccgauaccgaaccgcaauaugcggccucuaccccgcccaaauaaaagccagacaaaugauaagcccagucauguccgucauaggcuuccuagcacucgccaaagacuggagcgaccgcauagaacaguggcuaagcgaaccaugcaaacuccuccccgacaccgccgccgucucccuucacggcggcccagccaccaaccgugacuaccuccgccaacgccaagucgcccuaggaaacauggaaaccaaagaauccaaagccauccgacaacacgcugaauccgcaggcugcagcauggucgaggacaucgaaucaccaucaagcaucuggguguucgccggcgcccccgaccgaugccccccaacaugccuguucaucgcaggcauagccgaacucggcgcuuucuucucaauccuccaagacaugcgaaacacaauaauggccucaaaaacagucggcacaagcgaagaaaaacuacgcaaaaaaucauccuucuaccaauccuaccuacgacgcacccaauccaugggcauacaacucgaccaacguauaaucguucucuuuaugguggcauggggaaaagaagccgucgacaacuuccaacccggcgacgacauggaucccgaacuccgcacccuagcccaaagccugaucgacgucaaaguaaaagaaaucucaaaccaagaaccccuaaaacuguga

SEQ ID NO: 7771 - RNA, 1290 nt, Artificial Sequence
  derived and/or modified CDS sequence (opt11) from HTNV(SXHu2012B1)__KC844226.1__N
auggccaccauggaagaacuccaacgcgaaauaaacgcccacgaaggacaacucgucauagcacgccaaaagguccgagacgcggaaaaacaauacgaaaaggacccagacgaacucaacaaaagggcacucaccgaccgcgaaggcgucgcagccucaauccaagccaaaaucgacgaacucaaacgacagcucgcagaccgcaucgccaccggcaaaaaccucggcaaagaacaagacccaaccggcguagaacccggcgaccaccuaaaagaacgaucaaugcuauccuacggaaacguccuagaccucaaccaccuagacaucgacgaaccgaccggacaaacagcagacuggcucuccauagucauauaucuaacauccuucguagucccaauccuccucaaagcccuauacaugcucacaacccgcggccgacaaaccaccaaagacaauaaagguacccggauccgcuucaaagacgacuccucauucgaagacguaaacgggauccgaaaaccgaagcaccucuacgucucccucccaaacgcgcaauccuccaugaaagccgaagagaucacgcccggccgauaccgcacggcaauaugcggacuuuaccccgcccaaaucaaagcgcgccaaaugauaagccccguuaugagcgucauaggcuuccucgcccucgccaaagacuggagcgaccgcauagagcaaugguuaagcgaacccuguaaauuacucccagacaccgcagcgguaucccuccauggcggccccgccaccaaccgagacuaccugcgccaacgacaagucgcccucggaaacauggaaaccaaagagagcaaagccaucagacaacacgcggaaucagccggaugcucaauggucgaagacaucgaaagcccgucaagcaucuggguauucgcaggcgcccccgaccggugcccgcccacaugccuauucaucgccggaaucgcagaacuaggcgccuucuuuuccauccuccaggacaugcgcaacaccauaauggcaucaaaaaccguaggcaccagcgaagaaaaacuaagaaagaaauccuccuucuaccagucauaccuaagaaggacccaaagcaugggaauacaacucgaccaacgcauaaucguacucuucaugguagccuggggcaaagaagcaguagacaacuuccaccucggcgacgacauggaccccgaacugcgcacgcucgcacaaucccuuaucgacgucaaagucaaagaaaucuccaaccaagaaccccucaaacucuga

SEQ ID NO: 7772 - RNA, 1290 nt, Artificial Sequence
  derived and/or modified CDS sequence (opt11) from HTNV(TJJ16)__AY839871.1__N
auggccacgauggaggaacuccagagagaaaucaaugcgcacgaaggacaacugguaaucgccagacaaaaaguccgcgacgcggaaaaacaauacgaaaaggaccccgacgaacuaaacaaacgcgcccucaccgaccgcgagggccucgccgccagcauacaagcaaaaauagacgagcucaaacgucaacuagcagaccggaucgcaaccggcaaaaaccucggcaaagaacgcgaccccaccggcguagaacccggagaccacuuaaaagaacgcucaaugcuauccuacggcaacguccuagaccuaaaccaccuagacaucgacgaacccaccggacaaaccgccgauuggcuaucaaucguaauauaccuaaccucauucgucgucccuauacuccucaaagcccuauacaugcucacaacacgcgggaggcaaacaaccaaagacaacaaaggcacccgaauccgcuucaaagacgacagcagcuucgaagacgucaacggcauacgcaaacccaaacaccucuacgucagccuccccaacgcgcaaucauccaugaaagccgaagagauaacucccggaagauaccgcacggccauaugcggccucuacccagcccaaauaaaagcccgacaaaugauaagccccgucaugagcgucauaggguuccucgcacuagccaaagacugguccgaccgcauagaacaauggcuuucagaacccugcaaacuacucccagacacagccgccgucucccuacacggcggcccagccaccaaccgagacuaccuacgccagcgccaagucgcacucggcaacauggaaacaaaagaaagcaaagccauacgccaacacgccgaauccgccggcugcucaaugguagaagacaucgaaagccccagcuccauaugggucuucgccggggcccccgaccgcugucccccaaccugccucuacauagccgggaucgcagaacucggcgcauucuucagcauccuccaagacaugcgcaacaccauaauggcaagcaagacgguaggaacaagcgaagaaaaacuccgaaagaaaagcuccuucuaccaauccuaccuaagaagaacacaaucaaugggcauccaacuagaccagcgcaucaucguccuguucaugguagccuggggaaaagaagcaguagacaacuuccaccuaggcgacgacauggaccccgaacuacgcacccuagcccaaucccuaaucgacgucaaaguaaaagaaaucucaaaccaagaaccgcuaaaacuuuaa

SEQ ID NO: 7773 - RNA, 1290 nt, Artificial Sequence
  derived and/or modified CDS sequence (opt11) from HTNV(WCL)__KM355414.1__N
auggcaaccauggaagaacuccaacgcgaaaucaacgcccacgaaggacaacucgucauagcccgccaaaaaguccgcgacgccgaaaaacaauacgaaaaagacccagacgaacugaacaaacgcgcccugacagacagggaaggcguagcagucagcauccaagcaaaaauagacgaacucgaacgccaacucgccgacagaaucgcaaccgggaaaaaccucggcaaagagcaagaccccaccggaguagaaccgggcgaccaccuaaaagaacgcuccaugcuuuccuacggcaacguccuagaccucaaccaccucgacauugacgaacccaccggccaaaccgccgacuggcuaucaaucgucgucuaccuaaccagcuuuguagucccaauccuacuaaaagcacuauacaugcuuacaacacguggccggcaaacaacaaaagacaacaaaggaacccgaauccgauucaaagacgacuccucauucgaagacgucaacggcauaagaaaacccaaacaccucuacguaucccuccccaacgcccaguccuccaugaaagccgaagaaaucacaccaggccgcuaccgcacagcaaucugcggccucuaccccgcacaaauaaaagcccgccaaaugaucuccccaguaaugucagucaucggauuccuagcccuagccaaagacuggagcgaccgcaucgaacaaugguuaagcgaacccugcaaacuacucccagacacagccgcagucagccuccucggcggccccgcaacaaaccgagacuaccuucgccaacgacaagucgcccuaggaaacauggaaaccaaagaguccaaagccauccgacaacacgcugaggcagccggcugcuccaugauagaagacaucgaaagccccagcucaaucugggucuucgccggagcccccgaccgaugcccaccgaccugccuauucaucgcaggaaucgccgaacucggcgccuucuucucaauccuccaagacaugcgcaacaccauaauggccuccaaaaccgucggcacaagugaggaaaaacuccgcaagaaauccucauucuaccaaucuuaccuccgccgcacucaaucaaugggaauacaacuagaccagcgcaucauaguccucuucaugguagccuggggcaaagaagccguugacaacuuccaccucggcgacgacauggaccccgaacuccgaacccuagcccaaucacucaucgacgucaaaguaaaagaaaucucaaaccaagaaccccucaaacucuaa

SEQ ID NO: 7774 - RNA, 1290 nt, Artificial Sequence
  derived and/or modified CDS sequence (opt11) from HTNV(YN509)__GU329991.1__N
auggccacaauggaggaacuccagaaagaaaucaacgcgcacgaaggacaacucauuauagccaaacaaaaaguaaaagacgcagaaaaacaauacgaaaaagacccagacgaacuaaacaaacgagcccuaaccgaccgagaaggcguagccgccuccauccaagccaaaauagacgaacuaaaacgccaacucgccgaccgcaucgcaaccggcaaaaaccucggacaagaccgcgacccaaccggcguagaacccggcgaccaccuaaaagaacgcuccaugcucagcuacggcaacauacuagaccuaaaucaccucgacaucgacgaacccaccgggcaaacagccgacuggcucagcauaauagucuaccucaccuccuucgucguacccauccuccuaaaagcccucuacaugcugaccacacgcggacggcaaaccgcaaaagacaacaaaggcacaagaauaagauucaaagacgacagcagcuucgaggacgucaacggaauccgaaaacccaaacaccucuacgucagcaugcccaacgcccagucaagcaugaaagcagaagaaauaacaccaggccgcuaccgcaccgccgucugcggccucuaucccgcacaaaucaaagcgcgccaaauggucuccccagucauguccguuaucggcuucauggcccuggccaaagacuggaccgacagaauugaaaacuggcuaggcgaacccugcaaacugcuucccgacaccuccucaguaauacuccucggcggccccgccacaaacagagacuacauccgccaacgacaaguagcacucggaaacauggaaaccaaagaagccaaagccguccgacaacacgccgaaucagccggcugcuccaugaucgacaacaucgacagccccagcuccaucugggucuucgccggcgcacccgaccgaugcccaccaacgugccuauucgucgccggccucgcagaacuuggagcauucuucuccauacuccaagauaugcgaaacacaaucauggccagcaaaaccguaggcacaagcgaagaaaaaaugcgcaaaaaauccucauucuaccaauccuaccuccgccgcacccaauccaugggaauacaacucgaccaacgcaucaucguccucuucaugguugcauggggaaaagaagcagucgacaacuuccaccuaggcgacgacauggaucccgagcuccgcaaucuagcccaaucccuaauagaccaaaaagucaaagaaaucuccaaccaagaaccccucaaacucuaa

SEQ ID NO: 7775 - RNA, 1290 nt, Artificial Sequence
  derived and/or modified CDS sequence (opt11) from HTNV(YU62)__AY748309.1__N
auggccaccauggaagaacuccaacgcgaaaucaacgcccacgaaggacaacucgucaucgcccgccaaaaaguccgcgacgcagaaaaacaauaugaaaaagaucccgacgaacucaacaaacgcgcccucaccgaccgcgaaggacucgcggccagcauccaagccaaaaucgacgagcuaaaacgccaacucgccgaccgcauagccaccggaaagaaccucggcaaagaacaagaccccacaggcguugaaccaggcgaccaccucaaagaacgcucaaugcuaucauauggcaacguacucgaccucaaccaccucgacaucgacgaaccaaccggacaaaccgccgacuggcucuccaucgucaucuaccucaccagcuucgugguccccaucuugcuaaaagcacuuuacaugcucaccaccagaggucgccagacaaccaaagacaacaaaggcacccgcauacgauucaaagacgacucaucauucgaagacguaaacggcauccgaaaaccaaaacaccucuacgucucccuccccaacgcccaauccagcaugaaagcagaagaaaucacgccaggccgauaccgcacagccauuugcggccucuaccccgcucaaauaaaagcacgacagaugaucagccccguuaugagcguaaucggauuccucgcccuagccaaagacugguccgaccgcaucgaacaauggcuguccgaacccugcaaacuccucccagacaccgccgccgucucgcuccacggcggccccgcaacaaaccgcgacuaccuacgccaacgacaagucgcccucggcaacauggagaccaaagagucaaaagccauccgccagcacgcagagagcgccggcugcagcauggucgaagacaucgaaagccccucaucuaucugggucuucgcgggagcccccgaccgcugcccucccacaugccucuucaucgccggaaucgccgaacuaggagccuucuucuccauacuacaagacaugcgcaacaccaucauggccuccaaaaccgucggcacaucagaagaaaaacuccgcaagaaaucuagcuucuaccaaucauaccuaagaagaacacaaucaaugggaauccaacuagaccaacgcaucaucguccuauucaugguagccuggggcaaagaagccgucgacaacuuccaccucggcgacgacauggaccccgaacuccgcacccucgcacaaucccucaucgacgucaaagucaaagaaauaucaaaucaggaaccccucaaacucuaa

SEQ ID NO: 7776 - RNA, 1290 nt, Artificial Sequence
  derived and/or modified CDS sequence (opt11) from HTNV(ZLS6-11)__FJ753396.1__N
auggcgaccauggaagaacuccaacgcgaaaucaacgcccacgaaggccaacucgucauagcaaggcaaaaaguacgcgacgccgaaaaacaauacgaaaaagaucccgacgaacucaacaaacgagcacucaccgaccgcgaaggcguagcagcaagcauacaagccaaaaucgacgagcucaaacgccaacucgccgauagaaucgcaaccggcaaaaaccucgggaaagaacaagaccccacaggcguagaaccgggcgaccaccuaaaagaacgcuccaugcuaucauacggaaacguccuagaccuuaaccaccucgacauagacgaaccgaccggacaaacagccgacuggcucuccaucgucaucuaccucaccucauucgucgucccaauccuccucaaagcccucuacaugcuuaccacccgcggccgacaaacaaccaaagacaacaaaggaacccgaauccgcuucaaagacgacuccucauucgaagacaucaacggcauacgaaaacccaaacaccucuacgucucccugcccaacgcccaauccucaaugaaagccgaagaaaucacacccggcagauaccgcacagcuauaugcggccucuacccagcacaaaucaaagcacgacaaaugauaucccccguaaugagcgucauaggcuuccucgcacucgccaaagacugguccgacagaaucgaacaauggcuauccgaacccugcaaacuccuacccgacacggccgccgucucgcuacaugguggaccagccacaaaccgcgacuaccuccgucaacgccaaguagcacucggcaacauggaaaccaaagaauccaaggccauacgacagcacgcagaaaccgcaggcugcucaaugaucgaagacaucgaaagccccagcucaaucuggguauuugccggagcccccgaccguugcccuccaaccugccuauucauagccggaaucgcagaacucggcgccuucuucagcauccuccaagacaugagaaacaccaucauggcgagcaaaaccgucggcacaagcgaagaaaaacuaagaaagaaaagcuccuucuaucaaagcuaccuacgacgaacacaaagcaugggcauccaacuggaccagagaauaaucguacuauucauggucgccuggggcaaagaagccgucgacaacuuccaccuaggagacgacauggaccccgaacugcgcacccucgcacaaucccuaaucgacgucaaagucaaagaaauauccaaccaagagccccucaaacucuaa

SEQ ID NO: 7777 - RNA, 1290 nt, Artificial Sequence
  derived and/or modified CDS sequence (opt11) from HTNV__AB027523.1__N
auggcaacaauggaagaacuccaaaaagaaaucaacgcccacgaaggacaacuaauaauagcaaaacaaaaagucaaagacgccgaaaaacaauacgaaaaagaccccgacgaacuaaacaaacgggcccugacagaccgagaaggcguaagcgcaucaauccaagcaaaaaucgacgaacuuaaacgccaacucgccgacagaaucgccaccgggaaaaaccuaggccaagaccgagaccccaccggaguagaacccggcgaccaccucaaggagcgcucaaugcuauccuacggaaacauccuggaccuaaaccaccucgacaucgacgaacccaccggacaaaccgccgacuggcugagcauaaucguauaccucacauccuucgucguccccauacuccucaaagcccuauacaugcucacaacacgcggccgccaaacagcaaaagacaacaaaggaaccagaauccgauucaaggacgacagcagcuucgaagacguaaacgggauaagaaaacccaaacaccuauacguuucaaugcccaacgcccaaucaagcaugaaagccgaagaaaucacccccggcggcuaccgaaccgcaguaugcgggcuauuccccgcgcaaaucaaagcccgacaaauggucucccccgucaugagcgugaucggcuucauggcacucgccaaagacuggaccgacagaaucgaaucauggcugggcgagcccugcaaacuccuacccgacacaagcgccgucucccuccucggcggccccgccacaaaccgagacuacauccgccaacgccaggucgcccuaggaaacauggaaacaaaagaagccaaagcaguccgacaacacgccgaaucagccggaugcucaaugaucgacaacauagacagcccaagcucaaucugggucuucgcgggagccccagaccgcugcccacccacaugccucuucaucgcaggaaucgcagaacugggcgccuucuucagcauacuccaagacaugcgcaacaccauaauggccuccaaaaccguaggcacuagcgaggagaaaaugagaaagaaauccucauucuaccaaucauaccuccgcagaacccaaagcaugggaauacagcuagaccagcgaauaauaguacuauucauggucgcauggggcaaagaagcagcagacaacuuccaacacggcgacgacauggaccccgaacuccgaacccucgcccaaucgcucaucgaccaaaaaguaaaagaaauaucaaaccaagaaccccucaaacucuag

SEQ ID NO: 7778 - RNA, 1293 nt, Artificial Sequence
  derived and/or modified CDS sequence (opt11) from HTNV__D25530.1__N
augauggcuaccauggaagaacuccagcgagagaucaacgcccacgaaggccagcuagucaucgcccgacaaaaaguacgcgaugccgaaaagcaauacgaaaaagaccccgacgaacuaaacaaaagagcacucaccaaccgcgaaggcguagccgucuccauccaagcaaaaaucgacgaacucaaaaugcaacucgcagacaggauugcaacaggcaaaaaccucggaaaagaacaagacccaacaggagucgaacccggagaccaccucaaagaacgaagcaugcuguccuacggaaacguacucgaccuaaaccaccucgacaucgaugaaccaaccggacaaacggccgacuggcucuccaucauagucuaccucaccagcuucguaguccccauacuccucaaagcccuauacaugcuaacaaccagaggacgacaaaccacaaaagacaacaaaggcaccagaauccgcuucaaagacgacagcuccuucgaagacgucaacggaauccggaaaccuaaacaccucuacguaucccuccccaacgcacaauccagcaugaaagccgaagaaaucacccccggacgauaccgaaccgccgucugcggacucuauccagcccaaaucaaagcacgccaaaugaucucccccgucaugucagucaucggcuuccuagccuuagccaaggacuggagcgaccgcaucgaacaauggcucauagaaccaugcaaauugcugccggacaccgccgccgucucacuccuaggcggacccgcaacgaacagagacuaccuacgacaacgacaagucgcacucggcaacauggaaaccaaagaauccaaagccauaagacaacacgcagaggccgccggaugcuccaugaucgaagacaucgaaucccccagcuccaucugggucuucgcaggagccccagacaggugcccacccacaugccucuucaucgccggaaucgccgaacuaggcgccuucuuuuccauccuacaggacaugcgcaacacaaucauggcaagcaaaaccgucggcacaagcgaagaaaaacuccgcaagaaauccuccuucuaccaaucguaccuucgcagaacccaguccaugggcauccaacuagaccaaagaauaaucguacucuucaugguagcauggggcaaagaggccgucgacaacuuccaccuaggcgacgacauggaccccgaacuccgaacacuagcgcaaucccucaucgacgucaaaguaaaagaaaucuccaaccaagaaccacucaaacucuaa

SEQ ID NO: 7779 - RNA, 1290 nt, Artificial Sequence
  derived and/or modified CDS sequence (opt11) from HTNV__M14626.1__N
auggccaccauggaagaacuccaaagagaaaucaacgcccacgaaggccaacucgucaucgcccgccaaaaagucagagacgccgaaaaacaauacgaaaaggaccccgacgaacucaacaaacguacccucaccgaccgcgaaggcguagccgucagcauccaagcaaaaaucgacgaacucaaaagacaacuagccgacagaaucgccaccggcaaaaaccucgggaaagaacaagaccccaccggcgucgaaccgggcgaccaccucaaagaacgaucaaugcugagcuacgggaacguccuagaccucaaccaccucgacauagacgaaccaaccggccaaacagcagacuggcugagcauaauagucuaccuaaccuccuucgucgucccaauccuacucaaagcccuuuacaugcucaccacccgaggccgccaaacaaccaaagacaacaaaggcacccgaaucagguucaaagaugacagcuccuucgaagacgucaacgggauccgcaaaccaaaacaucucuacgucucacuacccaacgcccagucaagcaugaaagccgaagaaaucacgcccggacgcuaccgcacagccgucugcggacucuaccccgcccaaauaaaagcacgccaaaugauaucucccgucaugucagucaucggguuccuagcccuggcaaaagacuggagcgaccgcauagaacaauggcucauagagccaugcaaacugcuccccgacaccgcagcagucucccuccuaggcggccccgcaaccaaccgcgacuaccuacgccaacgacaggucgcacucggcaacauggaaacaaaagaaagcaaagccauacgccaacacgcagaagccgccggcugcucaaugauagaagacaucgagucccccagcuccauaugggucuucgccggcgccccggaccgcugcccaccaaccugccuguucauagccggaauagccgaauuaggcgcauucuucaguauacuccaagacaugcgcaacaccaucauggccagcaaaacagucggcacaagcgaagaaaaacuacgcaaaaagagcuccuucuaucaaagcuaccuccgccggacccaaagcaugggcauacaacuaggacaacgaauaauuguacucuucaugguggccuggggcaaagaagccgucgacaacuuccaccuaggcgacgacauggaccccgaacugcgaacccuagcgcaaucccucauagacguaaaaguaaaagaaaucucaaaccaagaaccccucaagcucuag

SEQ ID NO: 7780 - RNA, 1290 nt, Artificial Sequence
  derived and/or modified CDS sequence (opt11) from HTNV__X95077.1__N
auggccaccauggaggagcuccaacgcgaaaucaacgcccaugaaggacaacucgucauagcaagacaaaaaguccgagacgcagaaaaacaauacgaaaaagaccccgacgaacucaacaaaagaacccuuacagaucgcgagggcgucgccgucuccauacaagccaaaauagacgaacucaaacgccaacuugccgacaggaucgccaccggcaaaaaccucggaaaagagcaagacccaacaggcguagaaccaggagaccaccugaaagaacguucgaugcugagcuacggcaacguccucgaccuaaaccaccucgacaucgacgaacccacaggacaaacagccgacuggcuaagcauagucguauaccuaacauccuucgucgucccgacccugcuuaaagcccucuacaugcucacgacccgggggagacaaacaaccaaagacaacaaaggaaccagaauacgauucaaagacgacagcucuuucgaagacguaaacgggaucagaaaaccaaaacaccucuacgucucccuccccaacgcacaaucaagcaugaaagcugaagagaucacgcccggacgcuaccgaaccgcagucugcggccucuaccccgcccaaaucaaggccagacaaaugaucagcccagucaugagcguaaucggauuccuagcacuagccaaagacuggagcgaccgaaucgaacaauggcuaagcgaacccugcaaacuacucccagacacaacagccgucucccuccugggaggacccgcaaccaaccgcgacuaccuacgccaacgacaggucgcacuaggcaacauggaaacaaaagaaucaaaagccaucagacaacacgccgaagccgcagguugcucaaugauagaagacaucgaaucccccagcuccaucuggguauucgccggggccccugaccgaugcccgccaaccugccuauucauagccggcaucgccgaacuaggagccuucuuuagcauacuccaagacaugcgcaacacaauaauggcaagcaaaacagucggcacaagcgaagaaaaacuucgaaagaaaagcagcuucuaccaauccuaccuacgccgaacacagagcaugggcauacagcuagaccagcgaauaaucguacucuucaugguggcauggggcaaagaagcuguagacaacuuccaccucggcgacgacauggaccccgaacuccgcacgcuagcacaaucccucauagacguaaaagucaaagaaaucucaaaccaagaaccccucaagcucuaa

SEQ ID NO: 7781 - RNA, 1290 nt, Artificial Sequence
  derived and/or modified CDS sequence (opt11) from HTNV(CGAa1011)__EF990913.1__N
auggccaccauggaagaacuccaacgugaaaucaacgcacacgaaggacaacucgucaucgcccgacaaaaagucagagacgccgaaaaacaguacgaaaaagaccccgacgaacucaauaaacgcacccucacagaccgagagggcguagccgccagcauacaagccaaaauagacgaacucaaacgacaacucgcagaccgaaucgccacagguaaaaaccucggaaaagaacaagacccaaccggcguggaacccggcgaccaccucaaagaacgcuccaugcucuccuacggaaacguacuagacuugaaccaccucgacauagacgaacccaccggacaaaccgccgacuggcucuccauagucauauaccucaccuccuucguaguacccauccuacucaaagcccucuacaugcucaccacccgcggccgccaaaccaccaaagacaacaaaggaacaagaauccgauucaaagacgacucguccuucgaagacgucaacggcauaagaaaacccaaacaccucgauguaucccucccaaacgcccaaucauccaugaaagcagaagaaaucacaccaggccgauacagaaccgccaucugcggccucuacccagcacaaauaaaagcacgacagaugauaucuccagucauguccgucaucggcuuccucgcacucgcuaaagacuggucagaccgcaucgaacaguggcucggcgaaccaugcaaacuccucccugacaccgccgccgucucacuccucggcggccccgcaaccaaccgcgacuaccuccgacaacgacagguagcccucggcaacauggaaacaaaggaaucaaaagccauccgccaacacgccgaaaccgcaggcugcaguaugaucgaagacauagaaagccccuccuccauaugggucuucgccggggccccagaccgaugcccacccacaugccucuucaucgccggcaucgccgaacuaggcgccuucuucuccguacuacaggacaugcgaaacaccaucauggcaucaaaaacaguaggcaccuccgaagaaaaacuacgaaagaaauccagcuucuaccaauccuaccucggccgaacccaguccaugggaauacaacuggaccaacgcaucaucguccucuucaugguggccuggggcaaagaagcagucgacaacuuccaccugggagacgacgucgaccccgaacugagaacccucgcacaaucacucauagacgucaaaguaaaagaaauauccgaccaagaaccccuaaaacuguaa

SEQ ID NO: 7782 - RNA, 1290 nt, Artificial Sequence
  derived and/or modified CDS sequence (opt11) from HTNV(CGAa1015)__EF990912.1__N
auggccaccauggaagaacuccaacgcgaaauaaacgcacacgaaggacaacuggucaucgcgcgccaaaaaguucgagacgcagaaaaacaauacgaaaaggaccccgacgaacucaacaaaagaacccuaacagacagagaaggaguagcagcaagcauccaagccaaaaucgacgaacucaaaagacaacucgccgaccgcaucgccaccggcaaaaaccucggcaaagaacaagaccccacaggaguagaacccggcgaccaccugaaagaacgcagcaugcucagcuacggcaacguucucgaccugaaccaccucgacauagacgaacccaccggacaaaccgcagacuggcuuucaaucgucaucuaccugaccagcuucguaguccccauccuccuaaaggcccucuacaugcucacaacaagaggccgccaaaccaccaaagacaacaaagguacacgaauccgcuucaaagacgacuccagcuucgaagacguaaacggcauucgaaaacccaaacaccucgacguaucccuacccaacgcacaaagcuccaugaaggccgaagaaaucacccccggccgcuaccggacugcaaucugcggccucuaccccgcccaaaucaaagcccgccaaaugaucucccccgucaugucagucaucggcuaccuagcccucgccaaagacugguccgaccgcaucgagcaauggcuaggcgaacccugcaaacuccuaccagauacagccgcagucagccuccucgguggaccagccacaaacagagacuaccuacgccaacgacaagucgcccugggcaacauggaaaccaaagaaagcaaagccauaagacaacacgccgaaacagcuggaugcucaaugaucgaggacaucgaaucccccuccuccaucugggucuucgccggcgcccccgaccgaugcccaccaaccugccucuucaucgccggcaucgccgaacucggcgccuucaucucaguacuacaagacaugcgcaacaccauaauggccucaaaaacaguaggcaccagcgaagaaaaacuccgcaagaaaagcagcuucuaccaauccuaccuaggacgaacccaauccaugggcauacaacuagaccaaagaaucaucguccucuucaugguagccuggggcaaagaagccgucgacaacuuccaccuaggcgacgacguagaccccgaacuccgcacccucgcacagagccucaucgacgucaaagucaaagaaauaucagaccaagaaccccuaaaacucuaa

SEQ ID NO: 7783 - RNA, 1290 nt, Artificial Sequence
  derived and/or modified CDS sequence (opt11) from HTNV(CGAa2)__EU092219.1__N
auggcaaccauggaagaacuucaaagagaaaucaacgcgcacgaaggacaacuggucaucgcaaggcaaaaagucagagacgccgaaaaacaauacgaaaaagaccccgacgaacuaaacaaacgaacacucaccgaccgcgaaggcgucgccgcaagcauccaagccaaaaucgacgaacucaaacgccaacuagccgaccgcauagcaacuggcaaaaaccuaggcaaagaacaagaucccaccggcguagaacccggcgaccaccucaaagaacgcuccaugcucagcuacggaaacguacuagaccuaaaccaccucgacaucgacgaaccaaccggccaaaccgcagacuggcucuccauagucaucuaccuaaccuccuucgugguacccauccuccucaaggcccucuacaugcucacaacacgaggacgccaaacaaccaaagacaacaaagggacccgcauccgauucaaagaugacuccuccuucgaagacgucaacggcauccggaaacccaaacaccucuacguaucccuaccuaacgcccaaucaagcaugaaagcaaaagaaaucaccccagggcgcuaccgcacagcaaucugcggccuauaccccgcccaaaucaaagcccgccaaaugaucagcccagucaugagcguaaucgguuuccuagcccuugccaaagacuggagcgaccgcauugaacaauggcucagcgaacccugcaaacuacuaccagacaccgccgcaguaucacuccacggcggccccgcaaccaaccgggacuaccucagacaacgccaagucgcacucggaaacauggaaccgaaagaauccaaagccauccgccagcacgcagaaucagccggaugcuccauggucgaagacaucgaaagccccuccagcauaugggucuucgccggcgccccagacagaugcccaccaaccugccuauucauagccgggauagcagaacucggagcguucuucagcauacuccaagacaugagaaacaccaucauggccuccaaaacaguaggcaccagcgaagaaaaacucagaaagaaaagcucauucuaccaauccuaccuacgccggacccagagcaugggcauccaacuagaccaaagaauaaucguccuuuucauggucgccuggggaaaagaagccgucgacaacuuccaccugggcgacgacauggaccccgaacuccgcacccucgcccaaagccucauagacgucaaggucaaagaaaucuccaaccaagaaccccucaaacucuga

SEQ ID NO: 7784 - RNA, 1290 nt, Artificial Sequence
  derived and/or modified CDS sequence (opt11) from HTNV(CGAa31MP7)__EF990911.1__N
auggcaaccauggaggaacuacaacgcgaaauaaacgcccacgaagggcaacucgucauagcccgccaaaaagucagagacgccgaaaaacaauacgaaaaagacccagacgaacuaaacaaacgaacauuaaccgacagagaaggcgucgccgccagcauacaagccaaaaucgacgagcucaaacgccagcucgcagacagaaucgccaccggcaaaaaccuuggaaaagaacaagaccccacgggaguggaaccgggagaccaccuaaaagagcguucgaugcucucauacggaaacguacucgaccuaaaccaccucgacauagacgaacccacaggacaaaccgcagacugguuaagcauagucauauaccuaacauccuucguagucccaauccugcuaaaagcccuuuacaugcucacgacacgcggcagacaaacgaccaaagacaacaaaggcaccagaauaagauucaaagacgacagcagcuucgaagacguaaacggaauccgaaaaccgaaacaccucuacguaagccuccccaaugcccaauccuccaugaaagcggaagaaaucacacccggacgauaccgaacggccauaugcggacuauaccccgcacaaauaaaagcccgucagaugauaagcccagucauguccgucaucggauuccuagcacuggcuaaagacuggagcgaccgcauagaacaauggcucagcgagcccugcaaacuacuccccgacaccgcagcagucagccuccacggcggaccagcaaccaaccgcgacuaccuacgccaacgccaaguagcgcucggaaacauggaaaccaaggaaagcaaagccauccgccaacacgcagaauccgcaggcugcucgaugguggaagacaucgaaagcccaagcucaaucugggucuucgccggagcccccgaccgaugcccacccacaugccucuucaucgccggaauagcggaacucggcgcauucuucagcauacuacaagacaugcgcaacacaauaauggcaagcaaaaccgucggcaccagcgaagaaaaacuacgaaagaaauccuccuuuuaccaauccuaccuacgcaggacccaaagcaugggcauacaacuggaccagcgcaucaucgugcuauucaugguagccuggggaaaagaagccgucgacaacuuccaccucggcgaugacauggaccccgaacuacgaacacucgcacaaucgcucaucgacgucaaaguaaaagaaauaucaaaccaggaaccacuaaaacucuaa

SEQ ID NO: 7785 - RNA, 1290 nt, Artificial Sequence
  derived and/or modified CDS sequence (opt11) from HTNV(CGAa31P9)__EF990910.1__N
auggcgaccauggaagaacuacaaagagaaauaaacgcccacgaaggccagcuaguaauagcccggcaaaaaguacgcgacgcagaaaaacaauacgaaaaagacccggacgaacucaacaaaaggacccuaaccgaccgagagggcguagccgcaagcauacaagcuaaaauagacgagcucaaacgccaacucgccgacagaaucgcaacagggaaaaaccuaggaaaagaacaagaucccaccggaguagaaccaggcgaccaucucaaggagcgauccaugcugagcuacggcaacguccuagaccuaaaccaucuagacaucgacgaaccgacaggacaaacagccgacuggcucagcauagucauauaccucacaucguucguagucccgauccuacugaaagcccuauacaugcucacaaccagaggcaggcaaacgaccaaagacaacaaagggacaaggauaagauucaaggacgacagcucauucgaagacgugaacggaauaaggaaaccgaaacaucucuacguuucucugccgaacgcacaaucgagcaugaaagcagaagagaucacacccggacgcuaccgcacggcaauaugcggacuauaccccgcccaaaucaaagcacgccaaaugaucagcccagucaugagcguaauaggauuccuagcacuagccaaagacuggagcgaccgcaucgaacaaugguugagcgaacccugcaaacuacuccccgacacagccgcaguuucgcuacacggcgggcccgcaaccaaccgcgacuaccuacgccaacgccaagucgcacucggaaacauggaaaccaaggagagcaaagccauccgacagcacgccgagucggccgggugcuccaugguggaagacaucgaaaguccauccucaaucuggguauucgccggcgccccagacaggugcccgccaaccugccuauucauagccgaaaucgcagaacuaggcgcauucuucagcauacuacaagacaugcgaaacacaauaauggcaagcaaaaccgucggcacaagcgaagaaaaacuccgcaaaaagagcucguucuaccaaucguaccuccgaaggacccaaagcaugggcauccaacuagaccaacgaauaaucgugcuauucauggucgccuggggaaaagaagcgguagacaacuuccaccugggcgaugacauggaccccgaacuacgcacgcuagcccaaucacucauagacguaaaagugaaagaaauaucaaaccaagaaccacucaaacucuaa

SEQ ID NO: 7786 - RNA, 1290 nt, Artificial Sequence
  derived and/or modified CDS sequence (opt11) from HTNV(CGAa4MP9)__EF990915.1__N
auggccaccauggaggaacuccaacgagaaauaaacgcccacgaaggacagcuagucaucgcacgccaaaaagucagagacgcggaaaaacaauacgaaaaagacccagacgaacuuaacaaacgaacacucacagaccgcgaaggcgucgccgccuccauacaagccaaaaucgacgaacucaagcgccaacuagcagaccgcaucgccaccggcaaaaaccuaggcaaagaacaagacccaacgggagucgaacccggcgaccaccucaaagaacgaagcaugcucuccuacggcaacguccucgaucucaaccaccucgacaucgacgaaccaaccggccaaaccgccgacugguuaagcauugucaucuaccuaaccagcuucgucguacccauacuccuaaaagcccuauacaugcucacaacaaggggacgacaaaccacaaaagacaacaaaggaacacgaauccgcuucaaagacgacucaucauucgaagacguaaacggaaucagaaaaccaaagcaccuauacgucucacuacccaacgcccaaucaagcaugaaagccgaagaaauaacacccggccgauaucgcaccgccaucugcgggcucuacccagcccaaauaaaagcccgccaaaugaucucccccguaaugagcguaauaggcuuccuggcccucgcaaaggacuggagcgaccgcaucgaacaauggcucggcgaaccaugcaaacuacucccagacacagcagcaguaucccuccuaggcggccccgcaaccaaccgcgacuaccuccgccaacgccaaguagcccucggcaacauggaaaccaaagaauccaaagccauacgccaacaugccgaaacggccggaugcuccaugaucgaagacauagagagccccuccagcaucugggucuucgccggugcccccgaccgcugcccacccacaugccuuuucauagcaggcaucgcagaacucggagccuucuucagcguucuccaagacaugcgcaacaccaucauggcaagcaaaaccgucggcacaagcgaagaaaaacuucgcaagaaauccucauucuaccaaagcuaccuccgccggacccaaucaaugggcauccaacuagaccaacgcaucaucguccuauucauggucgcauggggcaaggaagccgucgacaacuuccaccugggcgacgacauggaccccgaacugcgcacacucgcacaaucacucaucgacgucaaaguaaaagagaucucaaaccaagaaccacucaaacuuuaa

SEQ ID NO: 7787 - RNA, 1290 nt, Artificial Sequence
  derived and/or modified CDS sequence (opt11) from HTNV(CGAa75)__EU092220.1__N
auggccacaauggaagaacuccaacgugaaaucaacgcacacgaaggacaacucgucauagcccgccaaaaaguacgcgacgcagaaaaacaauacgaaaaagaccccgacgagcucaauaaacggacccucacagaccgcgagggagucgcagcaagcauucaagccaaaauagacgaacucaaacgucaacucgccgaccggaucgccaccggaaaaaaccucggcaaagaacaagaccccacaggcgucgaacccggcgaccaccucaaagaacgcuccaugcucagcuacggcaacguacuagaccucaaccaccucgacaucgaugaacccaccggccaaaccgccgacuggcucuccauaguaaucuaccuaaccuccagcguggucccgauccuccuaaaagcccuguacaugcuaacaacccggggccgccaaaccaccaaagacaacaaaggaaccagaauccgcuucaaagaugacuccuccuucgaggacguaaacggcauccgcaaacccaaacaccucuacgucucacucccaaacgcccaauccuccaugaaagccgaagagaucacaccuggccguuaccgaacagccaucugcggccucuaccccgcacaaauaaaagcgcgccaaaugauaucccccguaaugaaugucaucggauucuuagcccucgccaaagacuggagcgaccgaaucgaacaguggcucucugagccaugcaaacuacuccccgacaccgcagcaguaucacuacacggcggacccgccaccaaccgcgacuaccuccgccaacgacaagucgcccuaggcaacauggaaacuaaagaauccaaagcaauacgccaacacgcagaaagcgccggcugcucaauggucgaagacaucgaaagccccagcuccaucugggucuucgccggagcccccgaccgcugcccccccacaugccucuucauagcaggaaucgcggaacuaggagcguucuucuccauccuccaagacaugcgcaacaccaucauggccagcaaaaccgucggcacauccgaagaaaaacuacgcaaaaaauccuccuucuaccaauccuaccuccgccgcacacaaagcaugggcauccaacucgaccaacgcauaaucguacucuucauggucgccuggggcaaagaagcagucgacaacuuccaccucggcgacgacauggaccccgaacuccgcacgcuagcacagucacuaaucgacguaaaaguuaaagagaucuccaaccaagaaccccucaaacucuaa

SEQ ID NO: 7788 - RNA, 1290 nt, Artificial Sequence
  derived and/or modified CDS sequence (opt11) from HTNV(CGHu1)__EU092218.1__N
auggccaccauggaggaacuccagagagaaauaaacgcccacgaaggccaacucgucaucgcccgccaaaaaguacgcgacgccgaaaaacaauacgaaaaagacagcgacgaacuaaacaaacgaacacucacagaccgagaaggcguagccgucuccauacaagccaaaauagacgaacucaaacgccaacucgccgaccgcaucgccacaggcaaaaaccuaggaaaagagcaagaccccacaggcguagaacccggagaccaccucaaagaacgcuccaugcucuccuacggaaacguccuggaccugaaucaccucgacaucgacgaaccaacaggccaaaccgccgacuggcucagcauagucguauaccuaaccagccuagucgucccgauccuacuaaaggcacuauauaugcucaccaccaaaggccgccaaacuaccaaagacaacaaaggaacccgcauaagauucaaagacgacucauccuucgaagacguaaacggaaucaggaaacccaaacaucucuacguaucccuacugaacgcacaauccuccaugaaagcggaagaaaucacccccggccgcuaccgaaccgcaaucugcggaccauaccccgcccaaauaaaagcacggcaaaugauaucccccgucauguccgucaucggauuccuagcacuagcaaaagacugguccgaccgcauagaacaauggcuaucagaacccugcaaauuacuccccgacacagccgcagucucccugcuaggcggaccagccaccaaccgcgacuaccuccgacaacgacaaguagcacuaggcaacauggaaacaaaagaaagcaaagcaauccgacaacacgccgaagcggcaggcugcuccaugaucgaagacaucgaaucacccucauccaucugggucucagccggagcccccgaccgcugcccacccacaugccuguucaucgccggcauagcagaacucggagccuucuucagcauccuacaagacaugcgcaacaccaucauggcaucuaaaaccgucggaaccagcgaagaaaaacuccggaagaaaagcucauucuaccaaucauaccuccgacgaacacaaagcaugggcauacaacuggaccaacgcaucaucguacuauucauggucgccuggggaaaagaagccgucgacaacuuccaccugggcgacgacauggacccagaacuucgaacccucgcacaaucccucauugacguuaaagugaaagaaaucucaaaccaggagccccuaaaacucuaa

SEQ ID NO: 7789 - RNA, 1290 nt, Artificial Sequence
  derived and/or modified CDS sequence (opt11) from HTNV(CGHu2)__EU363813.1__N
auggcaaccauggaagaacuacaacgagaaaucaacgcccacgaaggccaacucgucaucgcaagacaaaaagucagagacgcagaaaaacaauacgaaaaagacccagacgaacucaacaaacgaacacucaccgaccgcgagggcgucgccgcguccauacaagccaaaauagacgaacuaaaacgccaacucgccgaccgaaucgccacaggcaaaaaccuaggcaaagaacaagacccaacaggcguagaaccaggagaccaccucaaagagcgaucaaugcucagcuacgggaacguccuagaccuaaaccaccucgacauagacgaaccaacaggccaaacagcagacuggcuauccauugucauauaccucaccucccuagucgucccaauccuacucaaagcacuauacaugcucacaacaagaggaagacagacaacaaaagacaacaaaggcacccggauccgauucaaagacgacagcuccuucgaagacgucaacggcauacgcaaaccgaaacaccuauacgucucccuccccaacgcacaauccagcaugaaagcggaagaaaucacccccggccgcuaccgcacagcaaucugcggacuauacccagcccaaaucaaagcacgccaaaugaucagcccgguaaugagcguaaucggcuuccuugcccuagccaaagacuggagcgaccgaauagaacaauggcucagcgaacccugcaaacuacuacccgacacagcagcaguaucacuccacggagggccagccaccaaccgagacuaccuccgucaaagacagguagcccucgggaacauggaaaccaaagaaagcaaagcaauccgccaacacgccgagucagccgggugcuccauggucgaagacaucgaaagccccagcucaaucugggucuucgcaggagccccagacagaugcccccccaccugccuauuuaucgccggcaucgcagaacuuggagcguucuucagcaucagccaagacaugcgcaacaccauaauggcaagcaaaaccgucggcacaagcgaagaaaaacuccggaaaaaaagcuccuuuuaccaauccuaccuccgacgaacccaauccaugggaauacagcucgaccagcgcaucaucguccucuucaugguggccuggggcaaagaagcagucgacaacuuccaccucggcgaugacauggacccagaacuccgcacccucgcucagagccucaucgacgucaaagugaaagaaaucuccaaucaagaaccccuaaaacuauag

SEQ ID NO: 7790 - RNA, 1290 nt, Artificial Sequence
  derived and/or modified CDS sequence (opt11) from HTNV(CGHu3612)__EF990909.1__N
auggccacuauggaggaacuccaacgcgaaauaaacgcccacgagggacaacucgucaucgcccgccaaaaaguccgcgacgccgaaaaacaauacgaaaaagaccccgacgaacuuaacaaacgcgcccucaccgaccgcgaaggacuagcagcaucaauccaagccaaaaucgacgaacucaaacgccaacucgccgaccgggucgcaacuggcaaaaaccucggcaaagaacaagacccaacaggcgucgaaccgggcgaccaccucaaagagcgcuccaugcucucauacgguaacguccucgaccuaaaccaccucgacaucgacgaacccaccggccaaaccgccgacuggcuaucuaucguaaucuaccuaacuucuuucgucguccccauccuccucaaagcccuauacaugcucaccacgcgcggucgacaaacgaccaaagacaacaaaggcacccgcaucagauucaaagacgacuccucauuugaagacgucaacggcauccgaaaacccaaacaccuauacgucucacugcccaacgcccaaucguccaugaaagcagaagaaauaacacccggccgauaccgcaccgccaucugcggccucuacccugcccaaauaaaagccagacaaaugauaucacccguaauguccguaauaggcuuccucgcccucgccaaagacugguccgacagaauagaacaauggcucucagaacccugcaagcuccucccggacaccgcagccgucagccuacacggaggcccagccacaaaccgcgacuaccuccgccaacgccaagucgcccucggaaacauggaaacaaaagaguccaaagccaucagacaacacgcagaauccgccggcugcagcauggucgaggacaucgaaucacccucauccaucugggucuuugccggcgcccccgaccgcugcccacccacaugccucuucaucgcaggaaucgccgaacuaggagcguucuucuccauccuccaagacaugcgaaacaccaucauggccagcaaaaccguuggcaccuccgaagaaaaacuccgcaagaaauccagcuucuaccaaaguuaccuccgccguacccaauccaugggaauccaacuagaccaaagaaucaucguacucuucaugguagcauggggaaaagaagcagucgacaacuuccaccucggcgacgacauggaccccgaacucagaacacucgcccaaucccucauagaugucaaaguacgcgaaauauccaaccaagaaccccucaaacuuuaa

SEQ ID NO: 7791 - RNA, 1290 nt, Artificial Sequence
  derived and/or modified CDS sequence (opt11) from HTNV(CGRn15)__EU363810.1__N
auggccacaauggaagaacuccagcgcgaaaucaacgcccacgaaggccaacuggucauagcacggcaaaaagucagggacgccgaaaaacaauacgaaaaagaccccgacgaacuaaacaaacgcacccuaaccgacagagaaggcguagccgccagcauccaagcuaaaaucgaugaacucaaacgacaacuagccgaccgcaucgcaacaggcaaaaaccuaggaaaagaacaagaccccaccggagucgaaccaggagaccaccuaaaagagcgcagcaugcuuagcuacggcaacguccucgaccuaaaccaccucgacauagacgaacccaccggacaaacggccgacuggcuaagcaucguaaucuaccuaacaucauucguaguccccauccuccucaaagcccuauacaugcuaacgacccgaggcagacaaaccaccaaagacaacaagggcaccagaauccgauucaaagacgacagcuccuucgaggacgugaacggcaucagaaaaccaaaacaccucuacguaacacucccaaacgcgcaauccuccaugaaagccgaagaaaucacacccggacgauaccgcaccgccaucugcggccuauaccccgcacaaaucaaagcacgccaaaugaucagccccguaaugagcgucaucggcuuccucgcccucgcaaaagacuggucagaccgcaucgaacaauggcucuccgagcccugcaaacuacucccagacaccgccgcagucucacuccacggcggccccgccaccaaccgagacuaccuccgacaacgacaagucgcccuaggcaacauggaaacaaaagagagcaaagccauccgccaacacgccgaaucagccggcugcuccaugguagaagacaucgaauccccauccucaaucuggguauucgcaggcgccccggaucgaugcccaccaaccugccuauucauagcgggaauagcagaacucggagccuucuucagcauccuccaagacaugcgcaacaccaucauggcaucaaaaaccgucggcacaagcgaagaaaaacuccgaaagaaaagcuccuucuaccaaagcuaccuccgcagaacacaaagcaugggcauacaacuggaccagcgcaucaucguacucuucauggucgcauggggaaaagaagccgucgacaacuuucaccuaggcgacgacauggaccccgaacuccgcacccuagcccaaucgcuaaucgacgucaaagucaaagaaaucucgaaccaagaaccgcucaaacucuaa

SEQ ID NO: 7792 - RNA, 1290 nt, Artificial Sequence
  derived and/or modified CDS sequence (opt11) from HTNV(CGRn2616)__EU363811.1__N
auggccaccauggaagaacuacaacgcgaaaucaacgcccacgaaggacaacuugucaucgcccgacaaaagguccgcgacgcaggaaaacaauacgaaaaagacccggacgaacuaaacaaacgcacccucacagaccgagaaggcgucgccgcauccauccaggccaaaaucgacgaacugaaaagacaacucgccgaccgaauagccaccggcaaaaaccucggcaaagaacaagaccccacaggagucgaaccaggagaccaccuaaaagaacggagcaugcuaaguuacggcaacguccucgaccugaaccaccuagacaucgacgaaccaacaggccaaaccgccgacuggcuaagcaucgucaucuaccugaccagcuuuguaguccccauccuacuaaaagcacuauacaugcugacaacacggggccgccaaacaaccaaagacaacaaagggacccgcaucagauucaaagacgacagcuccuucgaggacgugaacggcauccgcaaaccaaaacaccucuacgucucccucccaaacgcacaaucaagcaugaaagccgaagaaaucacaccaggccgcuaccgcacagccaucugcggacucuaccccgcccaaauaaaagcccgccaaaugaucagccccgucaugagugucaucggauuccucgcccuagcaaaggacuggagcgaccguauagaacaauggcuauccgaacccugcaaacugcucccggacaccgccgcaguaucccuccacggcggccccgcgaccaaucgugacuaccuccgacaacgccaagucgcccuaggaaacauggaaaccaaagaaagcaaagccauccgccaacacgcagaauccgccggcugcagcauggucgaagacaucggcuccccaaguuccaucugggucuucgccggcgcacccgaccgcugcccacccacgugccucuucaucgccggaaucgccgaacugggcgccuucuucagcauacuccaagacaugcgcaacaccaucauggcaagcaaaaccguaggcaccagcgaagaaaaacuccgcaaaaaguccuccuucuaccaauccuaccuccgacgcacccaaagcaugggcauacaacuagaccaacguauaaucguacucuucaugguugccuggggaaaagaagccgucgacaacuuccaccuaggcgacgacauggaccccgaacuccgcacacuagcacaaucccucauagacguggaagugaaagaaaucagcaaccaggaaccccugaagcucuaa

SEQ ID NO: 7793 - RNA, 1290 nt, Artificial Sequence
  derived and/or modified CDS sequence (opt11) from HTNV(CGRn53)__EF990907.1__N
auggcaaccauggaagaacuacaacgcgaaaucaacgcacacgaaggacaacucgucauagcccgccaaaaaguccgagacgcagaaaaacaauacgaaaaagauccagacgaacuaaacaaaagagcacuaacagaccgcgaagguguagcagcauccauacaagcaaaaaucgacgaacucaagcgccaacuagccgaccgcaucgcaacaggcaaaaaccucggcaaagaacaagacccaaccggcgucgaaccaggugaccaccuuaaagaacgcuccaugcucagcuacggcaacguacucgaccuaaaucaccucgacaucgacgaaccaaccggucaaacagccgacuggcucagcaucguaaucuaccugaccucauucgucgucccaauacuccuaaaagcccucuacaugcuaacaacccgcggcagacaaacaaccaaagacaacaaaggcacgcgcauccgcuucaaagacgacuccuccuucgaagacgucaacggaauccgaaaaccaaaacaccucuacgucagccuccccaacgcacaaucaaguaugaaagccgaagaaauaacucccggacgguaccgaacagccauuugcggacucuaccccgcccaaaucaaagcccgccaaaugaucuccccagucauguccgugaucggcuuccucgcccucgcaaaagacuggagcgaccgcaucgaacaauggcugagcgaacccugcaaacuccucccagacacagccgcggucucgcuccacggcggcccugccaccaaccgcgacuaccuccgccaacgacaagucgcccucggaaacauggaaacaaaagaauccaaagccauccgccaacacgcugaagcagccgguugcucaaugaucgaagacaucgaaagcccauccuccauaugggucuucgcaggagcaccagaccgcugcccgcccacaugccuuuucaucgcaggcauagccgaacucggagccuucuucagcauccuacaagacaugagaaacaccaucauggcauccaaaaccgugggcacauccgaagaaaaacuccgcaagaaaagcucauucuaccaauccuaccuccgccgcacucaaucaaugggcauccaacuagaccaacgcaucaucguccuauucauggucgccuggggcaaagaggcuguagacaacuuccaccugggcgacgacauggaccccgaacuacgcacccucgcccaaagccucaucgacguaaaaguuaaagaaauauccaaccaagaaccccucaaacucuaa

SEQ ID NO: 7794 - RNA, 1290 nt, Artificial Sequence
  derived and/or modified CDS sequence (opt11) from HTNV(CGRn5310)__EF990906.1__N
auggccaccauggaagaacuccaaagagaaauaaacgcccacgaaggccaacucguaaucgcccgccaaaaagugcgcgacgcagaaaagcaauacgaaaaagacccagacgaaccaaacaaacgcgcccuaacagaccgcgaaggcguagccgccuccauccaagccaaaauagacgaacucaaacgccaacucgccgaccgcaucgcaaccggcaaaaaccugggaaaagagcaagaccccaccggcguagaacccggcgaccaccucaaagaacgaagcaugcuauccuacggcaacguccucgaccucaaccaccucgacauagacgaacccacaggccaaacugccgacuggcucagcaucguaaucuaccucacgucauucguaguccccauccuccuaaaagcccuguacaugcucacuaccagaggacgacaaaccaccaaagacaacaaaggcaccagaauccgcuucaaagacgacucaucauucgaagacgucaacggcauacgcaaacccaaacaccucuacguaucccuaccaaacgcccaauccagcaugaaagcagaagaaaucacccccggacgcuaccgcaccgccaucugcggccucuaccccgcccaaaucaaagcacgccaaaugaucucaccagucaugucagucauaggauuccucgcccuagccaaagacuggagcgaccgaauagaacaauggcucucugaaccaugcaaacuccucccugacacugcagcaguaucccuccacggcggcccagccaccaaccgggacuaccucagacaacgacaaguagcacuaggaaacauggaaacaaaggaauccaaagcaauacgccaacacgcugaggccgccggaugcuccaugauagaagacauagaguccccuucaagcauaugggucuucgccggggcacccgaccgcugcccaccuaccugccuuuucauagcaggcauagcagaacucggagccuucuucucgauccuacaagauaugagaaacacaaucauggccucaaaaaccguaggcaccagcgaagaaaaacuccguaagaaaagcuccuucuaccaauccuaccuccgacggacccaaucaaugggaauccaauuagaccaacgaaucaucguacucuucauggucgccuggggcaaagaagcagucgacaacuuccaccucggcgacgacauggaccccgaacuccgcacccuggcccaaagccugaucgacgugaaagucaaggaaaucagcaaccaagaaccccucaaacuauaa

SEQ ID NO: 7795 - RNA, 1290 nt, Artificial Sequence
  derived and/or modified CDS sequence (opt11) from HTNV(CGRn93MP8)__EF990905.1__N
auggccacaauggaagaacuccaacgcgaaaucaacgcgcacgaaggccaacucgucauagcccgacaaaaaguccgggacgccgaaaaacaauacgaaaaagaccccgacgaacuaaacaaacgugcccucaccgaccgcgagggcguagccgccccaauccaggccaaaaucgacgaacucaaacgccaacucgccgaccggaucgccaccggcaagaaccuaggcaaagaacaagacccaaccggcgucgaacccggcgaccaccucaaagagcguagcaugcuaagcuacggaaacguccucgaccucaaccaccuagauaucgacgaacccaccggacaaaccgccgacuggcucucaauagucaucuaucuaaccucauucguuguccccauccuacucaaagcccucuacaugcuaaccacacgcggccgccaaaccacaaaagacaacaaaggcucucgcauccgcuucaaagacgacucaucauucgaagacguaaacggaauccgcaaacccaaacaccucuacguaucacuacccaacgcacaauccuccaugaaagcagaagagaucaccccaggacgauaccgcaccgcaauaugcggccucuaccccgcccagauaaaagcacgacaaaugaucagccccgucauguccgucaucggcuuccucgcccuugccaaagacuggucagaccgcauagaacaaugguuauccgaacccugcaaacuucucccggacacagccgccguaucccuccacggcggccccgccaccaaccgcgacuaccuccgccaacgccaaguagcccuuggcaacauggaaacaaaagaauccaaagcaauccgccaacacgccgaagccgcaggcugcuccaugaucgaagacaucgaaagccccagcucaauaugggucuucgccggagcccccgacagaugcccaccuaccugccuauucaucgccggcaucgccgaacuaggagcauucuucuccauacuccaagauaugcgaaacaccaucauggcaagcaaaaccgucgguaccuccgaagaaaaacuccgcaagaaguccuccuucuaccaaucauaccuacgcagaacccaaucaaugggcauucaacucgaccaacgcauuauaguacuauucauggucgccuggggcaaagaagcagucgacaacuuccaccucggcgacgacauggaccccgaacuccgcacccucgcacaaagccugaucgacguaaaaguaaaagaaauaucaaaccaagaaccccuaaaacucuaa

SEQ ID NO: 7796 - RNA, 1290 nt, Artificial Sequence
  derived and/or modified CDS sequence (opt11) from HTNV(CGRn93P8)__EF990904.1__N
auggccaccauggaagaacuccaacgcgaaaucaacgcccacgaaggccagcuagucaucgcccgacaaaaaguccgcgacgccgaaaaacaauacgaaaaagaccccgaugagcuaaacaaacgcgcacugaccgaccgagaaggaguagccgcauccauccaagcaaaaaucgacgaacucaagagacaacuagccgaccgcaucgccaccggcaaaaaccucggcaaagaacaagaucccaccggaguggaaccgggagaccaccuaaaagaacgcagcaugcucuccuacggaaacguccuggaccuaaaccaucucgacauagacgagccaaccggacaaacagcagacuggcucuccaucgucaucuaccuaaccucauucgucgucccuauccugcuaaaagcauuauacaugcuaacaacccgcggucgccaaacaaccaaagacaacaaaggaacccgcauccgauucaaagacgacucauccuucgaagacguaaacggcauccgcaaacccaaacaccucuacgucagucuccccaacgcccaauccucaaugaaagccgaagaaaucacccccggcagauaccgcaccgccaucugcggacucuaccccgcccaaaucaaagcccgccaaaugauaagccccgucauguccgucauaggcuuccucgcccuugccaaagacugguccgaccgcauagaacaauggcucuccgaacccugcaaacuccucccugacaccgccgccguaagccuacacggcggacccgccaccaaccgcgacuaccuacgacaacgacaaguagcccucggaaacauggaaacuaaagaauccaaagccaucagacaacacgccgaagcagcaggcugcucaaugauagaagacauagaaucacccuccuccaucugggucuucgccggcgcacccgacagaugcccaccaaccugccuuuucauagccggaauagccgaacucggcgccuucaucagcauacuucaagacaugcgaaacaccaucauggcaagcaagacaguuggcaccagcgaagaaaaacuccgcaacaaauccagcuucuaucaaucauaccuaagacgcacccaaagcaugggcauccaacucgaccaacgcaucauaguacuauucaugguugccuggggcaaagaagccgucgacaacuuccaccucggcgacgacauggaccccgaacuccgcacccucgcacaaucccugaucgacgucaaagucaaagaaauauccaaccaagaaccccucaaacucuaa

SEQ ID NO: 7797 - RNA, 1290 nt, Artificial Sequence
  derived and/or modified CDS sequence (opt11) from HTNV(CGRni1)__EU363812.1__N
auggccacaauggaagaacuccaacgcgaaaucaaugcccacgaaggccagcugguaaucgccagacaaaaaguccgagacgcagaaaaacaauacgaaaaagaccccgacgaacucaauaaacgcacccucaccgacagagaaggagucgccgccucaauccaagcaaaaaucgacgaacucaagcgacaacucgccgacagaaucgccaccgggaaaaaccucgggcgagaacaagaccccaccggcgucgaaccaggcgaccaccucaaagaacgauccaugcucuccuacggaaacguccuugaccucaaccaccucgacauagacgaacccacaggccaaaccgccgacuggcuaucaaucguaauauaccucaccucauucgucguccccauacuccuaaaagcccucuacaugcuaacuacccgcggccgacaaacaaccaaagacaacaaaggcacccgaauacgcuucaaagacgacucgucauucgaagacaucaacggcauccgcaaaccaaaacaccuuuacguaucacuacccaacgcccaaucguccaugaaagccgaagaaauaacccccggccgauaccgcaccgccaucugcggacuguaucccgcccaaaucaaagccaggcaaaugaucagccccgucauguccgucaucggcuuccuagcccucgcaaaagacuggucagaccgcaucgagcaauggcuauccgaaccaugcaaacuccucccagacaccgcagccgucucccuccacggcggccccgccacaaaccgcgacuaccuccgacaacgccaaguagcccucggcaacauggaaacaaaagaaagcaaagccauacgacaacacgccgagucagccggcugcuccauggucgaagacaucgaaucccccuccuccauuugggucuucgcaggcgcaccagaccgcugucccccaaccugccuguucaucgccgguaucgcagaacuaggggcguucuucuccauccuccaggacaugcgcaacaccauaauggcaucaaaaaccgucggcaccagcgaagaaaaacuccgcaagaaauccuccuucuaccaauccuaccuccgccgcacccaaagcaugggaauccagcucgaccaacggaucaucguacuccuaauggucgcguggggaaaagaagccgucgacaacuuccaccucggcgacgacauggaccccgaacuccgcacccucgcccaaucacucauagacgucaaagucaaagaaaucuccaaccaagaaccgcuaaaacucuaa

SEQ ID NO: 7798 - RNA, 1290 nt, Artificial Sequence
  derived and/or modified CDS sequence (opt11) from HTNV(CJAp93)__EF208929.1__N
auggccacaauggaagaacuacaacgagaaaucaacgcacacgaaggacaacucgucaucgccagacaaaaaguacgcgacgcagaaaaacaauacgaaaaagaccccgacgaacucaacaaacgcacccucaccgaccgcgaaggcguagcagucuccauccaagccaaaauagacgaacuuaaacgacaacucgcggaccgcaucgcaacaggcaaaaaccuaggaaaagaacaagaccccacaggcgucgaaccaggcgaccaccuaaaagaacgcagcaugcucagcuacggcaacguccucgaccugaaccaccucgacaucgacgaacccacaggacaaaccgccgacuggcuaucaauagugguguaccucaccagcuucgucgucccaauacuacugaaagcccuauacaugcuaaccacacgaggccgccaaaccaccaaagacaauaaaggcacccggauccgauucaaagacgacagcuccuucgaagacguuaauggcauacgcaaacccaaacaucuauacgucucccuccccaacgcccaauccagcaugaaagccgaagaaaucacccccggacgcuaccgcacagccauaugcggccuguacccagcccaaaucaaagcccgacaaaugaucagcccggucaugagcgucaucggcuuccuagcccuggccaaagacuggagcgacagaaucgagcaauggcucucagaacccuguaaacuacuacccgacaccgccgccgucggccuccuaggaggccccgcaacaaaccgcgacuaccuacgccagagacaagucgcccucggaaacauggaaaccaaagaauccaaagccauccgucaacaugccgaagcagccggcugcucuaugaucgaagacaucgaaagcccaagcucaaucugggucuucgccggcgcccccgaccgcugcccucccacaugccucuucaucgccgguaucgccgagcucggagccuuuuucagcauccuacaagacaugcgcaacaccaucauggccagcaaaaccgucggcacauccgaagaaaaacuccgcaagaaaagcucauucuaccaaucguaccuacgccgaacccaauccaugggcauccaacuagaucaacgaaucaucguccucuucauggucgcauggggcaaagaagccgucaacaacuuccaccucggcgacgacauggaccccgaacucagaacacuagcccaaucccucaucgacguaaaagucaaagaaaucucaaaccaagaaccacuaaaacuguaa

SEQ ID NO: 7799 - RNA, 1290 nt, Artificial Sequence
  derived and/or modified CDS sequence (opt11) from HTNV(Aa14_207)__KX687234.1__N
auggccaccauggaagaacuccaacgcgaaaucaacgcacacgaaggacaacucguaaucgcacgccaaaaaguccgagacgccgaaaagcaauacggcaaagacccagacgaacucaacaaacgagcccuaacagaccgcgaaggcgucgcagucucaauacaagccaaaaucgacgaacuaaaacgacagcucgccgaccggaucgcaaccgggaaaaaccucggaaaagaacaagacccaaccggagucgaacccggagaccaccucaaagaacgcagcaugcucuccuacggcaacguacuagaccucaaccaccucgacauagacgaaccgaccggccaaacagccgacuggcuuuccaucgucgucuaccucacauccuucgucgucccgauccuccuaaaagcucuauacaugcuaaccacccgcggccgacagaccaccaaagacaacaaaggcacacgaauacgcuucaaagacgacuccucguucgaagacguaaacgggauccgaaaaccgaaacaucuauacgucucccuacccaacgcccaauccagcaugaaagccgaagaaaucacaccgggccgguaccgcaccgccguaugcggccucuaccccgcacaaaucaaagcccgccaaaugauaucccccgucaugagcguaauaggauuccuggcccucgccaaagacuggagcgaccgcaucgaacaauggcucagcgagccauguaaacuucuaccggacaccgccgccgucucccuacugggcggacccgcaaccaaccgagacuaccuccgccaacgccaagucgcacucggcaacauggaaaccaaagaaagcaaagccauccgccagcacgcagaagcagccgguugcuccaugaucgaagacauagaaagccccuccuccauaugggucuucgccggcgcacccgaccgcugcccaccaaccugccucuucgucgccggcauagccgaacuaggcgcauucuucuccauacuccaagacaugcgaaacaccaucauggccagcaaaaccguaggaaccagcgaagaaaaacuccgaaagaaaagcucauucuaccaaucauaccuccgccgaacccaaagcaugggcauccaacuagaccaacgcauuauaguccucuucaugguagccuggggcaaagaagcagucgacaacuuccaccuaggagacgacauggaccccgaacugcgcacccucgcccaaucacucauagacgucaaagucaaagaaaucuccaaccaagaaccccuaaaacucuga

SEQ ID NO: 7800 - RNA, 1290 nt, Artificial Sequence
  derived and/or modified CDS sequence (opt11) from HTNV(Aa14_234)__KX687235.1__N
auggcaaccauggaagaacuccagcgcgaaaucaacgcacacgaaggacaacucgucaucgcccgccaaaaaguacgcgacgccgaaaaacaauacgaaaaagacccggacgaacuaaacaaaagagcccuaaccgaccgcgaaggcguagccgucagcauacaagcaaaaaucgacgaacucaaaaggcaacuagcagaccgcauagcaaccggcaaaaaccucggaaaagaacaagaucccacaggcgucgaaccuggcgaccaccucaaagaacgcuccaugcucagcuacggcaacguccuagaccugaaccaccuagacaucgacgaaccgacagggcaaacagccgacuggcucagcauaguuguauaccucaccucauucgucguccccauccuccucaaagcccuauacaugcuaacuacucgaggcagacaaacaaccaaagacaacaaaggaacccgcauccgcuucaaagacgacagcucauucgaagacguaaacggaauccggaaacccaaacaucuauacgucucacugccgaacgcacaaucaagcaugaaagccgaagaaaucacacccggccgauaucgcacagccgucugcggccucuaccccgcccaaaucaaagcgagacaaaugauaucccccgucaugagcgucaucggauuccuggcacuagccaaagacuggagcgaccgcauagaacaauggcuaggagaacccugcaagcuccucccagacacggccgcagucagccuccuaggcggccccgccacaaacagagacuaccuacgccaacgacaaguagcccucggaaacauggaaacaaaagaaagcaaagccauacgacaacacgcagaagcagcaggcugcucaaugauagaagacaucgaaagccccagcagcauaugggucuucgcaggcgcccccgaccgaugcccgcccacaugccuuuuuauugccggaauagcagaacuaggcgcguucuucuccauccuacaagacaugcgaaacaccauaauggccagcaaaaccgugggaaccagcgaagaaaaacuacgaaagaaaagcuccuucuaccaaagcuaccugcgccgcacccaaagcaugggcauccaacucgaccagcgcaucauagugcuauucauggucgccuggggcaaagaagcaguagacaacuuccaccucggcgacgacauggacccagaauuacgcacccuagcacaaucccucauagacguaaaagucaaagaaaucuccaaccaagaaccacuaaaacucuaa

SEQ ID NO: 7801 - RNA, 1290 nt, Artificial Sequence
  derived and/or modified CDS sequence (opt11) from HTNV(Aa14_239)__KX687236.1__N
auggccacaauggaagaauuacaacgcgaaaucaacgcacacgagggccaacuugucaucgcccgacaaaaaguacgagacgcagagaaacaagacggcaaagaccccgacgaacucaacaaacgagcccugaccgaccgcgaaggcgucgcaguauccauccaagcaaaaaucgacgaacugaagagacaacucgccgacagaaucgccacaggcaaaaaccuaggcaaagaacaagaccccaccggaguagaacccggagaccaccugaaagaaagauccaugcuaagcuacgguaacguccuagaccuaaaccaccuagacaucgacgaacccacaggccaaaccgccgacuggcucuccaucgucgucuaccuaaccagcuucguaguacccauacuccuaaaggcacuguauaugcucaccacacgaggccgccaaaccaccaaagacaacaaaggcacccgcauucgcuucaaagacgacagcucauucgaagacguaaacggcauacgcaaaccuaaacaccucuacguaucacuaccaaacgcccaaucaucgaugaaagcagaagaaauaaccccaggcagauaccgcacagccgucugcggccuguacccugcccaaaucaaagcacgccaaaugaucagcccaguaauguccgucaucggcuucuuagcccucgcaaaggacugguccgaccgaaucgaacaauggcuuggcgaacccugcaaacuacuccccgacaccgccgccgucucacuccuaggaggccccgccacgaaccgagacuaccuccgccaacgccaagucgcccucggcaacauggaaacaaaggaauccaaagccauccgccaacacgccgaagccgccggcugcucgaugaucgaggacauagaaagcccauccuccaucugggucuucgccggcgccccagaccgcugcccacccacgugccuauucauagcaggcaucgcagagcucggcgccuucuucagcauccuccaagacaugcgaaacaccaucauggccucuaaaaccguuggcaccuccgaagaaaaacuccgcaagaaauccucauucuaccaaagcuacuuacgccgaacacaaagcaugggcauccaacuagaccaacgcaucaucguacuauucaugguagccuggggcaaagaagcugucgacaauuuccaccuaggcgacgacauggaccccgaacugcgcacccuagcccaaucacuaaucgacguaaaagucaaagaaaucagcaaucaagaaccccuaaaacucuag

SEQ ID NO: 7802 - RNA, 1290 nt, Artificial Sequence
  derived and/or modified CDS sequence (opt11) from HTNV(AY133/2011)__KY807166.1__N
auggccaccauggaagaacuccaacgcgaaauaaacgcacacgaagggcaacucgucauagccagacaaaaaguucgcgacgccgaaaaacaauacgaaaaagaccccgacgaacucaacaaacgagcccuaaccgaccgcgagggcguagcagccuccauccaagccaaaauugacgaacucaaacgccaacucgccgaccgaaucgcaaccggcaaaaacaucggaaaagaacaagaccccaccggaguagaaccaggcgaccaccuaaaagaacgauccaugcucagcuacggcaacguccucgaccuaaaccaccucgacauagacgaacccaccgggcaaacugccgacuggcugagcaucgucaucuaccucaccagcuucgucguacccauccuccucaaagcccuguacaugcuaaccacacguggccgccaaaccaccaaagacaacaaaggcacacgaauccgauucaaggacgauagcuccuucgaagacguauccgggauccgcaagccaaaacaccucuaccugucccuaccaaacgcccaaagcagcaugaaagccgaagagaucaccccaggccgauaccgaaccgccaucugcgggcuauaccccgcccaaaucaaagcuagacaaaugaucagcccagucaugagcgucaucggguuccucgcccucgccaaagacuggucagaccgcaucgaacaauggcuauccgaacccugcaaacuccuucccgacaccgccgccguaucccuacacggcggccccgccaccaaucgcgacuaccuccgucaacgacaagucgcacucggcaacauggaaaccaaagaaagcaaggccauacgccaacacgcagaaaccgccggaugcuccaugaucgacgacaucgaaagccccuccuccauaugggucuucgccggcgccccagacagaugcccacccacaugccucuucaucgccggcaucgccgaacugggugccuucuucucaauccuacaagacaugcgcaauaccaucauggcauccaagacggucggcacauccgaagaaaaacuacgaaagaaaagcagcuucuaccaauccuaccuccgacgcacccaaaguaugggcauacaacuagaccaacgcauuaucguacucuucauggucgccuggggaaaagaagcggucgacaacuuucaccugggcgacgacauggaccccgaacugcgaacccucgcccaaucccucaucgacgucaaagucaaagaaaucucaaaccaagaaccccucaaacucuaa

SEQ ID NO: 7803 - RNA, 1290 nt, Artificial Sequence
  derived and/or modified CDS sequence (opt11) from HTNV(GAN13/2011)__KY807168.1__N
auggcuaccauggaagaacuacagcgcgaaaucaacgcccacgaaggccagcuagucaucgcccggcaaaaaguccgcgacgcagaaaaacaauacgaaaaagacccagacgaacucaauaaacgcgcacucacagaccgagaaggaguggccgccagcauccaagcaaaaaucgacgaacuaaaacgccaacuagccgaccgcaucgcaaccggcaaaaaccuuggaaaagaacaagaccccacaggcguagaacccggcgaccaccucaaagaacgaagcaugcuaaguuacggcaacguccuggaccucaaccaccuagacauagacgaaccaaccggccaaacagccgacuggcucagcauagucaucuaccuaacauccuucgucguccccauacuccucaaagcacuauacaugcuaaccacacgcggacgccaaaccacaaaagacaacaaaggaacacgcauacgcuucaaggaugacagcuccuucgaagacgucaacggaauccgaaaaccaaaacaccucuaccucucccuccccaacgcccaaucaagcaugaaagccgaagaaauaacgccaggccgcuaccgcacagccauaugcggccuauaccccgcccaaaucaaagcgcgccaaaugauaagccccguaaugucaguaauaggcuuccuggcccucgcgaaagacuggucagacagaauagaacaauggcucagcgaacccuguaaacuccuacccgacacagcggcgguaucccuccauggcggccccgcaaccaaccgagauuaccuccgccaacgacaaguagcucucggcaacauggaaaccaaagagagcaaagccauccgacaacacgcagaaacggccggcugcucaaugaucgacgacaucgaaucccccagcucgaucugggucuucgcuggagcacccgaccgaugcccaccaacaugccuguucaucgccggaaucgccgaacugggcgcauucuucagcauccuccaagacaugcgcaacaccauaauggcaagcaaaaccguaggcacaagcgaagaaaaacuccgcaagaaaagcuccuucuaccaaucguaccuccgccgcacccaaagcaugggcauacaacuagaccaacgcaucaucguccuuuucauggucgccuggggaaaagaagcagucgacaacuuccaccucggcgacgacauggacccggaacuccgcacacuagcccaaucacucauagacguaaaaguaaaagaaaucucaaaccaggaaccccuaaaacuauag

SEQ ID NO: 7804 - RNA, 1290 nt, Artificial Sequence
  derived and/or modified CDS sequence (opt11) from HTNV(GAN19/2011)__KY807172.1__N
auggccaccauggaggaacuacaacgcgagaucaacgcccacgaaggacagcuaguaaucgcccgccaaaaagucagagacgccgaaaaacaauacgaaaaagacccagacgaacucaacaaaagggcccucaccgaccgcgaaggaguagccgcaagcauccaagccaaaaucgacgaacuaaaacgacaacucgccgaccgaaucgcaaccgggaaaaaccuaggaaaagaacaagaccccaccggaguggaacccggugaccaccuaaaagaacgcuccaugcucagcuacggaaacguccuugaccuaaaccaccucgacaucgacgaacccaccgggcaaacggcagacuggcucagcauagucauauaccuaaccuccuucgugguacccauccuucuaaaggcgcucuacaugcucacaacccgcggcagacaaaccaccaaagacaacaaaggaacccgaaucagauucaaagacgacucaucauucgaggacguaaacggcauccgaaaacccaaacaccuguaccuaucacucccgaaugcgcaaucauccaugaaagccgaagaaauaacccccggcagauaccgaaccgccaucugcggacucuaccccgcacaaauaaaagccagacaaaugaccagccccgucaugagcgucaucggcuuccucgcccucgcaaaggacugguccgaccgcaucgaacaauggcugagcgaacccugcaaacuccuaccagacaccgccgccguaucccuacacggcggcccagccacaucgcgagacuaccuacgccaacgccaaguagcccuugggaacauggaaacaaaagaaucuaaagccauccgucaacacgcagagacagccggaugcucaaugauagacgacauagaaagccccagcucgauaugggucuucgccggagcaccagacagaugcccacccacaugccuguucauagccggcaucgccgaacuaggcgccuucuucagcauacuccaagacaugcgaaacaccauaauggcaagcaagacagucggcaccuccgaagaaaagcuacgcaagaaauccucccucuaccaauccuaccuucgccggacacagagcaugggcauacaacuggaccaacgaaucaucguccucuucaugguagccuggggcaaagaagcggucgacaacuuccaccucggcgacgacauggacccagaacuccgcacacucgcacaaucacuaauagacguaaaaguaaaagaaaucucaaaccaagaaccacucaaacuauaa

SEQ ID NO: 7805 - RNA, 1290 nt, Artificial Sequence
  derived and/or modified CDS sequence (opt11) from HTNV(LR1)__AF288294.1__N
auggccacaauggaagagcuacaacgcgaaaucaacgcccacgaaggacaacuagucauagcccgccaaaaaguccgagacgcugaaaaacaauacgaaaaagacccugacgagcucaacaaacgagcccucaccaaccgcgaaggcgucgcaguauccauccaagccaaaaucgacgaacuaaaaaugcagcucgcagacagaaucgcaacaggcaaaaaccuaggcaaagaacaagacccaaccggugucgaacccggcgaccaccucaaagaacgaagcaugcuauccuacggcaacguccucgaccugaaccaccucgacaucgacgaaccuaccggccaaacagccgacuggcucagcauaaucguauaccucacaagcuucgucguacccauacuccucaaagcccucuacaugcucaccaccagaggccgccaaacgacaaaagacaacaaaggcacacgaauccgcuucaaagacgacagcucauucgaagacguaaacggaauccgcaaaccgaaacaccucuauguaucacuccccgacgcacaauccucaaugaaagccgaagaaauaacaccaggccgcuaccgcaccgccgucugcggucucuaccccgcccaaaucaaagcccgccaaaugaucagccccgucauguccgucauaggauuccuagcccucgccaaagacugguccgaccgaaucgaacaauggcucaucgaacccugcaaacuacucccagacacagccgcagucucccuccucggcggacccgcaaccaaccgcgauuaccuccgccaacgccaaguugcccucggaaacauggaaaccaaagaaagcaaagccauccgccaacacgccgaagccgcaggcugcucuaugauagaagacauagaaucaccaagcuccauaugggucuucgccggagccccagaccgcugcccaccaaccugccuauucaucgccggcauagccgagcugggggccuucuucuccauacuccaagacaugagaaacaccaucauggccagcaaaaccguaggcaccuccgaagaaaaacucagaaaaaaaagcuccuucuaccaaagcuaccugcggagaacacaaucaaugggcauccaacuagaccaacgaaucaucguccucuucauggucgccuggggaaaagaagccgucgacaacuuccaccugggcgacgacauggaccccgaacuccgaacccuagcacagucccuuaucgacgucaaaguaaaagagauauccaaucaagaaccccucaaacuauaa

SEQ ID NO: 7806 - RNA, 1290 nt, Artificial Sequence
  derived and/or modified CDS sequence (opt11) from HTNV(RG9)__AF288296.1__N
auggcaaccauggaagaacuccaacgcgaaaucaacgcccacgaaggccaacucguaaucgcacgccaaaaaguaagagacgcagaaaaacaauacgaaaaagaccccgaugaacuaaacaaacgcacccuaacagaccgcgaaggcguagcugcaucaauccaggccaaaaucgacgaacugaaacgccaacucgccgaccgcaucgccacaggcaaaaaccucggaaaagaacaagaccccaccggcgucgaacccggcgaccaccucaaagaacgcuccaugcucuccuacgguaacguccucgaccuaaaccaccuugacaucgacgaacccacuggacaaacagccgacuggcucuccaucgucauauaccucaccucauucgugguccccauucuccucaaagcccucuacaugcucacaaccagaggaagacaaacaaccaaagacaacaagggcacccgcauccgcuucaaagacgacuccuccuucgaagacgucaacggaauaagaaaacccaaacaccucuacguaucacuccccaacgcccaaucauccaugaaagcugaagaaauuacccccggccgauaccgcaccgccauaugcggccucuaucccgcccaaaucaaagcccgucaaaugaucucccccgucaugucggucaucggcuuccucgcccuggccaaagacuggucagaccgcaucgaacaauggcuaucagaacccugcaaacuacuacccgacacagcagccgugucccuccacggaggcccagcaaccaaccgcgacuaccuacgccaacgccaaguagcccucggaaacauggaaaccaaagaaagcaaagccaucagacaacacgcagaauccgcaggcugcucaaugaucgaagacaucgaaucuccauccuccauauggguauucgcaggcgcccccgaccgcugcccucccacaugccuuuucaucgccggcauagccgaacucggcgccuucuucagcauccuccaagacaugcgaaacacaauaacagccuccaaaacugucggcacaagcgaagagaaacuccgaaagaaauccuccuucuaccaauccuaccuccgccgaacacaauccaugggaauccaacucgaccaacgcaucaucguccuguucauggucgccuggggcaaagaagcagucgacaacuuccaccucggcgacgauauggaccccgaacugcgaacacucgcacaaucacucaucgacgucaaaguaaaagaaaucagcaaccaagaaccccucaaacuauaa

SEQ ID NO: 7807 - RNA, 1290 nt, Artificial Sequence
  derived and/or modified CDS sequence (opt11) from HTNV(S85-46)__AF288659.1__N
auggccaccauggaggaacuacaacgcgaaaucaacgcccacgaaggccaacucguuaucgcccgccaaaaagucagagacgccgaaaaacaauacgaaaaagaccccgacgagcucaacaaauccgcacucacaaaccgcgaaggcguagcugucucaauacaagcaaaaaucgacgaacucaaaaugcagcucgcagaccgcaucgcaacaggcaaaaaccucgggaaagaacaagacccaaccggcgucgaacccggcgaccaccucaaagaaagaucaaugcuauccuacggcaacguccuggaccugaaccaccucgacaucgacgaacccaccggacaaacagcagacuggcucucaauuaucgucuaccucaccuccuucguaguaccaauacuacucaaagcccucuacaugcucaccacccgaggacgccaaaccacaaaggacaacaaaggaacacgaauccgauucaaagacgacagcagcuucgaggacguaaacggaauccgaaaacccaagcaccuguacgucucccuccccaacgcccagagcuccaugaaagcagaagaaauaacccccggccgcuaccgcaccgccgucugcggccucuacccagcacaaaucaaggcccgccaaaugauaagcccagucaugagcgucauaggcuuccucgcccucgcgaaggacugguccgaccgcaucgaacaauggcuaauagaacccugcaaacugcuccccgacacagccgcagucucacugcuaggaggccccgcaaccaaccgcgacuaccuccgccaacgacaagucgcccuaggaaacauggaaacaaaagagagcaaagccauccgccaacacgccgaagcagccggaugcuccaugauagaagacauagaaagccccucaucaaucuggguauucgccggcgcccccggcagaugcccacccacaugccucuucaucgcaggaauagcagaacugggagccuucuucuccauccuccaggacaugagaaacaccaucauggccuccaaaacaguaggcacguccgaagaaaaacuacgaaagaaaagcuccuucuaccaguccuaccuccgccgcacccaauccaugggaauccaacucgaccaacgaaucauaguccuguucauggucgcauggggcaaagaagcagucgacaacuuccaccucggcgacgacauggaccccgaacugcgcacacuagcccaaucacuaaucgacgucaaaguaaaagaaaucuccaaccaagaaccacucaaacucuaa

SEQ ID NO: 7808 - RNA, 1290 nt, Artificial Sequence
  derived and/or modified CDS sequence (opt11) from HTNV(SN7)__AF288657.1__N
auggccaccauggaagaacuccaacgagaaaucaacgcccacgaaggccagcucgucauagcccgccaaaaaguccgagacgccgaaaaacaguacgaaaaagaccccgacgaacucaacaaacguacccuuaccgaccgcgaaggcgucgccgccucaauacaagcaaaaaucgacgaacucaaacgccaacucgcggaccgcaucgcaaccggcaaaaaccucggaaaagaacaagaccccacaggcgucgaacccggcgaccaccucaaagaacgcagcaugcuauccuacggaaacguccucgaccuaaaucaccucgacaucgacgaacccacaggacaaaccgccgauuggcuaagcaucgucaucuaccucaccucauucguaguccccauauuacucaaagcucucuacaugcuaaccacacgcggucgccaaaccacaaaagacaacaaaggcacacgcauccgcuucaaagacgacuccucauucgaagacgucaaugguauccgcaaacccaaacaccucuacgucucccuacccaacgcacaaucauccaugaaaaccgaagaaaucacccccggccgcuaccgaacagcuaucugcggccucuaccccgcacaaaucaaagcccgacaaaugauaagccccguaauguccguaauaggguuccuagcccucgccaaagacuggucagaccgaaucgaacaauggcucuccgaacccugcaaacuccuacccgauaccgccgcaguaucccuccacggcggccccgccacaaaccgagacuaccuccgccaacgacaaguagcacucggcaacauggaaaccaaagaauccaaagccauccgacaacacgcagaaucagcugguugcucaaugauagaggacaucgaaucacccucaagcaucuggguauucgcuggagcccccgaccgaugcccaccaaccugccuauucauagccggaauagcagaacucggcgccuucuucucaauccuccaagacaugcgaaacacuaucauggccuccaaaacagucggcaccuccgaagaaaaacuccgaaagaaaucauccuucuaccaauccuaccuccgccgcacccaauccaugggcauccaacucgaccaacgaaucauaguacucuucaugguggccuggggcaaagaagccgucgacaacuuccaccucggagacgacauggaccccgaacuaagaacacuagcucaaucccucaucgacguaaaaguuaaagaaaucaguaaccaagaaccccucaaacucuaa

SEQ ID NO: 7809 - RNA, 1290 nt, Artificial Sequence
  derived and/or modified CDS sequence (opt11) from HTNV(84FLi)__AF366568.1__N
auggccaccauggaagaacuacaacgagaaaucaacgcccacgaagggcagcuaguaaucgcccgacaaaaaguccgcgacgccgaaaaacaauacgaaaaagaccccgacgaacuaaacaaaagaacacuaacugaccgcgaaggcgucgcagccuccauccaagccaaaauagacgaacuuaaaagacaacucgccgaccgcauagccaccggcaaaaaccucggcaaagaacaagacccaaccggaguagaacccggagaccaccuaaaagaaagauccaugcucucauauggcaacguacuugaccucaaccaucuagacaucgacgaacccaccggccaaaccgccgacuggcuuuccaucgucaucuaccuaacauccuucgucgucccaauacuacuaaaagcccuauacaugcucaccacccgcggccgccaaacaaccaaagacaacaaaggcacccgcauaagauucaaagacgacuccuccuucgaagacgucaacgguauccgcaaaccaaaacaccuauacguaucacuccccaacgcccaaagcucaaugaaagccgaagaaaucacaccaggaagauaccgcaccgcaaucugcggccucuaccccgcacaaaucaaagcacgccaaaugauaagccccguaauguccgucaucggcuuccuagcccucgccaaagacuggucugaccgaauagaacaauggcucuccgaacccugcaaacuccuacccgacaccgccgccguaucccuccacggcggccccgcgaccaaccgagacuaccuacgccaaagacaggucgcgcucggcaacauggagacaaaagaauccaaagccauccgccaacacgccgaaucugcaggcugcucaaugaucgaagacauagaauccccauccagcaucuggguauucgcuggagcacccaaccgaugcccucccacgugccuauucaucgccggcaucgccgaacuaggagccuucuucuccauccuacaagacaugcgcaacaccaucauggcaucuaaaacagucggcaccucugaagaaaaacuuagaaagaaaagcuccuucuaccaaucuuaccuucgccgaacccagagcaugggaauacaacuagaccaacgaaucauaguccuauucaugguagccuggggcaaagaagccgucgacaacuuccaccugggcgacgacauggaccccgaacuacgcacccucgcccaaagccucaucgacgucaaaguaaaagagaucuccaaccaagaaccgcuaaaacucuag

SEQ ID NO: 7810 - RNA, 1290 nt, Artificial Sequence
  derived and/or modified CDS sequence (opt11) from HTNV(KHF,clone:4)__LC209206.1__N
auggcaaccauggaggaacuccagcgcgaaauaaaugcacacgaaggacaacucgucauagccagacaaaaaguccgggacgcagaaaaacaauacgaaaaagacccagacgaacuaaacaaacgaacacugaccgaccgagaaggcguagccguaagcauacaagcaaaaauagacgagcuaaaacgacagcuagccgaccggaucgcaaccggcaaaaaccucggcaaagaacaagaccccaccggcgucgaaccgggggaccacuuaaaagaaagaucaaugcuauccuacggcaacguccucgaccuaaaccaccucgacaucgacgaaccaaccggacaaaccgcggauuggcuaucaauagucguauaccugacaucauucgucguccccauacuacucaaggcccucuacaugcucacaacccgcggccgacaaacaaccaaggacaacaaagggaccagaaucagauucaaggacgacucaucauucgaggacguaaacggaauccgcaaaccaaagcaccuauacgucagccuccccaacgcccaauccagcaugaaagcggaagaaauaacgcccggccgauaccgcacagcaguaugcgggcucuaccccgcacaaauaaaagcccgucaaaugaucagcccaguaaugagcguaaucggauuccucgcccuagccaaggacuggagcgaccgaauagaacaauggcugagcgaacccugcaagcuacucccagacacagcagcagucucgcuccuaggcgggcccgcaaccaacagagacuaccuacgccagcgccaagucgcgcuaggaaacauggaaacaaaagaaagcaaagccaucagacaacacgcagaagcagccggcugcucaaugauagaagacaucgaaagcccaucauccaucugggucuucgccggcgccccagaccgcuguccgccaacaugccucuucauagcagggaucgcagaacucggcgccuucuucucaauacuccaagacaugcgaaacaccaucauggcaaguaaaaccgucggcaccucagaagaaaaacuccgcaagaaaagcucauucuaccaaucauaccuacgcagaacccagagcaugggcauacagcuagaccagcgcaucauagugcuauucauggucgccuggggcaaagaagcaguagacaacuuccaccuaggcgacgacauggacccagaacuccgcacccucgcacagucacucauagacguaaaagucaaagaaaucucaaaccaagaaccccucaaacucuaa

SEQ ID NO: 7811 - RNA, 1287 nt, Artificial Sequence
  derived and/or modified CDS sequence (opt11) from LANV(510B)__AF005727.1__N
augaguaaucuacaagaaguccaagaaggaaucacccuccacgaacaacaacucguagccgcacgccaaaaacucaaggacgcagaaaaggccguagaagucgacccagacgauguaaacaaaagcacccuccaaagccgcagagccgccgucucagcccucgaaaacaaacucgccgaacucaaacgccaacucgcggaccucgucgccgcacaaaaacucgcagccaaaccagucgaccccaccggccuagaacccgacgaccacuuaaaagaaaaauccgcccuacgcuacggcaacguucucgacguaaacgccauagacuuagaagaaccaucgggccaaaccgcagacuggaaagccaucggcgccuacauacucggauucguaauccccauaauccucaaagcacucuacaugcucagcacacgcggaagacaaacagucaaagaaaacaaaggcacacgcauccgcuucaaagacgacuccuccuucgaagaagucaacggaauccgaaaacccaaacaccuauacgucuccaugcccaccgcucaaagcacaaugaaagccgacgaaauuaccccaggccgcuucaggaccaucgccugcggccuauuccccgcccaaauaaaagcccgaaacauaaucucccccguaaugggcgucaucggcuucggacacuucgugaaggacuggauggaacgcaucgacaacuuccucggagaagacugccccuuccucccaaaagcacgcguacaauccgaggcauucaugagcaccaacagagccuacuuccuaaaccgccaacgccaagucgacgaaucccgcauccaagacaucgucgaccucauacaagccgcagaagcaagcagcgccacccucuucaacgacaucgcaacuccccacuccgccugggucuucgccugcgccccagaccgcugcccacccaccgcccuauacguagcuggaguccccgaacucggagcauucuucgccauacuccaagacaugagaaacaccaucauggcuuccaaaagcgucggcacagccgaagaaaaacucaaaaagaaaucugcauucuaccaaucauaccuacgaagaacccaauccaugggaauacaacuagaccagaaaauaauaauacucuauaugcucuccuggggcaaagaagccgucaaucacuuccaccucggcgacgacauggacccagaacuccgccaacuagcccaaacccuaauagacgccaaaguaaaagaaaucagcaaccaagaaccccucaaacuauaa

SEQ ID NO: 7812 - RNA, 1287 nt, Artificial Sequence
  derived and/or modified CDS sequence (opt11) from LANV(12234)__ALD61435.1__N
auguccacacuccaagaaguccaagaaggcauaacccuacacgaacaacaacugguagccgcccgacaaaaacugaaagacgccgaaaaagcagucgaagucgaucccgacgacgugaacaaauccacccuacaaucaagacgagccgccguuucggcacucgaaaacaaacucgcagaacucaaacgacaacucgcagaccucgucgccgcccaaaaacucgccgcaaaaccaguagaccccaccggccucgaaccagacgaccaccuaaaagaaaaauccgcccuacgcuacggaaacguccucgacgucaacgcuauagaccuagaagaacccuccggccaaaccgccgacuggaaagcaaucggagccuacauacuaggauucgucaucccaaucauccucaaagcccucuacaugcuuuccacccgcggccgacaaaccgucaaagaaaacaaaggaacccgcauacgguucaaagacgacuccuccuucgaagaagucaacgggauccgcaaacccaaacaacuauacgucuccaugccaaccgcccaauccaccaugaaagcagaugaaaucaccccgggcagauuccgaaccaucgccugcggccuguuccccgcccaaaucaaagccagaaacaucauaaguccagucaugggagucauagguuucagccacuucgucaaggacuggauggaacggaucgacgacuuccucgccgcagacugcccauuccuacccaaaccacgcguacaauccgaagccuucauggcaaccaaccgagccuacuucaucaaccgccaacgccaaaucgacgaaagccgcaugcccgacaucauggaccucauacaggccgccgaagccggaucagcaacacucuucaacgacauagccaccccacacucagcaugggucuucgccugcgcccccgacagaugcccuccaaccgcucucuacgucgcaggaguacccgaacucggcgcuuucuucgccauccuacaagacaugcgcaacaccaucauggccucaaaauccgucggcacagccgaagagaaacuaaagaagaaauccgcauucuaccaauccuaccucagacgaacccaaagcaugggcauccaacucgaccagaaaaucaucauacuauacaugcucagcuggggcaaagaagccguaaaccacuuccaccucggggacgacauggaccccgaacuccgccaacucgcccaaacccucaucgacaccaaaguaaaagaaaucagcaaccaagaaccacucaaacucuaa

SEQ ID NO: 7813 - RNA, 1272 nt, Artificial Sequence
  derived and/or modified CDS sequence (opt11) from LQUV(Longquan-Rs-32)__JX465422.1__N
auggcaaccgggcgagaccuccaagacgaacucgaacaaaucgaacaagaaaucacccaagcaaaagccaaguacgaaaaacagaaagccgcuauaggcgaagaacccgacacaaucgaacucaaaguacuccaacaaagagaagaaacaauccauaugcucgaagaaaaacgcaaagaacuacuacaacgcaucgcccaacaaaugaaaucaccccgccaacccgucaaaggaagagaccuagacgaagacgaacaccuuagcgaaagaagcacccuccgcuacggcaacgucaucgaccucgaagaacucgacaucgacgaaccagcaggcggcagcgcugacuggcuagcuaucggaauauacauauucuccuuccccguacaacuacugcucaagacacuguauauacucaccacacgggggcgacaaaccaucaaagaaaacaagggcaaccgccuacgcuucaaagacagcagcagcacaauggacgucaacggcgucaagaccccacgccaccucuacaucagccucccaaccgcccaauccuccaugaagacagaagaaaucacacccggacgcuaccgcaccgucgcaugcggaauccucagcggcgaaaugagggcccgcaaacuggucuccccagucaugggcguuaucggcuucaacuaccucgccgaaaaauggggcgaauacaucgacgccuuccuuaugaaacaaagcccacaccuaccagucagcacagggucacccgaauccgccaccaacuucgccuaccucauccaacgccaagacguccuaaacaaauccaaaacagucgaauaccuagaacuaugggaacaagccgaaaaagccggccgccaccuagucgaccgcaucgaaucaccccucacccccuggcuauucgcaggcucccccgaccgaugcccacccaccagccucuacgucgccggcaucgccgaacucggcgccuucuucagcauccuccaagacauccgcaacgcgaucauggcuuccaaacucgucggcaccgccgaagaaaaacucaaacgaaaauccagcuucuaccaaucauaccuccgccgaacccaauccauggggguccagcuagaccaacgcaucaucauacucuacaugauggaauggggcaaaaugaugguagaccacuuccaccucggagacgacauggacucagaacuccgaaaggccugccaaagccuaaucgacgaaaaagucgcccaagucuccaaccaagaagcacucaaacuauaa

SEQ ID NO: 7814 - RNA, 1272 nt, Artificial Sequence
  derived and/or modified CDS sequence (opt11) from LQUV(Longquan-Ra-14)__JX465414.1__N
auggccaccggccgcgaccuccaagacgaauuagaacaaauagaacaagaaauaacccaagccaaagcaaaguacgaaaaacaaaaggcagcaaucggagaagaacacgacaccauagaacuaaaaguacuccaacaaagagaagaaaccauccacaugcucgaagaaaaacgcaaagaacuacuacaacgcaucgcacaacaaaugaaaagcccccgacaaccagucaagggcagagaccuggacgaagacgaacaccuauccgaacgcucaacccuccgcuacggcaacguaaucgaccuagaagaacucgacaucgacgaacccgccggcggcucggccgacuggcuagccauuggcaucuacaucuucuccuuccccguccaacuacuacucaagacccucuacauccucaccacacgcggccgccaaaccaucaaagaaaacaagggaaaccgacuacgauucaaagacucgagcuccacaauggacguaaacggcgucaagaccccaagacaccucuacauaucacuccccacagcccaaucauccaugaaaacagaagaaaucacccccggccgcuaccgcaccgucgccugcggcauccucagcggagaaaugcgcgcccgaaaacucguaagccccgucaugggcguaaucggcuucaacuaccuagccgaaaaauggggagaauacauagacgccuuccucaugaaacaauccccacaccuccccgucucaaccggcucccccgaauccgcaaccaacuucgccuaccucauccaacgccaagacguacuaaacaaauccaaaacagucgaauaccuagagcucugggaacaagccgaaaaagccggccgccaccuaguagaccgcaucgagagcccacuuacacccuggcuguucgccggcucuccagaccggugcccacccaccucacuauacgucgcaggcaucgccgaacucggggccuucuucagcaucuuacaagacauccgcaacgccauaauggccuccaaacucgucggaacagccgaagagaagcugaaacgaaaauccucauucuaccaauccuaccuccgccgaacccaaucaaugggcguccagcucgaccaacgcauaaucauacucuacaugauggaauggggaaaaaugauggucgaccacuuccaccucggggacgacauggacagcgaacuccguaaagcgugccaaucccucaucgacgaaaaagucgcccaaguaucaaaccaagaagcccucaaacuauaa

SEQ ID NO: 7815 - RNA, 1272 nt, Artificial Sequence
  derived and/or modified CDS sequence (opt11) from LQUV(Longquan-Ra-25)__JX465415.1__N
auggcaaccggacgcgaccuacaagacgaacuagagcaaaucgaacaagaaauaacccaggccaaagccaaauacgaaaaacaaaaagccgccauaggagaagaacccgacacaaucgaacucaaaguacuccaacaaagagaagaaacaauccacaugcuagaagaaaaacgcaaggaacuccuacaacgcaucgcccaacaaaugaaaagccccaaacaacccgucaaaggaagggaccucgacgaggacgaacaccuauccgaacgcagcacccuacgauacggcaacgucaucgaccucgaagaacucgacaucgacgaacccgccggaggcuccgccgacuggcuagccaucggcaucuacaucuucagcuuccccguccaacuccuacucaaaacacuauauauccucaccacaagaggccgccaaaccaucaaagaaaacaaaggcaaccgccuccgcuucaaagacagcagcucaaccauggacguaaacggcguuaaaaccccacgacaccuauacauaagccugccuaccgcccaaagcucgaugaaaacagaagaaaucacacccggccgguacagaaccguagccugcggaauccucucaggagaaaugcgcgcccgaaaacuugucagccccgucaugggcguaaucggauucaacuaccuugccgaaaaauggggcgaauacaucgacgccuuccucaugaaacaaagcccacaccuacccgucagcaccgguagccccgaaagcgcaaccaacuucgccuaccucauccaacgccaggacguccuaaacaaaagcaaaacuguagaauaccucgaacugugggaacaagccgaaaaagccggccgccaccucguggaccgcaucgaauccccacucacccccuggcuuuucgccgggagcccggaccgaugcccacccacaagccuauacguagccggcauagccgaacucggcgccuucuucuccauccuacaggacauccgcaacgccauaauggccagcaaacuggugggaacagccgaagaaaagcuaaaacgaaaaagcuccuucuaccaauccuaccuacgucgcacccagagcaugggcauacaacuagaccaaagaaucauaauccucuacaugauggaauggggcaaaaugauggucgaccacuuccaccuaggagacgacauggacucagaacuccgcaaggcuugccaaucacucauagacgaaaaaguagcccaaguauccaaccaagaagcacuaaaacucuaa

SEQ ID NO: 7816 - RNA, 1287 nt, Artificial Sequence; identical to SEQ ID NO: 6432
  derived and/or modified CDS sequence (opt11) from NYV(RI-1)__U09488.1__N

SEQ ID NO: 7817 - RNA, 1302 nt, Artificial Sequence
  derived and/or modified CDS sequence (opt11) from PUUV(K27)__L08804.1__N
auguccgaccucaccgacauccaagaagaaaucacccgccacgaacagcaacugguagucgcccgacaaaagcucaaagacgccgaacgcgccgucgaaguauaccccgacgacgucaucaaaaauacacuacaagccagacagcaaacagucagcgcccucgaagacaaacuagccgacuacaaaagacgcauggccgacgcagucucacgcaagaaaauggacaccaaacccacagacccaaccggaauagaacccgacgaccaccuaaaagaacgauccucccuccgcuacgguaacguacucgacgucaacgccaucgacaucgaagaaccauccggccaaacugccgacugguacacaaucggcgucuacgucauaggcuucaccauccccaucauccuaaaagcccuauacaugcucucaacccggggccggcaaacagucaaagaaaacaaaggcacccggauccgcuucaaagacgacaccuccuucgaagacauuaauggcauccgccgcccaaaacacuuauacguauccaugccaaccgcacaaucaacaaugaaagcagaagaacucaccccaggacgcuuccgcaccaucgucugcggccucuuccccacacaaauccaaguccgcaacaucaugucccccgucaugggagucaucggauucuccuucuucgucaaagacuggcccgaaaagauacgcgaguucauggaaaaagaaugccccuucaucaaacccgaagucaaacccggcacccccgcccaagaagucgaguuccucaaacgcaaccgcgucuacuucaugacccgacaagacguccucgacaaaaaccacguagccgacaucgacaaacugaucgacuacgcugccucuggcgaccccaccucacccgacgacauaaaaagccccaacgcaccaugggucuucgcaugcgccccagaccgauccccacccacuugcauauacguagccggcauggccgaacucggcgccuucuucagcauccuccaagacaugcguaacacaauaauggccuccaagaccgucggcaccgccgaagaaaagcuaaaacguaaaucaucguucuaccaauccuaccuaagacgcacacaauccaugggcauacaacuagaccaacgcaucauccuccuauacaugcucgaauggggaaaagaaauggucgaccauuuccaccuaggcgacgacauggaucccgaacugcgcggacucgcccaaagccucaucgaccagaaagucaaagaaaucuccaaccaagaaccccuaaaaaucuaa

SEQ ID NO: 7818 - RNA, 1302 nt, Artificial Sequence
  derived and/or modified CDS sequence (opt11) from PUUV(KS13/855)__KX815394.1__N
auguccgaccuaacagacauacaggaagacauaacacgccacgaacaacaacugguagucgccaggcaaaaacucaaagacgccgaaaaagcagucgaaauggaccccgacgacgucaacaagaacacccuacaagcccgccagcaaacggucagcgcccuggaagacaaacucgccgacuucaaacgccguauggccgacgcagucucacgcaaaaaaauggacacaaaaccuacagaccccaccggcaucgagcccgacgaccaccucaaagaacgcagcagccuccgcuacggcaacguacuggacgucaacgccaucgacaucgaagaacccagcggccaaaccgccgacugguacaccauaggcgucuacguaaucggauucacccuaccuaucauccucaaggcccuauacaugcuaucuacccgaggacgccaaaccgucaaagaaaacaaaggaacacgcauccgcuucaaagacgacaccucauucgaagacaucaacggcauaaggcgccccaaacaccucuacgucucaaugccaaccgcacaaucaacaaugaaagcggaagagcucacaccaggacguuuccgcaccaucgucugcggccucuuucccacccaaauccaaguccgcaacaucaugagccccgucaugggagucaucggcuuuucguucuucgucaaagacugggccgagcgaauacgagaauucauggaaaaagaaugcccauucaucaaacccgaggucaaacccgggacaccggcccaagaaguggaauuccuaaaaaaaaacaaaguauacuuuaugcaacgacaggacgugcucgacaaaaaccacgucgccgacaucgacaaacuaauagacuacgccgccucaggcgacccaaccagcccggacaacaucgaaagcccaaacgcaccaugggucuucgccugcgcccccgacagaugcccacccaccugcaucuacguagcgggcauggccgaacucggcgccuucuucucaauccuacaagacaugcgaaacaccaucauggccuccaaaacagucggcaccgccgaagaaaaacucaaaaaaaaaagcucauucuaccaauccuaccuccgcagaacccaaagcaugggcauccagcucgaccaacgcaucauccuacuauacaugcuagaauggggcaaagaaauggucgaccacuuccaccucggcgacgacauggacccagaacugcgcggacuagcacaagcacucaucgaccaaaaagucaaagaaauaucaaaccaggaaccccuaaaaauauaa

SEQ ID NO: 7819 - RNA, 1302 nt, Artificial Sequence
  derived and/or modified CDS sequence (opt11) from PUUV(KS14/118)__KX815395.1__N
auguccgaccuaaccgacauccaagaagacaucacccgccacgaacaacagcuagucguagcccgacaaaaacucaaagacgcagaacgcgccguagaaguagauccagacgacguaaacaaaaacacccuacaagcucgacaacaaaccgucuccgcccuggaagacaaacuagccgacuucaaacgccggauggccgacgcagucucacgcaagaaaauggacacaaaaccaacagaccccacaggcaucgaacccgacgaccaccucaaagaacgcagcucacuccgauacggcaacguccucgacgucaacgccaucgacauagaagaacccuccggacagacagccgacugguacaccaucggcguuuaugucaucggauucacaauccccaucauccucaaagcccucuacaugcucucaacacgcggacgccaaaccgugaaagaaaacaaaggcacccgaaucagguucaaagacgacacauccuucgaagauaucaacggcauccgccgcccaaaacaucucuacguaucaaugccaaccgcacaauccacaaugaaagccgaagaacuaaccccaggccgcuuccgaacaauagucugcggccucuucccaacccaaauucaaguccgcaacaucaugucacccguaaugggagucaucggcuucuccuucuucgucaaaaacuggccagaacgcauaaaagaguucauggaaaaagaaugcccuuucaucaaacccgaagucaaacccggcaccccagcccaagaaguagaguuccuaaaacgcaacaaaguauacuucaugaaccgccaagacguucuagacaaaaaccacguagccgacaucgacaaacucaucgauuacgcagccuccggcgaccccaccucaccagacgacaucgaauccccgaacgccccaugggucuucgccugcgccccagaccgaugcccaccaaccugcauauacgucgccggcauggcagaacuaggagccuucuucaguauacuccaagacaugcgcaacaccaucauggccucuaaaaccgucggcacagccgaagaaaaacuaaagaaaaagagcucguucuaccaauccuaccuccgccgcacccaguccaugggcauccaacuagaccaacgaaucauccuccucuauaugcucgaauggggcaaagaaauggucgaccacuuucaccucggcgacgacauggaccccgaacuaagaggacucgcacaggcgcuaauagaccaaaaagugaaagaaauauccaaccaagaaccccucaaaauuuaa

SEQ ID NO: 7820 - RNA, 1302 nt, Artificial Sequence
  derived and/or modified CDS sequence (opt11) from PUUV(LT15/201)__KX757841.1__N
augagcgaccucaccgacauccaagaagacaucacccgacacgaacaacaacucguagucgcucgacagaaacucaaagacgcagaaaaagcagucgaaauggaccccgacgacguaaacaaaaacacacuccaagccagacaacagaccgucagcgcccuagaagacaagcuagcagacuucaaacgccggauggccgacgcaguaagccgcaagaaaauggacacaaaaccaaucgaccccaccggaaucgaacccgacgaccaccuaaaagaacgcagcucacuaagauacggaaacgugcuagacgucaacgcaauagacauagaagaaccauccggccaaaccgcagacugguacaccauaggcgucuacgucaucggcuucacacuucccaucauccuuaaagcccucuacaugcucagcacccgaggacgacaaaccgucaaagaaaacaaaggcacacgaauccgauucaaagacgacaccaguuucgaagacaucaacggaauacgccgaccaaaacaccucuacgucuccaugcccaccgcccaaagcaccaugaaagccgaagaacuaacccccggacgauuccguaccaucgucugcggccuauuccccacccaaauacaaguccgaaacauaaugagcccagucaugggcgucaucggauucucauucuucgucaaagacugggccgaacgcauccgggaguucauggaaaaagagugccccuucaucaaacccgaaguaaagccaggcacccccgcccaagaagucgaauuucucaagaaaaacaaaguauacuucaugcaaagacaagacguccuggacaaaaaccacgucgcggacaucgacaaacucaucgacuacgcagccagcggagaccccaccucccccgacaacauagaaagccccaacgcacccuggguauucgcaugcgcccccgaccgcugcccacccacaugcaucuacguagccggaauggccgaacuaggcgcauucuucucaauccugcaagacaugcggaacaccaucauggccuccaaaacgguaggcaccgccgaagaaaaacucaaaaagaaaagcagcuucuaccaauccuaccuacgccgcacccaaucaaugggaauccaacucgaccaacgaaucauacuccuguacaugcucgaauggggaaaagaaauggucgaccacuuccaccuaggcgacgacauggacccagaacuacgcggccucgcacaagcccuaauugaccagaaagucaaagaaauaagcaaccaagaaccacucaaaauauaa

SEQ ID NO: 7821 - RNA, 1302 nt, Artificial Sequence
  derived and/or modified CDS sequence (opt11) from PUUV(PUU/Ernstbrunn/Cg641/1995)__AJ888752.1__N
augagcgaccuaacagauauacaggaggacaucacacgacacgaacaacaacucgucguagcacgccaaaaacuaaaagacgcagaaaaggcaguagaaauggaccccgacgacguaaacaaaaacacccuucaagcccggcaacaaaccgucuccgcccucgaagacaaacuagcagacuucaaacgacgaauggccgacgcagucucccgcaagaaaauggacacaaaacccacagaccccacaggcaucgaacccgacgaccaccuaaaagagcgcucaucccuacgauacggaaacguacucgacgucaacgccaucgacaucgaagaacccuccggccaaaccgccgacugguacaccaucggcguguacgucaucggcuucacacuacccaucauccuaaaagccuuguacaugcucucaacgagaggccgacaaacagucaaagaaaacaaaggcacccgaauccgauucaaagacgacaccagcuucgaagacaucaacggcaucaagcgccccaaacaccucuacgucuccaugcccaccgcccaaucuacaaugaaagccgaaaagcuaacccccggacgauuccgaacaaucgucugcggacuauucccaacccaaauccaagugagaaacaucaugucccccgucaugggcgucaucggcuucuccuucuucguaaaagacuggucagaacgaguacgcgacuucauggaaaaagaaugccccuuuaucaagcccgaaaucaagcccggcaccccuccccaagaagcggaguuccuaaaacgcaacaaagucuacuucaugcaacgacaagacguccuagacaagaaccacgucgcagacaucgacaaacucaucgacuacgcagcaucaggagaccccaccucccccgacaaccucgaaucccccaacgcacccugggucuucgcaugugcccccgaccgcugcccacccacaugcauauacgucgccggaauggccgaacugggcgcauucuucuccauccuccaagacaugcgcaacacaaucauggcauccaaaaccgucggaacagccgaagaaaaacucaaaaagaaaagcagcuucuaccaaucauaccugcgccgaacccaauccaugggcauccaacucgaccaacgaaucauccuacucuacauguuagaauggggcaaagaaauggucgaccacuuccaccugggcgacgacauggaccccgaacuacgaggacucgcccaagcccucaucgaccaaaaagucaaagaaauaagcaaccaagaaccccuaaaaaucuaa

SEQ ID NO: 7822 - RNA, 1302 nt, Artificial Sequence
  derived and/or modified CDS sequence (opt11) from PUUV(PUU/Klippitztoerl/Cg9/1995)__AJ888751.1__N
augucagaccucaccgacauacaagaagacauaacccgccacgaacaacaacucgucguagcccgccaaaaacucaaagaugccgagaaagccgucgaaauggaccccgacgacgucaacaaaaacacccuccaggcacgacaacagacagucuccgcccuagaagacaaacucgccgacuucaaacgccgaauggccgacgccgucagccgcaagaaaauggacaccaaacccaccgacccaaccggcaucgaacccgacgaccaccuaaaagaacgcuccucccuaagauacggaaacguccucgacguuaacgccauugacaucgaagaaccuggcggacaaaccgccgauugguacacaauaggcgucuacgugaucggcuucacccucccaauaauccuaaaagcccucuacauguucagcacccgcggacgacaaacagucaaagaaaacaaaggcacccgcauccgauucaaagacgacaccuccuucgaagacaucaacggaauccgccgccccaaacaccuguacgucagcaugcccacagcccaaagcacaaugaaagccgaagaacucacaccaggccgcuuccgcaccauugucugcggccucuuccccacccaaauccaaguccgaaauaucaugagccccgucaugggcgucaucggcuucagcuucuucgucaaagacugguccgaacgaguccgcgacuucauggaaaaagaaugccccuucaucaaacccgagaucaaacccggcaccccaccccaagaagccgaguuccuuaaacgcaacaaaguauacuucaugcaacggcaggacguacuagacaaaaaccacgucgcggacauagacaaacucaucgacuacgccgccucaggcgaccccaccuccccagacaaccucgaaucacccaacgcaccaugggucuucgccugcgcucccgaccgaugcccaccaaccugcauauacguagccggaauggcagaacucggcgcauuuuucucaauccuacaggacaugagaaacacaaucauggccagcaaaaccgucggaacagccgaagaaaaacucaaaaagaaauccuccuucuaccaaucauaccuucggcgcacccaaagcaugggcauccaacuggaccaaagaaucauacuccuauacaugcuggaauggggcaaagaaauggucgaccacuuccaccucggugacgacauggaccccgaacuccgcggccuagcccaagcccucaucgaccaaaaagucaaagaaaucagcaaccaagaaccccucaagaucuaa

SEQ ID NO: 7823 - RNA, 1302 nt, Artificial Sequence
  derived and/or modified CDS sequence (opt11) from PUUV(Balkan-1)__AJ314600.1__N
augucagaccucaccgacauccaagaagacauaacccgccacgaacaacaacucgucguggcacgccaaaaacucaaagacgccgaaaaagccgucgaaauggaccccgacgacgucaacaaaaacacccuccaagcccgccaacaaaccgucuccgcccucgaagacaaacucgccgacuucaaacgaaggauggccgacgcuguaucccgcaagaaaauggacaccaaacccaccgacccaacaggcauagaacccgacgaccaccugaaagaacgauccucccuacgauacggcaacguccucgacgugaacgccauagacaucgaagaacccagcggccagaccgccgacugguacaccauaggagucuacgucaucggcuucacacuccccauaauucuaaaagcccucuacaugcucucgacacgaggccgccaaacaguaaaagaaaacaaaggcacccggauccgcuucaaagacgacaccucuuucgaagacaucaacggcauccgcagacccaaacaccucuacguaucgaugcccacagcacaaucaacaaugaaagccgaagaacucacccccggacgcuuccgcacaaucgucugcggccuuuuccccacccaaauccaaguccgcaacaucauguccccgguaaugggcguaaucggcuucuccuucuucguuaaagacugguccgaacgaguccgagaauuuauggaaaaagaaugccccuucauaaaacccgaaaucaaacccggcaccccaccccaagaagcagaguuccuaaaacgcaacaaagucuacuucaugcaacgccaggacguccucgacaaaaaccacguagccgacaucgacaaacuacucgacuacgccgccuccggcgaccccaccucacacgacaauaucgaaagccccaacgcacccugggucuucgcaugcgcacccgaccgcugcccgcccacaugcauauacgucgccggcauggcagaacuaggcgcguucuucuccauccuucaggacaugcgcaacaccaucauggccuccaaaacagucggaacagcagaagaaaaacugaaaaagaaaagcuccuucuaccaaucguaccuccgccgcacccaaaguaugggcauacaacucgaccaacgaauaauacugcuauacaugcucgaauggggcaaagaaauggucgaccacuuccaccugggagacgacauggaccccgaacugcgaggccucgcgcaagcacucaucgaccagaaagucaaagaaaucuccaaccaagaaccccucaaaaucuga

SEQ ID NO: 7824 - RNA, 1302 nt, Artificial Sequence
  derived and/or modified CDS sequence (opt11) from PUUV(Balkan-2)__AJ314601.1__N
augagcgaccuaacagacauccaagaagacaucacacgccacgaacaacagcuagucguggcccgccaaaaacuaaaagacgccgaaaaagcgguagaaauggaccccgacgacgucaacaaaaacacccuucaagcacgccagcaaacagucuccgcccucgaagacaaacucgccgacuucaaacgcaggauggcagacgcagucucccgaaagaaaauggacacaaaaccgaccgaccccacaggcauagaacccgacgaccaccuaaaagaacgaucaucccuccgauacggcaacguccucgacgucaacgccaucgacaucgaagaacccuccggccaaaccgccgacugguacaccaucggcgucuacgucaucggcuucacucuccccauaauccuaaaagcccucuacaugcucuccacccguggccgacaaaccgucaaagaaaacaaaggaaccagaauccguuucaaagacgacaccucauucgaagacaucaacggcauccgcagaccaaaacaccucuacgucucaaugcccaccgcccagucgaccaugaaagcagaagaacuaaccccaggccgcuuccgcaccaucguauucggccuauuccccacacaaauccaaguacgaaacaucaugucacccguaaugggcgucauagguuucucauucuucguaaaagacuggucagaacgcguccgcgaguucauggaaaaagaaugcccauucaucaaacccgaaaucaaacccggcgccccaccccaagaagccgaguuccucaaacgcaacaaggucuacuucaugcaaagacaagacguccuagacaaaaaccauguggccgacaucgacaaacucaucgacuacgccgccucaggagaccccacaucccccgacaacauugaauccccaaacgcgcccugggucuucgccugcgccccagaccgcugcccacccacaugcaucuaugucgccgggauggcagaacucggcgcauucuucagcauccugcaagacaugcgaaacacaaucauggccucaaaaacagucggcaccgccgaagaaaaacuaaagaagaaauccagcuucuaccaaucauaccuccgacgcacccaauccaugggaauccaacucgaccaacgcaucauucuccuuuacaugcuggaauggggcaaagaaauggucgaccacuuccaccucggagacgacauggaccccgaacuccgcggacuagcccaagcccucaucgaccaaaaaguaaaagaaaucucaaaccaggaaccccuaaaaauauaa

SEQ ID NO: 7825 - RNA, 1302 nt, Artificial Sequence
  derived and/or modified CDS sequence (opt11) from PUUV(Baltic/205Cg/00)__AJ314599.1__N
augucagaccuggcagacauacaagaagacaucacacgucacgaacaacaacucgucgucgcacgacaaaaacucaaagacgccgaacgcgcagucgaagucgacccggaugacgucaacaaaaacacccuccaagccaggcaacaaaccgucucagcccucgaagacaagcucgccgacuacaaacgacgcauggcagacgccgucucccgaaagaaaauggacacuaaacccaccgaccccaccggaauagaacccgacgaccaccucaaagagcgcucaucacucagauacggaaacguccuggacgucaacgcaaucgacauagaagaacccucaggacaaaccgcagacugguacacaaucggagucuacguaauaggauucacccucccaaucauacucaaagcccuguacaugcucuccacccgcggacgacaaaccgucaaagaaaacaaaggcaccagaaucagauucaaagacgacaccuccuucgaagacaucaacggcaucagacgaccaaaacaccucuacgucuccaugccgaccgcccaaucaacaaugaaagcagaagaacucacccccggccgauuccgcaccaucguaugcggacuauucccgacacaaauccaaguccgcaacaucaugucacccgugaugggcguaaucggcuucuccuucuucguuaaagacuggcccgaacgcauaaaagaguucauggaaaaagaaugccccuucaucaaaccagaagucaaacccggaacccccacccaagaagucgaguuccuaaaacgcaacaaagucuacuucaugaaccgacaggacguacucgacaaaaaccacgucgccgacaucgacaaacucaucgacuacgcagcauccggcgaccccaccagccccgacgacaucgaaucccccaacgcacccugggucuucgcaugcgcccccgaccgcugcccgcccacaugcaucuacgucgcaggaauggccgaacucggcgccuucuucuccauccuccaagacaugcgaucaacaaucauggccagcaaaaccgucggcaccgcagaagaaaaacucaaaaagaaaucaucauucuaccaaucauaccuacgccgcacccaaucaaugggaauccaacuagaccaacgcaucauacuccuguacaugcuagaauggggcaaggaaauggucgaccacuuccaccucggagacgacauggauccagaacuccgaggccucgcgcaagcacuaaucgaccaaaaggucaaagaaaucucaaaccaagaaccccuaaaaaucuag

SEQ ID NO: 7826 - RNA, 1302 nt, Artificial Sequence
  derived and/or modified CDS sequence (opt11) from PUUV(Baltic/49Cg/00)__AJ314598.1__N
augucagaccuagccgacauccaagaagacauaacccgccacgaacaacaacucguagucgcccgccaaaaacucaaagacgcugaaagagccgucgaagucgacccggacgacgucaacaaaaacacacuccaagcacgacaacaaaccgucuccgcccucgaagacaaacuagcugacuacaagagacggauggcagacgccgucucacguaaaaagauggacaccaaacccacagaccccaccggcauagaaccagacgaccaccucaaagaacgcuccucacuccgcuacggcaacguccuagacgucaacgcaauagacaucgaagaacccuccggacaaaccgcagacugguacaccaucggcgucuacgucaucggauucacacuccccaucauccucaaagcccuauacaugcucuccacccgaggccgccaaacaguaaaagaaaacaagggcaccagaauccgauucaaagacgacaccagcuuugaagacauaaacggaauccgccgccccaaacaccucuacgucucaaugcccaccgcccaauccacgaugaaagccgaagaacucacccccggccgcuuccgcacuaucgucugcggccuuuuccccacacaaauccaaguacgcaacaucaugucaccugucaugggagucauaggcuucucuuucuucgucaaagacuggccagaacgcauaaaagaauucauggaaaaagaaugccccuucaucaaaccagaagucaaacccggaacccccgcccaagaagucgaauuccugaaacgaaacaaagucuacuucaugaaccgccaagacguccucgacaaaaaccacguagcagacaucgacaagcugaucgacuacgcagccuccggagacccuaccucgccagacgacaucgaaucaccaaacgcacccugggucuucgccugcgcccccgaccgcugcccccccaccugcaucuacgucgccggcauggccgaacucggcgcauucuucuccauacuccaagacaugagaaacacaaucauggcaagcaaaaccguaggaaccgcagaagaaaaacuaaaaaaaaaauccuccuucuaccaaucauaccuacgaagaacccaaagcaugggcauccagcuagaccaacgcauaauccuccucuacaugcuagaaugggggaaagaaaugguagaccacuuccaccugggcgacgacauggacccagaacugagaggccucgcccaagcccuaauagaccaaaagguaaaagaaaucuccaaccaagaaccacuaaaaauauaa

SEQ ID NO: 7827 - RNA, 1302 nt, Artificial Sequence
  derived and/or modified CDS sequence (opt11) from PUUV(Pallasjarvi/63Cg/98)__AJ314597.1__N
auguccgaccucaccgacauccaagaagacauaacacgacacgaacaacagcuaguaguagcccgccaaaaacucaaagacgcggaacgcgcagucgaaguagaccccgacgacguaaacaaaaacacacuccaggccagacaacaaaccguuucugcccuggaagacaaacuagccgacuacaaacgccgaauggcggacgccguaagccgcaagaaaauggacaccaaacccaccgaccccaccggcaucgaacccgacgaccaccuaaaagagcgaucaagccucagauacggcaacguccucgacguaaacgccaucgacaucgaagaacccucaggacaaaccgccgacugguacacaaucggcguauacgucaucggcuucacccuccccaucauacucaaagcacucuacaugcucucaacaagaggccgacaaaccgucaaagaaaacaaaggcacccgcauccgauucaaagacgacaccuccuucgaagacaucaacggcauacgccgacccaaacaccucuacgucuccaugccgaccgcacaaucaacaaugaaagccgaagaacucaccccaggaagauuucgcaccauagucugcggccucuuccccacccaaauccaaguacgcaacaucaugagcccgguaaugggaguaaucggauucucauucuucguaaaagacugguccgaacgaauccgugaguucauggaaaaagaaugccccuucauaaaacccgaagucaaacccggcacccccgcacaggaaguugaaaugcucaaacgcaacaaaaucuacuucaugcaacgccaggacguacucgacaaaaaccacguagccgacaucgacaaacucauagacuacgccgcauccggagaccccacaucaccagacaacaucgacucccccaacgcaccauggguauucgccugcgcccccgaccgcugcccgccaaccugcauauacguagccggcauggccgaacugggagccuucuucagcauccuccaagacaugcgcaacaccaucauggccagcaaaacagucggcacugccgaagaaaaacucaaaaagaaaucauccuucuaccaaucauaccuacgccgaacccaauccaugggaauacaacuggaccaacgcauaauccuccucuucaugcucgaauggggcaaagaaauggucgaccacuuccaccuaggcgacgacauggacccagaacuccgcggccuagcccaagcccucaucgaccaaaaaguaaaagaaauaucaaaccaggaaccacucaagaucuaa

SEQ ID NO: 7828 - RNA, 1302 nt, Artificial Sequence
  derived and/or modified CDS sequence (opt11) from PUUV(Sotkamo 2009)__HE801633.1__N
augagcgaccuuaccgacauccaagaagacauaacccgccacgaacaacaacucaucgucgcacgccaaaaacugaaagacgccgaacgcgccguagagguagacccagacgacgucaacaaaaacacccuacaagcacgacaacaaacagucuccgcacucgaagacaaacuagccgacuacaaacgccgcauggcagacgccguuucacgcaagaaaauggacaccaaacccaccgaccccaccggcauagaacccgaugaccaccuaaaagaacgcuccucacuccgcuacggaaacguccuagacguaaacgcaaucgacaucgaggaacccagcggacaaaccgcagacugguacaccaucggcguauacgucaucggcuucacccuaccgaucauccucaaagcccucuacaugcuaagcacccgcggcagacaaaccgucaaagaaaacaaagggacccgaaucagauucaaagacgacaccuccuucgaagacaucaacggcauucgccgccccaaacaccuauacguaucaaugcccaccgcccaaucaaccaugaaagccgaagaacugacacccggccgcuuccgcaccauagucugcggccucuuccccacacaaauccaagucagaaauaucaugucgcccgucaugggaguaaucggcuucagcuucuucgucaaagacuggucagaacgcauacgagaguucauggaaaaagaaugccccuucaucaaacccgaaguaaaacccggaaccccagcccaagaaaucgaaaugcucaaacgcaacaaaauauacuucaugcaaagacaagacguacuagacaaaaaccacguagcagacaucgacaaacuaaucgacuacgccgcaucuggcgaccccaccucacccgacaacaucgacucaccaaacgccccauggguauucgccugcgcccccgaccgcugcccacccacaugcaucuacguagccggaauggccgaacuaggcgcuuucuucagcauccuccaagacaugcgaaacaccaucauggcaucaaagaccgucggcacggcagaagaaaaacucaaaaagaaaagcucauucuaccaaagcuaccuccgccgaacccaauccaugggaauccagcucgaccaacgcaucauacuccuauucaugcucgaauggggcaaagaaauggucgaccacuuccaccucggcgacgacauggacccggaacuccgcggccuagcacaagcccuaauagaccaaaaagugaaagaaaucagcaaccaagaaccucucaaaaucuaa

SEQ ID NO: 7829 - RNA, 1302 nt, Artificial Sequence
  derived and/or modified CDS sequence (opt11) from PUUV(CG 13891)__U22423.1__N
augucagaccuaaccgacauacaagaagauaucacccgccacgaacaacagcuaguagucgcccgccaaaaacucaaagacgccgaaaaagccgucgaaauggaccccgacgacgucaacaaaaacacacuacaagcacgccaacaaacaguaucagcacuugaagacaaacucgccgacuucaagcgccaaauggccgacgccgucucaagaaagaaaauggacaccaaacccacagaccccacaggcaucgaaccagacgaccaccucaaagaacgcagcagccuccgcuauggcaacguccuggacgucaacgccaucgacaucgaagaacccagcggacaaaccgcagacugguacacaauaggcgucuacgugaucggauuuacacuccccaucauccucaaagcccucuacaugcucagcacccgaggccgacaaaccguaaaagaaaacaaagggacacgcauccgcuucaaagacgacacaucguucgaagacauuaacggcauccgccguccgaaacaccucuacgucuccaugcccaccgcccaauccaccaugaaagccgaagaacuaacaccaggacgcuuccgcacaauuguaugcggacucuuccccacccaaauacaaguccgcaacauaaugagccccgucaugggaguaauaggcuucuccuucuucguaaaagacugggccgaccgcauccgcgaaucaauggaaaaagaaugcccauuccucaaacccgacgucaaacccggcacccccgcccaagaaaccgaguuccucaagcgcaacaaaauauacuucaugcaacgucaagaaguacucgacaagaaccacgucgcagaaaucgacaaacuaauagacuacgccgcuuccggagaccccaccuccccagacaacaucgaaagccccaacgcacccuggguauucgccugcgcccccgaccgaugcccaccaaccugcauauacgucgcaggcauggccgaacucggagccuucuucuccauacuacaagacaugcgcaacaccauaauggccucuaaaaccgucggaaccgccgaagaaaaacuuaaaaagaaauccuccuucuaccaaucauaccuccgacgcacacaaagcaugggcauccaacucgaccagcgcaucauccuacuauacaugcuggaauggggcaaagaaauggucgaccacuuccaccuuggcgaugacauggaccccgaacuccgaggccuugcccaagcacuaaucgaccaaaaaguaaaagaaaucuccaaccaagaaccacucaaaaucuaa

SEQ ID NO: 7830 - RNA, 1302 nt, Artificial Sequence
  derived and/or modified CDS sequence (opt11) from PUUV(CG1820)__M32750.1__N
auguccgaccucaccgacauccaagaagaaauaacgcgacaugaacaacagcuaguagucgccagacaaaaacucaaagacgcagaacgcgcagucgaagucgaccccgacgacgucaacaaauccacccuacaagcccgccaacaaaccgucucagcccuagaggacaaacucgccgacuacaaaagaagaauggccgacgccgucucacgcaagaaaauggacacaaaaccaacagaucccaccggcaucgaacccgacgaccaccucaaagaaagaucaucccuccguuacggcaacguccucgacguaaacgccaucgacaucgaggaacccuccggacaaaccgccgacugguacacaauaggcguauacguaauaggauucaccauccccaucauccucaaagcccucuacaugcucucaacacguggccggcagaccgucaaagaaaacaaaggcacacgcauccgauucaaagacgacaccagcuucgaagacauaaacggcauacgccgccccaaacacuuauaugucuccaugcccaccgcacaaucaaccaugaaagccgaagaacucaccccuggacgauuccgcacaaucguaugcggccuauuccccacccaaauccaaguccgcaacaucaugagccccgucaugggagucaucggcuucuccuucuucguaaaagacuggccagagaaaauccgcgaauuuauggaaaaagaaugccccuucaucaaacccgaagucaaacccgguacacccgcacaagaagucgaguuccuaaaacguaaccgcguauacuucaugacacgacaggacguccucgacaaaaaccacgucgccgacaucgacaaacuuaucgacuacgcagccagcggcgaccccaccagccccgacgacaucgaaucccccaacgcacccugggucuucgccugcgcccccgaccgaugcccaccaaccugcauauacgucgcaggaauggccgaacucggagccuucuucuccauccuacaagacaugcgcaacaccaucauggcgagcaagaccgucggcacggcagaagaaaaacucaaaaagaaaagcagcuucuaccaauccuaccuccgccgaacacaguccaugggaauccaacucgaccaacgcauaauacuacuauacaugcuagaauggggccgagaaaugguggaccacuuccaccucggagaugacauggaccccgaacuccgcggacucgcacaaucucuaaucgaccaaaaagucaaagaaaucuccaaccaagaaccccucaaaaucuag

SEQ ID NO: 7831 - RNA, 1302 nt, Artificial Sequence
  derived and/or modified CDS sequence (opt11) from PUUV(Bussjo_95-1)__AM746297.1__N
augucagaucugacagacauccaagaagacauaacccgccacgaacagcaacuugugguagcccggcaaaaacucaaagacgccgaaaaagcaguugaaauggacccggacgacgucaacaaaaacacccuacaagcccgccagcaaaccguaucagcccucgaagacaaacucgccgauuucaaaagacgcauggccgaugccgucucacgcaaaaaaauggacaccaaacccaccgacccaaccggcauagaacccgacgaccacuuaaaagaaagaagcucacuacgauacggcaacguacuagacguaaacgccauagacaucgaagaacccagcggccaaacggccgacugguacaccaucggcgucuacgucauaggcuucacacucccaaucauacucaaagcccuguacaugcuauccaccagaggacgacaaacaguaaaagaaaacaaaggcacccggaucagauucaaagacgacaccagcuucgaagacaucaacggcaucagacgcccaaaacaccucuacgucucgaugcccaccgcgcaauccacaaugaaggccgaagagcuaacccccggccgcuuccgcacaaucgucugcggacuauuccccacccaaauccaaguacggaacaucaugagcccagucaugggcgucaucggcuucuccuucuucguuaaagacuggcccgaccgcauccgcgaauucauggaaaaagaaugccccuucaucaaacccgaggucaaacccggcacaccaacccaagaaaucgaguuccuaaaaaaaaacaaagucuacuucauggaccgccaaaacguccucgacaaaaaccacgucgccgacauagacaaacucaucgacuacgcagccuccggcgaccccaccagcccugacaacaucgaaagcccuaacgcccccugggucuucgccugcgcccccgaccgaugcccaccaacaugcaucuacguagccggcauggccgaacucggcgccuucuucuccauccuccaagacaugcgaaacacaauaauggccagcaaaaccgucggcaccgccgaagaaaaacuuaaaaaaaaaagcuccuucuaccaauccuaccuacgccgcacccaauccaugggcauacaauuagaccaacgcaucauccuccucuacaugcuagaauggggcaaagaaauggucgaccacuuccaccuaggcgacgacauggacccagaacuacgcggccuagcccaagcccuaauagaucaaaaagucaaagaaauaucaaaccaggacccccucaaaaucuaa

SEQ ID NO: 7832 - RNA, 1302 nt, Artificial Sequence
  derived and/or modified CDS sequence (opt11) from PUUV(CG144)__AF367064.1__N
augucagaccucaccgacauccaggaagacauaacccgacacgaacaacagcuaguagccgcccgccaaaaacuaaaagacgcagaacgcgccguagaaauggaccccgacgacgucaacaaaaacacccuccaagcccgccaacaaaccgucuccgcccucgaagacaagcucgccgacuacaaacgccgaauggcugacgcagucucccgcaagaaaauggacaccaaacccgcagacccuacaggcaucgaacccgacgaccaccucaaagaacgcucaucacuccgcuacggcaacguccuagacgucaacgccaucgacauagaagaacccucuggccaaacggcagacugguacacaaucggcaucuacgucaucggauucacacuaccaaucauccucaaagcccucuacaugcuauccacccgaggacgacaaacagucaaagaaaacaaaggcacccgcauccgcuucaaagacgacaccagcuucgaagacauaaacggcauacgaagacccaaacaccuauacgucagcaugccaaccgcacaaagcaccaugaaagcagaagaacucacccccggccgcuuccgcacuauagucugcggccuauucccuacacaaauccaaguccgcaacaucaugucucccguaaugggagucaucggcuucuccuucuucgucaaagacuggcccgaacguauccgcgaguucauggaaaaagaaugcccauucaucaaacccgaagucaaacccggcacccccgcccaagaaaucgaaaugcucaaaaagaacaaaaucuacuucaugcaccgccaagacguacuagacaaaaaccacguagccgacaucgacaaacucaucgacuacgcagccuccggagaccccacaucacccgacaacaucgacucacccaacgcccccugggucuuugcaugcgcccccgacagaugcccaccaacgugcaucuacguagcaggcauggccgaacuaggcgccuucuucagcauccuacaagacaugcgcaacacaaucauggccuccaaaaccguaggcacagccgaagaaaaacucaaaaagaaaucgucauucuaccaaucauaccuccgccgaacccaaucaaugggcauccagcucgaucaacgcaucauacuccuuuacaugcuagaauggggaaaagaaauggucgaccacuuucaccuaggcgacgacauggaccccgaacuccgcggccucgcacaagcccucaucgaccaaaaagucaaagaaaucucuaaccaagaaccccuaaaaaucuaa

SEQ ID NO: 7833 - RNA, 1302 nt, Artificial Sequence
  derived and/or modified CDS sequence (opt11) from PUUV(CG168)__AF367065.1__N
auguccgaccucaccgacauccaagaagacaucacacgucacgaacaacaacucgucgcugcccgacaaaaacucaaagacgccgaacgcgccguggaaauggaccccgacgacgucaacaaaaacacccuacaagcacgccaacaaacagucuccgcccucgaagauaaacuugccgacuacaaacgacgcauggcagacgccgucucccgcaagaaaauggacaccaaaccggcagaccccaccggcaucgaacccgacgaccaccucaaagagcgcuccucccuccguuacggcaacguacucgacgucaacgcaaucgacaucgaagaaccaagcgggcaaacagcagacugguacaccaucggcgucuacgucauaggauucacccuccccauaauacucaaagcacucuacaugcuaagcacccgaggccgccaaacugucaaagaaaacaaaggaacacgaauccgauucaaagacgacaccuccuucgaagacaucaacggcauccgccgccccaaacaccuauacgucucaaugccaaccgcccaauccaccaugaaagccgaagaacucacacccggcagauuccgcaccaucgucugcggccucuuccccacccaaauccaaguacgaaacaucauguccccagucaugggcgucaucggcuucucauucuucgucaaagacuggcccgaacgcauccgagaguucauggaaaaagaaugccccuucauaaaacccgaagucaaacccggcauaccagcacaagaaaucgaaaugcucaagaaaaacaaaauauacuucaugcaccgccaagacguacucgacaaaaaccacgucgccgacaucgacaaacuaaucgacuacgccgccucaggcgacccaaccucccccgacaacaucgacagccccaacgcacccugggucuucgcgugcgcccccgaccgcugcccacccacaugcaucuacgucgccgggauggccgaacuaggcgcguucuucuccauccuacaagacaugcgaaauaccaucauggcauccaaaaccgucggaaccgcagaagaaaaacucaaaaagaaaucguccuucuaccaaucguaccuccgacgcacccaaagcaugggcauacaacucgaccaacgcaucauacuccuauacaugcuagaauggggaaaagaaauggucgaccacuuccaccucggcgacgacauggaccccgaacuccgcggacucgcccaagcacuaaucgaccagaaagugaaagaaauauccaaccaagaaccccucaaaaucuaa

SEQ ID NO: 7834 - RNA, 1302 nt, Artificial Sequence
  derived and/or modified CDS sequence (opt11) from PUUV(CG17/Baskiria-2001)__AF442613.1__N
auguccgaccuagccgauauacaagaagaaauaacccgccacgaacaacagcuagucgcagcucgacaaaaacuaaaagacgccgaacgugccguggaagucgaccccgacgacguaaacaaaaacacccuacaagcacgccaacaaacggucagcgcacuggaagacaaacucgcggacuacaaacgccggauggcagacgccguaucccgcaagaaaauggacaccaaaccaacagaccccacaggcauagaaccagacgaccaccucaaagaacgcagcagccuccgcuacggcaacguacucgacguaaacgcaaucgacauagaggaaccauccggccaaacggccgacugguacacuaucggggucuacgugauaggcuucacgauacccauaauccucaaagcccuauacaugcucuccacccgcggcagacaaaccgucaaagagaacaaaggcacccgcauccgcuucaaagacgacaccucauucgaggacauaaacggaaucagaagacccaaacaccucuacguauccaugccaacagcucaaucaaccaugaaagccgaggaacucacccccggccgauuccgcaccaucguaugcggacucuuccccacccaaauccaaguccgaaacaucaugagccccgucaugggcgucaucggcuucucauucuucgucaaagacuggcccgagaaaauccgagaguucauggaaaaagaaugccccuucauaaagcccgaagucaaacccggcacacccgcacaagaagucgaguuccucaaacgcaaccgcguauacuucaugacccgccaagacgugcuagacaaaaaccacgucgccgacauagacaaacucaucgacuacgcagccucaggcgaccccacaagccccgacgacaucgaaucaccgaacgcccccuggguauucgccugcgcccccgaccgaugcccacccacaugcauauacguagccggaauggcggaacucggcgcauucuucagcauccuccaagacaugcgcaacaccaucauggcaagcaaaaccguaggcacagccgaagaaaaacuaaagaagaaaucauccuucuaccagucauaccuccgccgcacccaaucaaugggcauccaacuagaccagcgcauaauccuccucuacaugcuagaauggggaaaagaaaugguagaccacuuccaccucggagacgacauggaccccgaacuacgaggacuagcgcaaucccucaucgaccaaaaagucaaagaaaucuccaaccaagaaccacuaaaaauauaa

SEQ ID NO: 7835 - RNA, 1302 nt, Artificial Sequence
  derived and/or modified CDS sequence (opt11) from PUUV(CG215)__AF367066.1__N
augucagaccucacagacauccaagaagacaucacccgucacgaacaacaacucgucgccgcccgacaaaaacucaaagacgcagaacgcgccgucgagauggaccccgacgacgucaacaaaaacacacuacaagcucgacaacaaaccgucagcgcccucgaagacaaacuagccgacuacaaacgccgaauggccgacgcaguaucccgcaagaaaauggacacaaaacccgccgaccccaccggcaucgaacccgacgaccaccucaaagaacgauccucccuccgcuacggaaacguucucgacgucaacgcaaucgacaucgaagaaccauccggccaaaccgcagacugguacaccaucggcguuuacguaaucggcuucacccuccccauaauccuaaaagcccuuuauaugcucuccacacgaggacgccaaaccgucaaagaaaacaaaggcacacgcauacgauucaaagacgacaccucuuucgaagacaucaacggcauccgccgaccuaaacaccucuacgucucaaugcccacagcccaaagcaccaugaaagccgaagaacucacccccggccgauuccgcaccauaguaugcggacucuucccaacccaaauacaaguccgcaacaucaugucccccgucaugggcguaaucggcuucuccuucuucgucaaagacuggcccgaacgcaucagagaguucauggaaaaagaaugccccuucauaaaacccgaagucaaaccgggaaccccagcccaagaaauagaaaugcuaaagaaaaacaaaaucuacuucaugcaccgccaagacguucucgacaaaaaccacgucgccgacaucgacaaacucaucgacuacgccgcaagcggagacccaaccucacccgauaauaucgacagcccaaacgcucccuggguauucgccugcgcacccgaccgcugcccaccaaccugcaucuacgucgcaggcauggccgaacuaggcgcauucuucuccauccuacaagacaugcgcaacaccaucauggccucaaaaacaguagggaccgcagaagaaaaacucaaaaagaaaagcucauucuaccaguccuaccuaagaagaacacaauccaugggaauccaacucgaccaacgcaucauacuacucuacaugcucgaaugggggaaagaaauggucgaccacuuccaccugggcgacgacauggaccccgaacuacgcggacucgcccaaacacuaauagaccaaaaaguaaaagaaauauccaaccaagaaccccuaaaaauauag

SEQ ID NO: 7836 - RNA, 1302 nt, Artificial Sequence
  derived and/or modified CDS sequence (opt11) from PUUV(CG315)__AF367068.1__N
augucagaccucacagacauccaagaagacaucacacgccacgaacaacaacucgucgcagcacggcaaaaacugaaagacgcugaacgcgccgucgaaauggaccccgacgacgucaacaaaaacacccuccaagccagacaacaaaccguguccgcucuagaagacaaacuagccgacuacaaacgccgaauggcagacgccgucucacgaaagaaaauggacacaaaacccgccgaccccacaggaauagaacccgacgaccaccucaaagaacgaucaagccuucgcuacggcaacguacuagacguaaacgccauagacaucgaagaacccuccggccaaaccgccgacugguacacaaucggcguauacgucauuggauuuacccuccccaucauccucaaagcccuauacaugcuaucaacccgcggacgccaaacagucaaagaaaacaaaggaacccgcauccgauucaaagacgacaccuccuucgaagacaucaacggcauccgccgcccaaaacaccuauacguauccaugcccaccgcccaauccaccaugaaagccgaagaacuaacaccaggccgcuucagaaccaucguaugcggccucuuccccacccaaauacaaguacguaacaucaugucccccgucaugggggucaucggcuucuccuucuucgucaaagacuggcccgaacgcauccgcgaguucauggaaaaagaaugccccuucaugaaacccgaaguaaagcccggcaccccggcccaagaaaucgaaaugcucaagaaaaacaaaaucuacuucaugcaccgccaagacguccuagacaagaaccacgucgccgauaucgacaaacuaaucgacuacgccgcuucaggagaccccaccucacccgacaacaucgacucccccaacgcacccuggguguucgccugcgcgcccgaccgcugcccaccaaccugcaucuacgucgcagggauggcagaacuaggagccuucuucuccauacuccaagacaugagaaacacaaucauggcauccaaaacuguaggcacagccgaagaaaaacugaaaaagaaaucgucuuucuaccaauccuaccuacgccgcacacaauccaugggaauacaacucgaccaacgaaucauccuccuauacaugcuagaauggggaaaagagaugguagaccacuuccaccuaggcgacgauauggaccccgaacuccggggccuagcccaagcccucaucgaccaaaaagucaaagaaaucagcaaccaagaacccuuaaaaaucuaa

SEQ ID NO: 7837 - RNA, 1302 nt, Artificial Sequence
  derived and/or modified CDS sequence (opt11) from PUUV(CRF161)__AF367069.1__N
augucagaccucaccgacauccaagaagacauaacacgccacgaacaacagcuagucgccgcccgccaaaaacucaaagacgccgagcgagccguugaaauggacccggacgaugucaacaaaaacacccuccaagcccgacaacaaaccgucucagcacuagaagacaaacuagccgacuacaaacgacgaauggccgacgccgucucccguaagaaaauggacaccaaacccgccgaccccaccggcaucgagccagacgaccaccucaaagagagauccucccugcgcuacggcaacguccucgacguaaacgccauagacaucgaggaaccaagcggacaaaccgccgacugguacaccauaggcgucuaugucaucggauucacucuaccaauaauccucaaagcccucuacaugcucuccacccgaggccgccaaacagucaaagaaaacaagggcaccaggauacgcuucaaggacgacacauccuucgaagacaucaacggcauccgcagacccaaacaccucuacguauccaugccgaccgcccaauccaccaugaaagccgaagaacugacacccggacgauuccgcacaauagucugcggacuauuccccacucaaauccaaguccgcaacauaaugucccccgucaugggaguaaucggcuucuccuucuucguaaaagacuggccagaacgcauccgagaguucauggaaaaagaaugcccauucaucaaaccagaagucaaaccuggcacccccgcccaagaaauagaaaugcuaaagaaaaacaaaaucuacuucaugcacagacaagacguacuagacaaaaaccacgucgccgacaucgacaaacucauagauuacgccgcaucaggcgaccccacguccccagauaacaucgacagccccaacgcacccugggucuucgcaugcgcaccagaccgaugcccaccaaccugcaucuacgucgcagguauggccgaacuaggagccuucuucuccauccuccaagauaugcgcaauacaauaauggcauccaaaaccgucggaacagcagaagaaaaacugaagaagaaauccuccuucuaccaauccuaccuccgacgaacccaaucaaugggcauccaacuagaccaacgcaucauacuccucuacaugcucgaauggggcaaagaaauggucgaccacuuccaccuaggagacgacauggaccccgaacuccgcggccucgcccaagcccucaucgaccaaaaaguuaaagaaaucagcaaccaagaaccccuaaaaauauaa

SEQ ID NO: 7838 - RNA, 1302 nt, Artificial Sequence
  derived and/or modified CDS sequence (opt11) from PUUV(CRF308)__AF367070.1__N
augagcgaccuuaccgacauccaagaagacauaacacgccacgaacaacaacucguagcagcacgccagaaacuaaaagacgccgaaagagccgucgaaauggacccagacgacgucaacaaaaacacacuucaagcccgccaacaaaccgucagcgcccucgaagacaaacucgcagacuauaaaagacgaauggccgacgcagucucccgaaaaaaaauggacaccaaacccgcagacccaaccggaaucgaacccgaugaccaccucaaagaaagauccucccuccgcuacggcaacguccuggaugucaacgcuauagacauagaagaacccagcggacaaaccgcagacugguacacaaucggcgucuacguaaucggauucacccuacccaucauacuaaaagcccucuauaugcucuccaccagagggcgucagaccguaaaagaaaauaaaggcacacgcauacgauucaaagacgacaccagcuucgaagacauaaacggcauacgccgacccaaacaccuuuacgucagcaugccaacagcucaaucaacaaugaaggccgaagaacucacccccggacgcuucaggacaaucguaugcggccucuuccccacccaaauccaggucagaaacaucaugucacccguaaugggagucaucggauucuccuucuucgucaaagacuggcccgaacggauccgagaauucauggaaaaagagugcccuuucaucaaaccagaaguaaaacccggcacgcccgcgcaagaaaucgaaaugcucaaaaaaaacaaaaucuacuucaugcaccggcaagacguccuagacaaaaaccacgucgccgacauggacaaacucaucgacuacgccgcaagcggcgacccaaccucacccgacaacaucgacucaccuaacgcccccugggucuucgccugcgcaccagacagaugcccaccgaccugcaucuacgucgcaggcauggcagagcuuggugccuucuucucgauccuacaagacaugcgcaacaccaucauggccuccaaaaccgucggcacagccgaagaaaaacucaaaaaaaaauccucauucuaccaaagcuaccuccgacgaacccaaucaaugggaauacaacucgaccaacgaaucauccuccucuacaugcucgaguggggcaaagagauggucgaccacuuccaccucggagacgacauggacccagaacuaagaggacucgcccaggcauuaaucgaccaaaaagucaaagaaaucuccaaccaagaaccccucaaaaucuaa

SEQ ID NO: 7839 - RNA, 1302 nt, Artificial Sequence
  derived and/or modified CDS sequence (opt11) from PUUV(CRF366)__AF367071.1__N
augaccgaccuaacagacauccaagaagacauaacacgacacgaacaacaacucgucgccgcacgccaaaaacucaaagacgccgaacgagccguagaaauggaccccgacgacgucaacaagaacacacuacaagcacgacaacaaacaguaucagcacucgaagacaagcuagccgacuacaagcgccgaauggccgacgccgucagccgcaagaaaauggacacaaaacccgccgaccccacaggaauagaacccgacgaccaccugaaagaacgcucaagccuccgauacggaaacguccuagacguaaacgccaucgacaucgaagaacccucaggccaaaccgccgacugguacacaaucgguaucuacgucaucggcuucacccuccccaucaucuuaaaagcacucuacaugcucagcacacgaggacgccaaaccgucaaagaaaacaaaggaacccgcauccgcuucaaagacgacaccagcuucgaagacaucaacggcauccgcagacccaagcaccuuuacguauccaugcccacagcacagagcaccaugaaagccgaagaacuuacccccggccgcuuccgcacaaucgucugcggcuuauucccaacccaaauccaaguccgcaacaucaugagccccguaaugggcgucaucggcuucagcuucuucgucaaagacuggcccgaacgcauacgcgaguucauggaaaaagaaugccccuucaucaaaccggaaguuaaaccaggcacacccgcccaagaaaucgaaaugcuaaagaaaaacaaaaucuacuucaugcaccgccaagacguccucgacaaaaaccacgucgcagacaucgacaaacuaaucgacuacgcagccuccggugacccaaccucccccgacaacaucgacucaccuaauaccccauggguauucgccugcgcccccgaccgaugcccaccaaccugcaucuacgucgcgggaauggccgaacucggcgcauucuucagcauccuccaagacaugcgaaacaccaucauggccucaaaaacagucggcaccgcugaagaaaaacucaaaaagaaauccuccuucuaccaauccuaccucagacgcacccaauccaugggcauccaacucgaucaacgcaucauccuacuuuacaugcucgaauggggcaaagaaauggucgaccacuuccaccucggcgacgacauggaucccgaacuccgcggccuagcccaggcccucaucgaccaaaaagucaaagaaaucagcaaccaagaaccccucaaaaucuaa

SEQ ID NO: 7840 - RNA, 1302 nt, Artificial Sequence
  derived and/or modified CDS sequence (opt11) from PUUV(Djaknebole_98-1)__AM746310.1__N
augucagaccugaccgacauccaagaagacaucacgcgccacgaacaacaacucguagucgcacgacaaaaacucaaagacgcggaaaaagccguggaaauggacccggacgacguaaacaaaaacacccuacaagcgcgccaacaaacagucuccgcacucgaagacaaacucgcugacuucaaacgccgcauggcggacgccgucucccgcaaaaaaauggacaccaaacccaccgaccccacaggaaucgaacccgacgaccaccuaaaagagcgcuccucacucagauacggcaacguccucgacgucaacgccaucgacauagaagaaccaucaggccaaaccgccgacugguacaccaucggcgucuacgucaucggcuucacccucccaaucauacucaaagcccuguacaugcucagcaccagaggccggcaaaccgucaaagaaaacaaaggcacccgaauccgcuucaaagacgacacaucauucgaagacaucaacggcauccgccggccgaaacaccuauacgucucuaugcccaccgcacaguccacaaugaaagccgaagaacucacaccaggccgcuucagaacaaucgucuguggccucuuccccacccaaauccaaguacgaaacaucauguccccagucaugggagucaucggauucagcuucuucgucaaagacugggccgaccgaaucagagaauucauggaaaaagaaugcccauucaucaaaccggaagucaaaccaggaaccccgacccaagaaauagaauuccuuaaaaaaaacaaagucuacuucauggaccgccaaaacguacucgacaagaaccacguagcugacaucgacaaacucauagacuacgcagcuagcggcgaccccacauccccagacaacauagaguccccgaacgcacccugggucuucgccugcgcccccgaccgaugcccccccaccugcauauacguagccggcauggcagaacucggcgccuucuucuccauccuccaagacaugcgcaacaccauaauggccagcaaaaccgucggcaccgccgaggagaaacuaaaaaaaaaauccagcuucuaccaguccuaccuccgccgaacccaaagcaugggcauacaacuagaccaacgaauaauacuccucuacaugcucgaauggggcaaagaaauggucgaccacuuccaccucggcgacgacauggaccccgaacucagaggccuagcacaagcacucauagaccaaaaaguaaaagaaaucagcaaccaagacccacuaaaaaucuaa

SEQ ID NO: 7841 - RNA, 1302 nt, Artificial Sequence
  derived and/or modified CDS sequence (opt11) from PUUV(Fusong 114-05)__EF488804.1__N
auguccgaccucaaagacauucaagaagacauagcccgccacgaacaacagcuaguaguagcacgacaaaaacuccgggacgccgaaaaagccguagaaauggacccagacgacgucaauaaaaacacccuccaagcccgccaacaaacagucucagcccucgaagacaaaauagcagacuucaaacgccgcauggcagacaucgucagccgcaagaaaauggacacaaaacccgcagacccaacaggcaucgaacccgacgaccaccugaaagaacgcucgucccuccgcuacggcaacguacuagacgucaacgcaaucgacaucgaagaacccagcggccaaacagcggacugguacaccauuggcguauacauaauagaguucacccuccccaucauacuaaaagcccuauacaugcucagcacacgaggccgacaaaccgccaaagaaaacaaaggcacccgcauccgauucaaagacgacaccuccuucgaagacgucaacggcauccgccgacccaagcaccuauauguauccaugcccaccgcgcaaucaacaaugaaagcagaagaacuaaccccaggacgcuuucgcacaauagucugcggccucuuccccacccaaauacaaguucgaaacaucaugucccccgucaugggcguaaucggcuucagcuucuucgccaaagacuggccagaccgaaucaaagaguucauggaaaaagaaugccccuucaucaaacccgaagugaaaccagggacacccgccaaagaaguagaaauccucaaacgcaacaaaaucuacuucaugcaaagacaaggcguucucgacaaaaaccacguccccgacaucgacaaacucauagacuacgccgccuccggcgacccaaccagcccccgcaacaucgacucccccaacgcacccugggucuucgccugcgcccccgaccgcugcccaccgacgugcaucuacgucgcaggcauggccgaacucggggccuucuucuccauccuccaagacaugcgcaacaccaucauggccuccaaaacugucggcaccgccgaagaaaaacucaaaaagaaauccuccuucuaccaaagcuaccuucgacgcacccaauccaugggaauacaacucgaccaacgcauuauccuacucuacaugcuugaauggggaaaagaaauggucgaccacuuccaccucggagacgacauggacccugaacuccgcucacucgcccaagcgcucaucgaccaaaaaguaaaagaaaucuccaaccaagaaccacuaaaaauauag

SEQ ID NO: 7842 - RNA, 1302 nt, Artificial Sequence
  derived and/or modified CDS sequence (opt11) from PUUV(Fusong 199-05)__EF488803.1__N
auguccgaccucaaagacauccaagaagacaucgcaagacacgaacaacagcucgucgcagcccgacagaaacuacgggacgccgaaaaagccgucgaaauggaccccgacgacguuaacaaaaacacacuccaagcccgccaacaaacagucucagcccucgaggacaaaaucgcagacuucaaacgccgaauggccgacaucguaucccgcaagaaaauggacaccaaacccgcagaccccaccggcaucgaacccgacgaccaccuaaaagaacgcucaagccuacgcuacggcaacguccuagacguaaacgccauagacaucgaagaacccagcggccaaaccgcggacugguacacaauaggcguauacaucaucggcuucacccuccccaucauacuaaaagcccucuacaugcucucaacccgcggccgacaaacugucaaagagaacaaaggaacccgcaucagauucaaagacgacaccagcuucgaagauguaaacggcauccgccggcccaaacaccucuacgucagcaugcccaccgcacaauccacaaugaaagccgaagaacucacccccggccgauuccgcaccaucgucugcggccucuuccccacccaaauccaaguacgcaacaucaugagccccgucaugggcguaaucggcuucuccuucuucgccaaagacuggccagaccguaucaaagaguucauggaaaaagaaugcccauucaucaaacccgaagucaaaccaggaacacccgccaaagaagucgaaauccuaaaacgcaacaagaucuacuucaugcaacgccaagacguccuagacaaaaaccacguccccgacaucgacaaacucauagacuacgcagccuccggagaccccacaucacccgaaaacaucgacucaccaaacgcgccaugggucuucgccugcgcaccagaccgaugcccaccaaccugcauauacgucgccggcauggccgaacuaggcgccuucuucucaauacuacaggacaugcgcaacaccauaauggcauccaaaaccgucggcaccgccgaagaaaaacuaaagaagaaaagcuccuucuaccaaucuuaccucagacggacccaauccaugggcauccaacuagaccaacgaaucauucuccuauacaugcucgaauggggaaaagaaaugguagaccacuuccaccucggagacgauauggaccccgaacuccgaucguuagcacaagcccugaucgaccaaaaagucaaagaaauauccaaccaagaaccccuaaaaaucuaa

SEQ ID NO: 7843 - RNA, 1302 nt, Artificial Sequence
  derived and/or modified CDS sequence (opt11) from PUUV(Fusong 200-05)__EF211820.1__N
augagcgaccucaaagacauccaagaagacaucgcccgacacgaacaacaacucguagucgcacgccaaaaacuccgcgacgcagaaaaagccgucgaaauggaccccgacgacguaaacaaaaacaccuuacaagcccgacaacaaacggucucagcccucgaagacaaaauagcagacuucaaacgccgcauggccgacaucgucagccgcaaaaaaauggacacaaaaccagccgaccccacaggaaucgaacccgacgaccaccucaaggaacgcuccagccugcgcuacggcaacguacucgacguaaacgcaaucgacaucgaagaaccuucaggccaaacggcagacugguacaccauaggcgucuacauaauaggcuucacacuacccaucauccucaaagcacuauacaugcucucgacccgcggacgccaaaccguaaaagaaaacaaaggcacccgcauacgcuucaaagacgacacauccuucgaagacguuaauggaauccgccgaccaaaacaccucuaugucuccaugcccaccgcacaaagcaccaugaaagcagaagagcuaaccccaggacgcuuccgcacaaucgucugcggccucuucccaacccaaauacaaguccgcaacaucauguccccagucaugggagucaucggcuucuccuucuucgcaaaagacuggccagaccgcaucaaagaauucauggaaaaagaaugccccuucaucaaaccagaaguaaaacccggaacccccgccaaagaaguggaaauccucaaacgcaacaaaaucuacuucaugcaacgccaagacguccuagacaaaaaccacguacccgacaucgacaaacucauagauuaugccgcuuccggcgacccaaccucccccgaaaacaucgacagcccaaacgcccccugggucuuugccugcgcacccgaucgcugcccccccaccugcaucuacgucgccggaauggcagaacucggagccuucuucagcauccuccaagacaugcgcaacacaaucauggcuuccaaaacagucggcacagcagaagaaaaacugaaaaaaaaaucaucauucuaccaauccuaccuacgccgaacacaaucaaugggaauccaacucgaccaacgaauaauccugcucuacaugcuagaauggggaaaagaaauggucgaccacuuccaccucggugacgacauggaccccgagcucagaucccucgcccaggcccucaucgaccaaaaaguaaaagaaauauccaaccaagaaccccucaaaaucuaa

SEQ ID NO: 7844 - RNA, 1302 nt, Artificial Sequence
  derived and/or modified CDS sequence (opt11) from PUUV(Fusong 900-06)__EF488806.1__N
auguccgaucucaaagacauacaagaagacauagcccgccacgaacaacaacuugucgucgccaggcagaaacuccgagacgcagagaaagccgucgaaauggaccccgacgacguaaacaaaaacacacuacaagcccgccaacaaaccgucucagcccucgaagacaaaaucgccgacuucaaacgacgaauggcggacaucgucagccgcaaaaagauggacaccaaacccgccgaccccacaggcaucgaacccgacgaccaccucaaagaacgauccucacuccgcuacggcaacguacuagacguuaacgccauagacaucgaagaaccaucuggccaaaccgccgacugguacaccaucggagucuacaucaucggcuuuacacugccaauaauccucaaagcccuauacaugcuauccacccgcggccgucaaaccgucaaagaaaacaaaggaacccgaauccgcuucaaagacgacaccagcuucgaagacguaaacggcauccgacgacccaaacaccucuacgucucaaugcccaccgcacaaucaaccaugaaggccgaagaacuaaccccaggcagauuccguacaaucgucugcggccucuucccaacacaaauccaaguccgaaauaucaugucccccguaaugggcguaaucggauucuccuucuucgccaaggacuggcccgaccgcaucaaagaguucauggaaaaagaaugccccuucaucaaacccgaaguaaaacccggaacccccgccaaagaaguagaaauacuaaaacgcaacaaaaucuacuucaugcagcgacgagacguccucgacaaaaaccacguacccgacauagacaaacucauagacuacgccgccagcggcgacccaacaucccccgaaaacaucgacucccccaacgccccaugggucuucgccugcgcccccgacagaugcccaccaaccugcauauacgucgcaggcauggccgaacuaggcgccuucuucuccauacuccaagacaugcgaaacacaaucauggccuccaaaaccguaggcacggccgaagaaaaacucaaaaagaaaagcagcuucuacaaauccuaccuaagaagaacccaaucaaugggcauacaacucgaccaacgcaucauccuccuauacaugcucgaauggggcaaagagaugguagaccacuuccaccucggugacgacauggaccccgaacuacgcucacucgcccaagcccuaaucgaccaaaaagugaaagaaaucagcaaccaagaaccccucaaaaucuag

SEQ ID NO: 7845 - RNA, 1302 nt, Artificial Sequence
  derived and/or modified CDS sequence (opt11) from PUUV(Gumboda_98-2)__AM746316.1__N
augucggaccucacagacauccaagaagacauaacccggcacgaacaacaacucgucguagccagacagaaacucaaagacgccgaaaaagcagucgaaauggaccccgacgacgucaacaaaaacacgcuccaagcacgccaacaaacagucuccgcccuagaagacaaacucgccgacuucaaaagacgaauggccgaugccguuucacgcaagaaaauggacaccaaacccacugacccuaccggcauagaaccagacgaccaccucaaagaacgaucaucccuccgcuacggcaacguacuggacgucaacgccaucgacaucgaagaaccauccggccaaaccgccgacugguauacuaucggcguauacgucaucggauucacacuacccaucauccucaaagcccucuacaugcuauccacccgcggccgccagaccgucaaagaaaacaaaggcacccgaauacgcuucaaagacgacaccuccuucgaagacaucaacggcauacgccgccccaaacaccuauacgucagcaugcccacagcgcaaucaaccaugaaagccgaagaacuuaccccgggacgcuuccgcacaaucgucugcggacuauucccaacccaaauacaaguacgcaacaucauguccccaguuaugggagucaucggcuucagcuucuucgucaaagacugggccgaccgaauacgcgaguucauggaaaaagaaugccccuucaucaaacccgagguaaaacccggcacacccacacaagaaauagaguuccuaaagaaaaacaaagucuacuucauggacagacaaaacguacuagagaaaaaccacguggcagacaucgacaaacucauugacuacgccgccuccggcgaccccaccucccccgacaacaucgaaucccccaacgcccccugggucuucuccugcgcacccgaccgcugcccaccaaccugcauauacguagccggcauggcagaacuaggcgccuucuucagcauacuccaagauaugcgcaacaccaucauggccuccaaaaccgucggcaccgccgaagaaaaacucaaaaagaaauccuccuucuaccaauccuaccuccgccgcacccaaucaaugggcauacagcucgaccaacgaaucauacuccucuacaugcucgaauggggaaaagaaauggucgaccacuuccaccucggcgacgacauggaccccgaacuccgaggccuagcccaagcccucaucgaccaaaaagucaaagaaaucuccaaccaggacccccucaaaauauaa

SEQ ID NO: 7846 - RNA, 1302 nt, Artificial Sequence
  derived and/or modified CDS sequence (opt11) from PUUV(Gumboda_98-4)__AM746318.1__N
auguccgaccuaaccgacauccaagaagacaucaccagacacgaacaacaacucgucgucgcacgccagaaacucaaagacgccgaaaaagccgucgaaauggaccccgacgacguaaacaaaaacacccugcaagccagacagcaaaccguaucagcccuagaagacaaacucgcggacuucaaacgacgaauggccgacgcagucucccgaaagaaaauggacacaaaacccaccgaccccaccggcaucgaacccgacgaccaccuuaaagagcgcucaucccuccgcuacggcaauguccuggacgucaacgccaucgacaucgaagaacccuccggccaaaccgccgacugguacaccauaggaguauacguaaucggauucacgcuccccauuauccucaaagcccuauacaugcuauccacacgcggccgccaaaccgucaaagaaaacaaaggcacccggauccgcuucaaagacgacaccucguucgaagacaucaacggaauacgcagaccuaaacaccucuacgucucaaugcccaccgcucaaucuaccaugaaagccgaggaacuaacacccgggcgauuucgaaccaucgucugcggccuguuccccacccaaauccaaguacgaaacaucaugucgcccguuaugggcgucaucggauucuccuucuucgucaaagacugggccgacagaauccgagaguucauggaaaaagaaugccccuucaucaaaccagaagucaaacccggcacacccacccaagaaaucgaguuccuuaagaaaaacaaaguauacuucauggacagacaaaacguccucgacaaaaaccacgucgccgacaucgauaaacucaucgacuacgccgccuccggcgaccccaccucccccgacaacaucgaaucccccaacgcccccugggucuucagcugcgcaccagaccgcugcccaccaaccugcauauacgucgccggcauggcagaacucggcgcauuuuucuccauccuccaagacaugcgaaacaccaucauggcauccaagacagucggcaccgccgaagaaaaacuaaagaagaaauccagcuucuaccaauccuaccuacgcagaacccaaagcaugggcauacaacuagaccaacgcaucauccucuuauacaugcucgaauggggcaaagaaauggucgaccacuuucaccuaggagacgacauggaccccgaacuccgcggccucgcacaagcacuaaucgaccaaaaagucaaagaaaucuccaaccaggacccccuaaaaauauaa

SEQ ID NO: 7847 - RNA, 1302 nt, Artificial Sequence
  derived and/or modified CDS sequence (opt11) from PUUV(Kamiiso-8Cr-95)__AB010730.1__N
augucugaccuaaaagacauacaagaagacaucacccgccacgaacaacaacucguaguagcacgccaaaagcuccgagacgcagaaaaagccgucgaaauggaccccgacgacgucaacaaaaacacccuccaagcccgacaacaaaccgucucagcacuagaagacaaacuagcagacuucaaacgucgcauggccgacgucguaucccgaaagaaaauggacaccaaaccagccgaccccacgggaauagaaccagacgaccaccucaaagaacgcuccucccuacgcuacggaaacguccucgacgucaacgccaucgacauagaagaacccagcggccaaacagccgacugguacaccaucggggucuacauuaucggauucacccuccccaucauccucaaagcccuauacaugcucucaacccgaggccgacaaacagucaaagaaaacaaaggaacccgcauacgcuucaaagacgacacauccuucgaagacauaaauggcauacgccgccccaaacaccucuacgucagcaugcccaccgcccagucaacaaugaaagccgaagagaucacccccggacgcuuccgcacaaucgucugcggccucuuccccacacaaauccaaguccgcaacaucaugagccccgucaugggagucauaggcuucuccuucuucgucaaggacuggccagaacgaauaaaagaguucauggaaaaagaaugccccuucaucaagcccgaaguuaagcccggcaccccagccaaagaaguggaaauccucaaacgcaacaaagucuacuucaugcaacgccaagacguacucgacaaaaaccacguccccgacauugacaaacuaaucgacuacgccgcaucgggcgacccaaccucacccgacaacaucgacagccccaacgcccccugggucuucgccugcgccccagaccgaugcccacccacauguauauacguggccggcauggcagaauuaggcgccuucuucagcauccuacaagacaugcgcaacacaaucauggccuccaaaaccguaggaaccgccgaagaaaaacugaaaaagaaaagcuccuucuaccaauccuaccuccgcagaacccaauccaugggcauccaacucgaccaaagaauaauccuccuguacaugcuagaauggggcaaagagauggucgaccacuuccaccucggcgacgacauggaccccgaacuccggggccucgcccaagcacuaauagaccaaaaagucaaagaaauauccaaccaggaaccccucaaaaucuaa

SEQ ID NO: 7848 - RNA, 1302 nt, Artificial Sequence
  derived and/or modified CDS sequence (opt11) from PUUV(Mu/07/1219)__KJ994776.1__N
auguccgaccucaccgacauacaagaagacauaacccgccacgaacagcaacugguaguggcccgccaaaaacuaaaagacgccgaaaaggccguggaaauggaccccgacgacguaaacaaaaacacccuccaagcuagacaacaaacggucucagcccuagaagacaaacuagcagacuacaaacgccgcauggccgacgcagucucacgaaagaaaauggacaccaaacccacagacccaaccggcauagaaccagacgaccaccuaaaagaacgauccagccuccgcuacggcaacguccucgacgucaacgcaaucgacauagaagaaccaagcggccaaaccgccgacugguacaccaucggcguuuacgucaucggcuucacccuaccaauaauccuuaaagcccuauacaugcucucaacccgcggccgccaaaccgucaaagaaaacaaagggaccagaaucagauucaaagacgacaccagcuucgaagacaucaacggcaucagaagaccaaaacaccuauacgucuccaugccgacagcccaaucaaccaugaaagcagaagaacuuacccccggacgcuucagaaccaucguaugcggccuguucccaacccaaauccagguccgaaacaucaugagcccagucaugggaguaaucggauucuccuucuucguaaaagacugggccgaacgcauccgcgaguucauggaaaaagaauguccauucauaaaacccgaaguaaaacccggaacgcccgcccaagaagcggaguuccucaaacgcaacaaagucuacuucaugcaacgccaagacguucucgauaaaaaccacguagccgacauagacaaacucauagauuaugcagccucuggcgaccccaccuccccagacaacaucgaaagccccaacgcccccugggucuucgcaugcgcccccgaccgaugcccacccacaugcauauacgucgccggaauggcagaacucggagcauucuucagcauccuccaagacaugcgcaacaccaucauggcauccaaaaccgucggcacagcagaagaaaaacucaaaaagaaauccaguuuuuaccaauccuaccugcgcagaacccaaagcaugggcauacaacucgaccaacgcaucauacuccucuacaugcucgaauggggaaaagaaauggucgaucacuuccaccucggcgacgacauggaccccgaacuaagaggacuagcccaagcccuaaucgaccaaaaggucaaagaaaucucaaaccaagaaccccugaagaucuaa

SEQ ID NO: 7849 - RNA, 1302 nt, Artificial Sequence
  derived and/or modified CDS sequence (opt11) from PUUV(Opina916)__AF294652.1__N
auguccgaccucaccgacauacaagaagacauaaccagacacgaacaacaacucgucgucgcccgccaaaaacuaaaagacgcagaaaaagccgucgaaauggaccccgacgacgucaauaaaaacacccuccaagcacgacaacaaaccguaucggcccucgaagacaaauuagccgacuucaaacgccgaauggcggacgccgucucaagaaaaaaaauggacacaaaacccguagacccaaccggcaucgaacccgacgaccaucuaaaagaacgaagcucucuaagauacggcaacguacucgacgucaacgccaucgacaucgaagagcccagcggccaaacagccgacugguacaccaucggcgucuacgucaucggauucacccuccccauaauccuaaaagcccuauacaugcucuccacacgcggccgacaaaccgucaaagaaaacaaaggcaccagaaucagauucaaagacgacaccaguuucgaagacauaaacggaauacgcagaccaaaacaccuuuacgucucaaugcccaccgcacaauccaccaugaaagccgaagaacucacccccggccgcuuccgcaccaucguaugcggacuauucccaacccaaauccaaguccgcaacauaaugagccccguuaugggcguaauaggcuucuccuucuucgucaaagacugggccgaacgcauccgagaauucauggaaaaagaaugcccauucauaaagcccgaagugaaacccggaaccccagcgcaagaagccgaauuccucaaaaaaaaccgcaucuacuucaugcaacgccaggaaguccuagacaaaaaucacguggccgacaucgacaaacuuaucgacuacgcagccuccggagacccaacauccccagacaacaucgaauccccaaacgccccauggguauucgccugcgcccccgaccggugcccccccaccugcaucuacgucgccggcauggcagaacucggcgccuucuucucaauccuccaagacaugcgcaacaccaucauggcaagcaaaaccgucggcaccgccgaagaaaaacucaaaaaaaaauccuccuucuaccaauccuaccuccggcgaacacaaagcaugggcauccagcuagaccaacgcauaauucuacucuacaugcucgaauggggcaaagaaauggucgaccacuuccaccucggagacgacauggaccccgaacuccgaggccucgcccaagcacuaaucgaccaaaaagucaaagaaaucucaaaccaagaaccacuaaaaaucuga

SEQ ID NO: 7850 - RNA, 1302 nt, Artificial Sequence
  derived and/or modified CDS sequence (opt11) from PUUV(Palbole_98-1)__AM746327.1__N
augagcgaccucacggacauucaggaagacaucacaugccacgaacaacaacucgucgucgcccgccaaaaacucaaagacgccgaaaaagccguagaaauggaccccgacgacgucaacaaaaacacacuccaggcccgucaacaaaccgucagcgcacucgaagacaaacuagccgacuucaaacgccgcauggcagacgccguauccagaaaaaaaauggacaccaaacccaccgaccccaccggcaucgaaccagacgaccaccucaaggaaagaucgucucuccgcuacggcaacguccuagacgucaacgccauagacaucgaagaacccuccggacaaacagccgacugguacaccaucggagucuacgucaucggcuucacucucccaaucauacucaaagcccuauacaugcucuccacaagaggacgccaaaccgucaaagaaaacaaaggcaccagaaucagguucaaagacgauaccuccuucgaagacaucaacggcauacgccgccccaaacaucuuuacgucucaaugcccaccgcacaauccacaaugaaagccgaagaacucacacccggacgcuuccgcaccauagucugcggccuauuccccacacaaauccaaguccgcaacaucauguccccagucaugggcgucauaggcuucaguuucuucgucaaagacugggcagaccgaaucagagaauucauggaaaaagaaugccccuucauaaaacccgaagucaagccaggcaccccaacucaagaaaucgaauuccucaaaaaaaacaaagucuacuucauggaccgccaaaacguacucgacaaaaaccacgucgccgacaucgacaaacucaucgacuacgccgcaagcggcgaccccaccagccccgacaauauagaaucccccaacgcccccuggguauucgccugcgcccccgaccgcugccccccgaccugcaucuacgucgccggcauggcagaacuaggagccuucuucagcauccuacaagacaugcgcaacaccauaauggcuagcaaaaccgucggcaccgcagaagaaaaacucaaaaaaaagagcagcuucuaccaaucguaccuccgacgaacccaaagcaugggcauacaacuagaccaacgaaucauccuccucuacaugcucgaauggggaaaagaaaugguggaccacuuccaccuaggagacgacauggaccccgaacuccgcggacucgcccaagcccucaucgaccagaaaguaaaagaaauaucaaaccaggacccacucaaaauauaa

SEQ ID NO: 7851 - RNA, 1302 nt, Artificial Sequence
  derived and/or modified CDS sequence (opt11) from PUUV(Palbole_98-2)__AM746328.1__N
augucagaccucaccgacauacaagaagacaucacccgccacgaacaacaacucgucguagcccgccaaaagcuaaaagacgcugaaaaagcagucgaaauggaccccgacgacgucaacaaaaacacccuccaagcccgccaacaaaccguuuccgcccuggaagacaaacuagccgacuucaaacgccgcauggccgacgccguaucccgcaagaaaauggacaccaaacccaccgaccccaccggcauagaacccgacgaccaccucaaagaacgcucaucccuccgauacggaaacgucuuagacgucaacgcuaucgacaucgaagaacccagcggccaaacagccgacugguacaccaucggaguauacgucaucggcuucacacuacccaucauccucaaagcacucuauaugcuuuccacacgcggccgacaaacagucaaagaaaacaaaggaacacgcauccgauucaaagacgacaccuccuucgaagacaucaacggcauacgacgccccaaacaccuauacgucuccaugcccacagcacaauccaccaugaaagccgaagaacugacccccggccgcuuccgcacaaucguaugcggccucuuccccacccaaauccaaguccgaaacauaaugucaccagucaugggagucaucggcuucuccuucuucguaaaggacugggccgaccgcauacgcgaguucauggaaaaagaaugccccuucaucaaacccgaaguaaaacccggcaccccaacccaagaaaucgaguuccugaagaaaaacaaaguauacuucauggaccgccaaaacguccuagacaagaaccacgucgcggacaucgacaaacucaucgacuacgccgccuccggagauccaaccuccccagacaacaucgaaagccccaacgccccaugggucuucgccugcgccccagaccgaugcccuccaaccugcauuuacguagccggcauggccgaacucggcgcauucuuuuccauacuacaagacaugcgaaacaccaucauggcaucaaaaaccguaggcacagccgaagaaaaacucaaaaagaaauccagcuucuaucaauccuaccuacgccgaacccaaucaaugggaauacaacuagaccaacgcauaauccuacuuuacaugcuagaauggggcaaagaaaugguagaccacuuccaccucggcgacgacauggaccccgaacucagaggauucgcccaagcccucaucgaccaaaaagucaaagaaaucagcaaccaagacccccuaaagauauaa

SEQ ID NO: 7852 - RNA, 1302 nt, Artificial Sequence
  derived and/or modified CDS sequence (opt11) from PUUV(Palbole_98-3)__AM746329.1__N
auguccgaccuaaccgacauccaagaagacauaacccgacacgaacaacaacucgucgucgcccgccaaaaacucaaagacgccgaaaaggccguagaaauggaccccgacgacgucaacaaaaacacccuccaagcccgacaacagacaguauccgcacuggaagacaaacuagccgacuucaaacgacgcauggcagacgccgucucccgcaaaaaaauggacaccaagcccaccgaccccacggggaucgaaccagacgaccaccugaaagaacgcagcagccuacgcuacggaaacguccuagacgucaacgccaucgacauagaagaacccuccggccagaccgcagacugguacaccaucggagucuacguaaucggauucacccucccaauaauccuaaaagcccuauacaugcuaucaacccgcggcagacaaaccgugaaagaaaacaaaggcacccgcauaagauucaaagacgacacuuccuucgaagacaucaacggaaucagacgccccaaacaccucuacgucuccaugccgacagcccaauccaccaugaaagccgaagaacuaacccccggacgcuuccgcaccaucgugugcggccucuucccgacacaaauacaaguaagaaacauaaugucacccgucaugggcgucaucggcuucuccuucuucgucaaagacugggcagaccgaaucagagaauucauggaaaaagaaugccccuucaucaaaccagaagucaaacccggcacacccacccaagaaaucgaauuccucaaaaaaaacaaagucuacuucauggaccggcaaaacguacucgacaaaaaccacguggccgacaucgacaaacuaaucgacuacgccgcauccggcgacccaaccucccccgacuccaucgaaucaccgaacgcaccuuggguguucgccugcgccccagacagaugcccgcccacaugcaucuacgucgccggaauggcagaacucggagccuucuucagcauccuccaagacaugcgcaacaccaucauggccagcaagaccguaggaacggccgaagaaaaacucaaaaaaaaaucaaguuucuaucaauccuaccuacgacgcacccaauccaugggaauccaacucgaccaacgaauaauccuccuauauaugcuagaaugggggaaagaaauggucgaccacuuccaccuaggagacgacauggaccccgagcuccgcggacuagcacaagcacugaucgaccagaaagucaaagaaaucuccaaccaagacccgcucaaaaucuaa

SEQ ID NO: 7853 - RNA, 1302 nt, Artificial Sequence
  derived and/or modified CDS sequence (opt11) from PUUV(PUUV/Ardennes/Mg156/2011)__KT247592.1__N
augagcgaccucaccgacauccaagaagacaucacaagacacgaacaacaacucgucgucgcacgacagaaacucaaagacgccgaaaaagccguugagauggaccccgacgacgucaacaaaaacacacuccaagcacgacaacaaacgguaucagcccucgaagacaaacucgcagacuucaaacgacaaauggccgacgccguaucacgcaagaaaauggacaccaaacccaccgaccccaccggcaucgaaccagacgaccaccucaaagaacgcucaucacugcgcuacggcaacguacuagacgucaacgccaucgacaucgaagaacccuccggacagaccgccgacugguacaccaucggcgucuacgucaucggcuucacccuacccaucauccucaaagcccuauacaugcucucaacccgaggccgacaaaccgucaaagaaaacaaaggaaccagaauccgauucaaagacgacacuuccuucgaagacaucaacggcauucgacgccccaaacaccucuacgucucaaugccaaccgcccaauccaccaugaaagccgaagaacuaacacccggacgcuuccgcaccaucgugugcggccucuuucccacucaaauccaaguccgaaacaucaugagccccgucaugggaguaaucggauucucauucuucgucaaagacugggccgaccgaauccgcgaguucauggaaaaagaaugccccuucauaaaacccgaagucaaacccggaacccccgcacaagaagucgaguuucucaaacgcaacaaaaucuacuucaugcagcgccaagacguccucgacaaaaaccacgucgccgacaucgacaaacuaaucgacuacgccgccucgggcgacccaaccagccccgacaacaucgaagcgcccaacgcacccuggguauucgcaugcgcccccgaccgaugcccaccaaccugcauauacgucgcaggaauggccgaacucggagcauucuucuccauccuacaagacaugcgcaacaccaucauggcguccaaaaccgucggcacagcagaagaaaaacucaaaaagaaaagcucguucuaucaaagcuaccuccgcagaacccaaucaaugggcauacaacucgaccaacgaauaauccuccucuacaugcuggaauggggaaaagaaaugguagaccacuuccaccuaggagacgacauggaucccgaacugcgcggacucgcacaagcgcuaaucgaccaaaaagucaaggaaaucagcaaccaagaaccccucaaaaucuaa

SEQ ID NO: 7854 - RNA, 1302 nt, Artificial Sequence
  derived and/or modified CDS sequence (opt11) from PUUV(PUUV/Jelgava/Mg136/2008)__JN657230.1__N
augucagaccucgccgacauccaagaagacauaacccgacacgaacaacaacuagucgucgcccgccaaaaacucaaagacgccgaacgagccguagaaguagaccccgacgacgucaacaaaaacacccugcaagcccgccaacaaacagucuccgcacucgaagacaaacucgcagacuacaaacgucgcauggccgacgccgucucaagaaaaaaaauggacaccaaaccagcagaccccaccgggauugaacccgacgaccaccuaaaagaacgcagcagccuccgcuacggaaacguccucgacguaaacgcaauagauaucgaagaacccagcggccaaacggccgacugguacaccaucggcgucuacguaaucggauucacccucccaaucauccucaaagcacucuacaugcucuccacaagaggccgccaaacaguaaaagagaacaaaggcacccgcauacgauucaaggacgacaccagcuucgaagacauaaacggaauacgccgccccaaacaccucuacgucucaaugcccacagcgcaaagcaccaugaaagcagaagaacuaacccccggccgguuccgcacuguagucugcggccucuucccaacacaaauacaaguccgaaacauaauguccccggucaugggagucauaggcuucagcuucuucgucaaagacuggcccgacagaauaaaagaauucauggaaaaagaaucaccauucaucaagcccgacgucaaacccggcaccccagcucaagaagucgaauuccucaaaaggaacaaagucuacuucaugaaccgccaagacguccucgacaagaaccacguagccgacaucgacaagcuaaucgacuacgccgccuccggcgaccccacaucacccgacgacaucgaaagccccaacgcaccaugggucuucgccugcgcaccagaccgcugcccccccacaugcaucuacgucgccggaauggccgaacugggcgcauucuucuccauccuucaggacaugcgaaacacaaucauggccagcaagaccgucggcacggccgaagaaaaacuaaaaaaaaaaagcucauucuaccaaucauaccuccgccgcacccaaucaaugggcauacaacuagaccaacgaaucauccuccuauacaugcucgaauggggcaaagaaauggucgaccacuuccaccucggagacgacauggacccagaacugcgagggcuagcacaagcccucaucgaccaaaaaguaaaagaaaucagcaaccaagaaccacucaagaucuaa

SEQ ID NO: 7855 - RNA, 1302 nt, Artificial Sequence
  derived and/or modified CDS sequence (opt11) from PUUV(PUUV/Jelgava/Mg140/2008)__JN657231.1__N
augagcgaccuugcagacauccaggaagacaucaccagacacgaacaacagcuaguagucgcacgccaaaaacucaaagacgcggaacgcgccguagaagucgaccccgacgacguaaacaaaaacacccuacaagcccgccaacaaacuguauccgcccuagaagacaaacucgccgacuacaaaagacgaauggccgacgccguaucccgaaagaaaauggacaccaaacccgccgaccccacaggcaucgaacccgacgaccaccucaaagagcgaucaucccuacgcuacggcaacguccucgacgucaacgccauagacauagaagaacccagcggacaaacugccgacugguauaccaucggagucuacgucaucggcuucacccuccccaucauccuaaaagcacuauacaugcucuccacacgcggacgccaaaccgucaaagaaaacaagggcacccgcauccgcuucaaagacgacacauccuucgaagacauaaauggcauccgccgacccaagcaccucuacgucuccaugcccacagcacaauccaccaugaaagccgaagaacucacacccggccgcuucagaacugucgucugcggccucuuccacacccaaauacaaguccgaaacaucaugagccccgucaugggaguaaucggcuucuccuucuucgucaaggacuggccagaccgcaucaaagaguucauggaaaaggaaugccccuucaucaaacccgacguuaaacccggcacccccgcccaagaagucgaguuccucaaacgcaacaaagucuacuucaugaaccgacaagacguccucgacaagaaccacgucgcugacaucgacaaacuaaucgacuacgccgcauccggugaccccaccagccccgacgacauagaaucccccaacgcccccugggucuuugcaugcgcaccagaccgaugcccgccaaccugcaucuacguagcaggaauggccgaacuaggagcauucuucucaauacuccaagacaugcgcaacaccaucauggccucaaaaacagucggcaccgccgaagaaaaacucaaaaagaaauccucauucuaccaaucauaccuacgccgcacccaguccaugggcauacaacuagaccaacgcauaauccugcuuuacaugcucgaauggggcaaagaaauggucgaccacuuccaucuaggcgacgacauggaucccgaacucagaggccuugcccaagcucucaucgaccaaaaagucaaagaaaucuccaaccaagagccccuaaaaaucuaa

SEQ ID NO: 7856 - RNA, 1302 nt, Artificial Sequence
  derived and/or modified CDS sequence (opt11) from PUUV(PUUV/Jura/Mg2/2010)__KT247596.2__N
augucagaccucacagacauacaagaagacaucacacgccacgaacaacaacucgucguagcccgccaaaagcucaaagacgccgaaaaagccguagagauggaccccgacgacgucaacaaaaacacccuccaagcccgccaacaaaccgucuccgcccuagaagacaaacuagcagacuucaaacgaagaauggccgacgccguaucccgcaaaaaaauggacacuaaaccaaccgacccaacgggcaucgaacccgaugaccaccucaaagagcgcuccucccucagauacggcaacguccucgacgucaacgccaucgacauagaagagcccucgggccaaaccgcggacugguacacaaucggcgucuaugucauaggcuucacccucccaaucauccucaaagcccucuacaugcucucaaccagaggucgacaaaccguaaaagaaaacaaaggcacccgcauacgauucaaagacgacaccuccuucgaagacaucaacggcauccgacgacccaaacaccuauacguaucgaugccaacagcccaaucaaccaugaaagccgaagaacucacaccaggccgcuuccgcaccaucgucugcggccuuuuccccacacaaauccaaguccgcaacaucaugagcccagucaugggcgucaucggcuucagcuucuucgucaaagacugggcagaccgcauccgcgaauucauggaaaaagaaugccccuucauuaaacccgaaaucaaacccggaacccccgcacaagaagcagaauucuuaaaacgcaacaaaaucuacuuuaugcaacgccaagacguccucgauaaaaaccacgucgccgacaucgacaaacucaucgacuacgccgcauccggcgacccgaccagcccagacaacaucgaaagccccaacgccccaugggucuucgccugcgccccagaccgcugcccccccaccugcaucuacguagccggcauggcagaacucggcgccuucuucuccauacuccaagacaugcgcaacaccaucauggccagcaaaaccgucggcacagccgaagagaaacuaaaaaaaaaaagcucauucuaccaaagcuaccuacgccgcacacaaagcaugggaauccaacucgaccagcgcaucauccuccucuacaugcucgaauggggcaaagaaaugguagaccacuuccaccuaggcgacgacauggaccccgaacuucguggacucgcacaagcacucauagaccaaaaagucaaagaaaucuccaaccaagaaccccucaaaaucuaa

SEQ ID NO: 7857 - RNA, 1302 nt, Artificial Sequence
  derived and/or modified CDS sequence (opt11) from PUUV(PUUV/Madona/Mg233/2008)__JN657232.1__N
augucagaccucgccgacauacaagaagacaucacgcgccaugaacaacaacuugucgucgcacgacaaaaacucaaagacgcagaacgcgcuguagaagucgaccccgacgaugucaacaaaaacacccuccaagcccgccaacaaaccguaucugcccuagaagacaaacucgccgacuacaaacgaagaauggccgacgccguaucacgcaagaaaauggacacgaaaccgaccgaccccaccggaaucgaacccgacgaccaccuaaaagaacgcagcucccuaagauauggcaacguccuagacgucaacgcaaucgauaucgaggaacccuccggccaaaccgccgacugguacacaauaggcgucuacgucaucuccuucacacuccccaucauccucaaagcccucuacaugcuaucuacccgaggucgccaaacaguaaaagaaaacaaaggcacacgcauccgauucaaagacgacaccagcuucgaggacaucaacggcauccgccgcccaaaacaccuauacguaucaaugcccaccgcccaauccaccaugaaagcggaagaacucacccccggacgauuccgaaccaucguaugcggacuauuccccacccagauccaagucagaaacauaaugucaccagucaugggcgucaucggcuucuccuuuuucgucaaggacuggcccgaccgcaucaaagaguucauggaaaaagaaugccccuucauaaaaccagacgucaaacccggaacccccgcccaagaaauagaguuccucaaacguaacaaagucuacuuuaugaaccgacaggacguccuagacaaaaaccacgucgccgacaucgacaagcucaucgacuacgccgccucaggcgaccccaccagcccagacgacauagaaagccccaacgccccauggguauucgcuugcgccccagaucgaugucccccaaccugcauauacguagccggaauggcagaacucggcgcauucuucagcauccuucaagacaugcgaaacaccaucauggcaagcaaaaccguaggcaccgccgaagaaaaacucaaaaagaaauccagcuucuaccaauccuaucugcgccggacccaauccaugggcauccaacucgaccagcgaaucauccuacucuacauguuagaauggggcaaagaaauggucgaccacuuccaccuaggcgacgacauggacccagaacuccgcggccucgcccaagcccucaucgaccaaaaaguaaaagagaucuccaaccaagaaccccucaaaaucuag

SEQ ID NO: 7858 - RNA, 1302 nt, Artificial Sequence
  derived and/or modified CDS sequence (opt11) from PUUV(PUUV/Orleans/Mg23/2010)__KT247594.1__N
auguccgaccuaaccgacauccaagaaguaauaacccgacaugaacaacaacucgucguagcccgccaaaagcucaaagacgccgaaaaggcagucgaaauggaccccgacgacgucaacaaaaacacccuccaagcccgccagcaaaccgucagcgcccuagaagacaagcuagcugacuucaaacgcagaauggccgacgccgucucccguaagaaaauggacaccaaaccggcagaccccaccggcaucgaaccagacgaccaccuaaaagaaagauccucccuccgcuacggaaacguccuugacguaaacgcaaucgacaucgaagaacccuccggccaaacagccgacugguacaccaucggcguguacgucauaggcuucacccuucccaucauacucaaagcccuauacaugcuuuccaccagaggccgccaaacggucaaagaaaacaaaggcacacgaauacgcuucaaagacgacacaucauucgaagacaucaacggaauacgccgaccgaaacaucucuacgucucaaugcccaccgcccaaagcaccaugaaagccgaagaacucacacccggacgcuuccgcacaaucgucugcggacuauuccccacccaaauccaaguacgcaacauaaugagccccgucaugggagucaucggcuucucauucuucguaaaagacugggccgaccgcaucaaagaguucauggaaaaagaaugccccuuuaucaagccugaagucaaacccgguaccccaguaaaagaagccgaguuccucaagaaaaaccgcgucuacuucaugcaacgccaagacguacucgacaaaaaccacgucgcagacaucgacaaacuuaucgacuacgcugccgccggagacccuaccagcccugacaauauagaaagcccaaacgcacccugggucuucgccugcgcaccagaccgcugcccacccacgugcaucuacgucgccggcauggccgaacuaggcgccuucuucuccauacuacaagacaugcgcaacacaaucauggccucaaaaaccguaggcaccgcagaagaaaaacugaagaagaaaagcucauucuaccaauccuaccuccgacggacccaaagcaugggcauacaacucgaccaacggaucauccuccuauacaugcuagaauggggaaaagaaaugguagaccacuuucaccuaggagacgacauggaccccgaacuacgaggccucgcacaagcacucaucgaccaaaaaguaaaagaaaucucgaaccaagaaccccucaaaaucuaa

SEQ ID NO: 7859 - RNA, 1302 nt, Artificial Sequence
  derived and/or modified CDS sequence (opt11) from PUUV(Tobetsu-60Cr-93)__AB010731.1__N
auguccgaccucaaagacauccaagaagacaucacccgccacgaacaacaacucgucguagcccgacaaaaacuacgcgacgcagaaaaagccguagaaauggaccccgacgacguuaauaagaacacccuacaagcacgccaacaaaccgucagcgcccucgaagacaaacuggcagacuucaaacgacgcauggcagacguagucucacguaagaaaauggacaccaaacccgccgaccccaccggaaucgaacccgacgaccaccucaaagaccgcucaucacuacgcuacggaaacguacucgacgucaacgcgaucgacauagaagaacccagcggccaaacagccgacugguacacaaucggcguauacauaaucggcuucacccucccaaucauacucaaagcccuguacaugcucagcacccgcggucgccaaaccgucaaagaaaacaagggcacccgaauccgcuucaaagacgacaccucguucgaagacaucaauggcauccgccgcccaaaacaccucuacgucuccaugccaaccgcccaauccaccaugaaagccgaagaaaucacaccaggccgcuucagaaccauagucugcggccucuuucccacacaaauacaaguccggaacaucaugagccccgucaugggaguaaucggauucuccuucuucguaaaagacuggcccgaacgcaucaaagaguucauggaaaaagaaugccccuucauaaaacccgaaguaaaacccggcacccccgcuaaagaaguagaaauccuaaaacgaaacaaagucuacuucaugcaacgacaagacguccucgacaaaaaccacguccccgacaucgacaaacuaaucgacuacgccgccuccggagaccccacauccccagacaacaucgacagccccaacgcacccuggguauucgccugcgcccccgacagaugcccuccaaccugcauauacgucgcaggcauggcggaacucggugccuucuucagcauccuacaagauaugcgcaacaccaucauggccucaaaaaccguaggcaccgccgaagaaaaacucaaaaagaaaucaucuuucuaccaauccuaccuacgacgaacccaauccaugggcauccagcuagaccaacgcaucauacuccuuuacaugcuagaauggggaaaagaaaugguagaccacuuucaucucggcgacgacauggaccccgaacuacgcgggcucgcccaagcacuaaucgaccaaaagguaaaagaaaucucaaaccaagaaccccucaaaaucuaa

SEQ ID NO: 7860 - RNA, 1302 nt, Artificial Sequence
  derived and/or modified CDS sequence (opt11) from PUUV(Vranica)__U14137.1__N
auguccgaccucacagacauacaagaagacaucacacgacacgaacagcagcuagucgucgccagacaaaaacucaaagacgccgaaaaagcagucgaaauguacccggacgacguaaacaaaaacacccuccaagcaagacaacaaaccgucuccgcccuggaagacaaacuagcagacuucaagcgccgaauggccgacgcagucagccgcaagaagauggacacaaaacccaccgaccccacgggcaucgaacccgacgaccaccucaaagaacgaagcagccuaagauacggcaacguccucgacgugaacgccauagacaucgaagaacccagcggccaaaccgcagacugguacaccauaggcguauacgucauaggauucacccucccgauaauacucaaagcacuguacaugcuaucaacacgcggcagacaaaccguuaaagaaaacaaaggaacacgauaccgcuucaaagacgacaccagcuucgaagacaucaacggcauccgccgcccaaaacaccuauacgucagcaugcccaccgcacaauccaccaugaaagcagaagaacuaaccccaggaagguuccgcacaaucgucugcggccuauuccccacccaaauacaaguaagaaacaucaugagccccgucaugggcgucaucggcuucagcuucuucgucaaagacugggcagaccgcauccgcgaguucauggagaaagaaugccccuucaucaaaccagaagucaaacccggcacccccacccaagaaaucgaguuucucaagaaaaacaaagucuacuucauggaccgccaaaacgugcucgacaagaaccacguagcagacauagacaaacucauagacuacgccgcauccggcgaccccaccagcccagacaacaucgaaucaccaaacgcccccugggucuucgccugcgcacccgaccgaugucccccaaccugcaucuacguagccggcauggccgaacucggcgccuucuucuccauccuacaagacaugcgcaacacaaucauggcguccaaaaccgugggcaccgccgaagaaaaacucaaaaagaaaucauccuucuaccaauccuaccuccgcagaacacaauccaugggaauacaacucgaccaacgaauaauccuacuauacaugcucgaauggggcaaagaaaugguagaccacuuccaccucggcgacgacauggaccccgaacuccguggacucgcccaagcccuaaucgaccaaaaagucaaagaaauauccaaccaagacccccugaagauauaa

SEQ ID NO: 7861 - RNA, 1302 nt, Artificial Sequence
  derived and/or modified CDS sequence (opt11) from PUUV(P360)__L11347.1__N
augucagaccugaccgacauccaagaagaaaucacccggcacgagcaacaacuugucguagccaggcaaaaacucaaagacgcagaacgagccgucgaagucuaccccgaugacguuaacaaaaacacccugcaagcccgacaacaaaccguaucagcccuagaagacaaacuugcagacuacaaacgccgaauggcagacgcaguaucccgcaagaaaauggacaccaaaccgacugaccccacaggcauagaacccgacgaccaccuaaaagaaagaucaucccuacgcuacggaaacguccucgacguuaacgccaucgauaucgaagaacccagcggccaaaccgccgacugguacaccauaggcguguaugugaucggcuucacaauaccaauaauacuaaaagcacuauacaugcucucgacacgcggccgucaaaccguaaaagaaaacaaaggcaccaggauacgauucaaagacgacaccuccuucgaagacaucaacggcauccgacgacccaaacaccucuacgucagcaugcccaccgcccaaucuacaaugaaagccgaggaacuaacccccggccgauuccgcaccaucgucugcggccucuucccaacacaaauccaaguccgaaacauaaugagccccguaaugggcgucaucggcuucucauucuucgucaaagacuggccagaaaagauccgcgaguucauggaaaaagaaugcccauucaucaaacccgaagucaaaccaggcaccccagcccaagaagucgaguuccucaaacgaaaccgcgucuacuucaugacgcgacaagacguccuagacaagaaccacgucgccgacaucgacaaacucauagauuacgccgcaucaggagaccccaccuccccagacgacauagaauccccgaacgccccauggguguucgccugcgcaccagaccgaugcccacccacuugcauauacgucgccggcauggcagaacucggcgcauucuucuccauccuccaagacaugagaaacaccaucauggccuccaaaaccgucggcacagccgaagaaaaacucaaaaagaaauccuccuucuaccaaucauaccuccggagaacacaaucaaugggcauacaacucgaccaacguaucauccuacucuacaugcuagaauggggcaaagaaaugguagaccacuuccaccucggggacgacauggaccccgaacuacgcggccucgcccaaucccucauagaccaaaaagucaaagaaaucucaaaccaagaaccgcuaaaaaucuag

SEQ ID NO: 7862 - RNA, 1302 nt, Artificial Sequence
  derived and/or modified CDS sequence (opt11) from PUUV(Aijajarvi/Mg7/05)__GQ339476.1__N
auguccgaccucaccgacauccaagaagacauaacacgacacgaacaacagcuagucgucgcacgacaaaaacucaaagacgcagaaaaagccgucgaaauggacccagacgacguaaauaaaaacacacuccaagcacgccaacaaacagucucagcccucgaagacaaacucgccgacuucaagcgccaaauggcagacgccguaucccgcaagaaaauggacacaaaaccaaccgaccccaccggcauagaaccagacgaccaccuaaaagaacgauccucccuacgcuacggcaacguccuagacgucaacgccaucgacaucgaagaacccagcggccaaacagccgacugguacacaauaggaguauacgucauaggcuucacacucccaaucauccucaaagcccucuacaugcucuccaccagaggccgacaaacagucaaagaaaacaaaggaacccgcauccgguucaaagacgacacauccuucgaagacaucaacggcauccgccgcccgaaacaccucuacgucucaaugcccaccgcccaauccaccaugaaagcggaagaacucacaccaggacgcuuccgcacaaucgugugcggccucuuccccacccaaauccaagucagaaacaucaugagcccagucaugggagucaucggauucuccuucuucgucaaaggaugggcagacagaauccgugaguucauggaaaaagaaugccccuucauaaagccugaagucaaacccggcaccccgacccaagaagucgaguuccucaaaaagaacaaagucuacuuccuagaucgccaaaacguccuugacaaaaaucacgucgcagacauagacaagcuaaucgacuacgcagccuccggcgaccccaccagcccagacaacauagaaucccccaacgccccaugggucuucgcaugcgcccccgaccgaugcccacccacaugcaucuauguagccggaauggccgaacucggagccuucuucagcauccuccaagacaugcgaaacacaauaauggcauccaaaaccgucggcaccgcagaagaaaaacuuaaaaagaaaagcagcuucuaccaauccuaccuacgccgaacccaauccaugggcauccagcucgaccaacgcauuauacuccucuuuaugcucgaauggggaaaagaaauggucgaccacuuccaccucggcgacgacauggaccccgaacuacgcggccuugcucaagcccuaaucgaccagaaagucaaagaaaucuccaaccaagaaccccucaaaaucuag

SEQ ID NO: 7863 - RNA, 1302 nt, Artificial Sequence
  derived and/or modified CDS sequence (opt11) from PUUV(Bavaria 151/05)__EU439968.1__N
augucagaccucacagacauccaagaagacaucacacgacacgaacaacaacuagucgucgcccgccaaaaacucaaagacgccgaaaaagccguugaaauggacccagacgacgucaacaaaaacacccuccaagcccgccaacagacugucucagcccuagaagacaaacuggccgacuacaaacgacgcauggccgacgccgucucccgcaaaaaaauggacaccaaacccacagacccaaccggcaucgaaccagacgaccaccuaaaagaacgcagcucacuccgcuacggaaacguccuggacgucaacgccaucgacauagaagaaccgagcggacaaaccgccgacugguacaccaucggagucuacgucaucggcuucacccuccccaucauacucaaagcccuauacaugcucucaacccgcggaagacagaccguaaaggaaaacaaagggacccggauacgauucaaagacgacaccuccuucgaagacaucaacggaauacgccgccccaaacaccuuuacgucuccaugcccaccgcccaauccaccaugaaagcagaagaacucacaccgggacgcuuccgaaccaucgucugcggccuauuccccacgcaaauccagguacgaaacaucaugucacccgucaugggcgucaucggguucuccuucuucgucaaggacugggccgaacgcauccgcgaauucauggaaaaagaaugccccuuccuaaaacccgaaauaaagccaggcacccccgcacaagaagcggaauuccuaaaaaaaaacaaaguauacuucaugcaacgccaagacguccuagacaaaaaccacgucgccgacaucgacaaacuaauagacuacgcugccucaggagacccgaccucccccgacaacaucgaaagccccaacgcccccugggucuucgcaugcgcgcccgaccgaugcccccccaccugcauauacgucgccggcauggcagaacuuggcgccuucuucagcauccuccaagacaugcgaaacaccaucauggcauccaaaaccguaggaacagccgaagaaaagcuaaaaaaaaaaagcucauucuaccagucguaccuaagacgaacacaaagcaugggcauacaacucgaccaacgaaucauccuacuauacaugcuggaauggggcaaagaaauggucgaccacuuccaccucggggacgacauggacccagaacuccgcggucucgcacaggcacuaauagaccaaaaagucaaagaaaucuccaaccaagagccccuaaaaaucuga

SEQ ID NO: 7864 - RNA, 1302 nt, Artificial Sequence
  derived and/or modified CDS sequence (opt11) from PUUV(Bavaria 159/05)__EU439972.1__N
augucagaccuaaccgacauccacgaagacaucacacgccacgaacaacaacuaguuguagcccgccaaaaacucaaagacgccgaaaaagcagucgaaauggacccagacgacgucaacaaaaacacacuccaagcacgccaacaaaccgucucagcccucgaagacaaauuagccgacuacaaacgccgcauggcagacgcagucuccagaaaaaaaauggacacaaaacccaccgaccccacaggcauagaacccgacgaccaccuaaaagaacgcucgagccuccgcuacggcaacguccucgacgucaaugccauagacauagaagaaccaagcgggcaaaccgccgacugguacaccaucggcguguacguaaucggcuucacccuaccaaucauacucaaagcccucuacaugcucucgacccgcggcagacaaacaguaaaagaaaacaaaggcacccgcauccgauucaaagacgacaccucauucgaagacaucaacggcaucagacgaccgaaacaccucuacgucuccaugccaaccgcacaaucaaccaugaaagcagaagaacuuacaccaggccgcuuccgaaccaucguaugcgggcuauuccccacacagauacaaguccgcaacauuaugucacccgucaugggugucaucggauucuccuucuucguaaaagacugggccgaacgaauccgcgaauucauggaaaaagaaugccccuucauaaaacccgaaaucaaaccaggcacuccagcacaagaagccgaauuccucaaacgcaacaaagucuacuucaugcagcgccaagacguccucgacaaaaaccacguggcagacauagacaaacucaucgacuacgccgccuccggcgaccccaccucccccgacaacaucgaaagccccaacgcgcccuggguauucgcaugcgcccccgacagaugcccacccaccugcauauacguagccggcauggcagaacuaggagccuucuucuccauacuccaagacaugcgcaacaccaucauggcuucaaaaaccgucgguaccgccgaagaaaaacucaaaaaaaagagcucauucuaccaaagcuaccugcgccggacccaaucaaugggcauacaacucgaccaacgcauaauccuccuauacaugcuagaauggggcaaagaaaugguugaccacuuccaccucggcgacgacauggacccagaacuacgaggccucgcccaagcacucaucgaccagaaagucaaagaaauauccaaccaagaaccacuaaaaaucuaa

SEQ ID NO: 7865 - RNA, 1299 nt, Artificial Sequence
  derived and/or modified CDS sequence (opt11) from PUUV(Bavaria CG 33/04)__DQ016430.2__N
augucagaccuaaccgacauacaagaagacauaacccgacacgaacaacaacucgucguagcacgccaaaaacuaaaagacgcagaaaaagccguagaaauggaccccgacgacgucaacaaaaacacccuccaagcccgccaacagacggucuccgcccuugaagacaaacucgcagacuacaaacgacgcauggcagacgcagucucacgaaaaaaaauggacacaaaacccaccgacccaaccggcaucgaaccagacgaccaccucaaagagcguucaucacuccgcuacggaaacguccucgacguaaacgccaucgacaucgaagaacccuccggacaaaccgcagacugguacaccaucggaguauacgucaucggcuucacccuacccaucauacuuaaagcccucuacaugcuaucaacccgcggacgacaaacggucaaagagaacaaaggcacccgaauccgcuuuaaagacgacaccucauucgaagacauaaacggcauacgccgccccaaacaccucuaugucucaaugcccaccgcccaauccaccaugaaagcagaagaacucacaccaggccgcuuccgcaccaucgucugcggccucuuccccacccagauucagguacgcaauaucaugagcccagucaugggaguaauaggguucagcuucuucgucaaagacugggccgaaagaauacgagaauucauggaaaaagaaugccccuuuaucaaaccagaaauaaaacccggcaccccagcccaagaagccgaauuccucaaacgcaacaaaguauacuucaugcaaagacaagacgugcucgacaaaaaccacguagccgacaucgacaaacucaucgacuacgccgccuccggcgaccccacaucuccggacaacauagaaagccccaacgccccgugggucuucgccugugcccccgaccgcugcccccccaccugcauauacgucgcuggcauggccgaacucggcgccuucuccauccuccaagacaugcgaaacaccaucauggccuccaaaacaguaggaacagcggaagaaaaacuaaaaaaaaaaucauccuucuaccaaagcuaucuacgucgaacccaaucaaugggcauccaacucgaccaaagaaucauccuccuauacaugcucgaauggggaaaagaaauggucgaccacuuccaccucggagacgacauggaccccgaacuacgcggacucgcccaagcacucaucgaccaaaaagucaaagagaucucaaaccaagagccccucaaaaucuaa

SEQ ID NO: 7866 - RNA, 1302 nt, Artificial Sequence
  derived and/or modified CDS sequence (opt11) from PUUV(Bavaria CG 34/04)__AY954723.2__N
augucggaccuaaccgacauacaagaagacauaacccgccacgaacaacaauugguggucgcccgccaaaaacucaaagacgccggaaaagcuguagaaauggacccagacgacgucaacaaaaacacucuccaagcccgacaacaaaccguaucggcacucgaagacaaacuagccgacuacaaaagacgcauggcagacgcagucucccgaaagaaaauggacaccaaaccgaccgaccccaccggcauagaacccgacgaccaccucaaagaacgcuccucccuccgcuacggaaacguccucgacgucaacgcaaucgacaucgaagaaccauccggccaaaccgccgacugguacaccaucggagucuacgucaucggauucacacucccaaucauacucaaagcucuauacaugcucagcacccgcggaagacaaacagucaaagaaaacaagggcaccagaauacgauucaaagacgacacaaguuucgaagacaucaacggcauccggcgcccaaaacaccucuacguaucaaugccaaccgcccaaagcaccaugaaggcagaagaacugacccccggccgcuuccgcaccaucgucugcggacuauucccaacccaaauccaaguacgcaacaucauguccccagugaugggcgucauaggauucuccuucuucgucaaagacugggccgaacgcauccgcgaguucauggaaaaagaaugcccuuucaucaaaccagaaaugaagccaggcacccccgcacaagaagccgaguuccuaaaacgcaacaaagucuacuucaugcaacgccaagacguccuagacaaaaaccacgucgcagacaucgacaaacuaaucgacuaugccgccagcggagacccaaccagccccgacaacaucgaaucccccaacgcgccaugggucuucgccugcgcacccgaccgaugcccaccaaccugcaucuauguagcaggcauggcagaacucggcgccuucuucagcauacuucaagacaugcgcaacacaauaauggccuccaaaaccgucggaacagcagaagaaaaacucaaaaagaaauccucguucuaccaaucauaccuccgaagaacacaaagcauggguauucaacucgaccaacgcaucauacuccuauacaugcucgaauggggcaaagaaauggucgaccacuuccaccucggcgacgacauggacccagaacuccgcggccucgcccaagcccucauagaccagaaaguaaaagaaaucuccaaccaagaaccacuaaaaaucuag

SEQ ID NO: 7867 - RNA, 1302 nt, Artificial Sequence
  derived and/or modified CDS sequence (opt11) from PUUV(Bavaria CG 41/04)__DQ016432.2__N
auguccgaccucaccgacauacaagaagacauaacccgacacgaacaacaacucguagucgcccgccaaaaacucaaagacgccgaaaaagccgucgaaauggacccugacgacgucaacaaaaacacacuccaagcccgccaacagacagucucagcccucgaggacaaccuagccgacuacaaacgccgcauggccgacgccguaagccgcaaaaaaauggacaccaaacccaccgaccccaccggcaucgaacccgacgaccaccucaaagaacgguccucccuccgcuacggcaacguucuagacguaaacgccaucgacaucgaagaacccagcggccaaaccgccgauugguacaccaucggcguuuacgucaucggcuucacacucccaaucauccucaaagcccuuuacaugcucucaacccgaggcagacaaaccgucaaagaaaacaaaggcacccgaauccgcuucaaagacgacaccuccuucgaagacauaaacgggauccgucgccccaaacaccucuacgucucaaugccaaccgcacagucaaccaugaaagccgaagaacucacacccggccgauuccgaacaauuguaugcggccuauuccccacucaaauacaaguccgaaacaucaugagcccaguaaugggcgucaucggauucuccuucuucgucaaagacugggccgaacgaauccgcgaauucauggaaaaagaaugccccuucaucaaaccugaaaugaaacccggcacccccgcccaagaagcagaauuccucaaaagaaacaaagucuacuucaugcagcgccaagacguccucgacaaaaaccacgucgccgacaucgacaaacugaucgacuacgcagccuccggcgaccccaccucccccgacaauaucgagucccccaacgcccccugggucuucgccugcgcccccgaccgcugcccccccacaugcaucuacgucgccggcauggccgaacugggugcauucuucuccauccuccaggacaugcgcaacacuaucauggccucaaaaaccgucggcacagcagaagaaaaacucaaaaaaaaaucauccuucuaccaauccuaccuccgccgcacccaaagcaugggaauccaacucgaccaacgaauaauccuccuauacaugcucgaauggggcaaagaaaugguagaccacuuccaccuaggagacgacauggaccccgaacuacgaggccuagcgcaagcccuaauagaccaaaaagucaaagaaauauccaaccaagagccacuaaaaauauaa

SEQ ID NO: 7868 - RNA, 1302 nt, Artificial Sequence
  derived and/or modified CDS sequence (opt11) from PUUV(Bavaria CG 9/04)__AY954722.2__N
auguccgaccuaaccgacauccaagaagacaucacacgacacgaacagcaacucgucgucgcccgccaaaaacucaaggacgcagaaaaagcaguagaaauggacccagacgacgugaacaaaaacacucuccaagcacgacaacaaaccgucagcgcccucgaagacaaacuagccgacuacaaaagacgcauggccgacgcagugucacgcaagaaaauggacacaaaacccaccgaccccacaggcauagaacccgacgaccaccuuaaagaacgcuccucccugcgauacggcaacguccuggacguaaacgccaucgacauagaagaacccagcggccaaacagcagacugguacaccaucggcguauacgucauaggcuucacccuacccauuauccuaaaagcccucuacaugcucagcacacgcggccgccaaaccgucaaagaaaacaaaggcacacgaaucagauucaaagacgacacauccuucgaagacauaaacggcauccgccgcccgaaacaccucuacgucuccaugcccaccgcccaaucaaccaugaaagcagaagaacucacccccggccgcuuccgaaccaucguaugcggccucuuccccacccaaauacaaguccgcaauauaaugagccccgucaugggcgucaucggcuucuccuucuucgucaaagacugggccgaacgcaucagagaauucauggaaaaggaaugccccuucaucaaacccgaaaugaagcccggcauccccgcacaagaagccgaauuccucaaacgcaacaaagucuacuucaugcaacgucaagacguccuagacaaaaaccacguagccgacauagacaaacucaucgacuacgccgcaucaggagaccccacauccccagacaacaucgaaagccccaacgcccccugggucuucgccugcgcaccggaccgcugcccccccacgugcaucuacgucgccggcauggccgaacuaggcgcguucuucucaauccuacaagacaugcgaaacaccaucauggcaagcaaaaccgucggcaccgcagaagaaaaacucaaaaaaaaauccuccuucuaccaaagcuaccuccgccgcacccaaagcaugggcauccaacuagaccaacgcauaauccuccuauacaugcuagaauggggcaaggaaaugguagaccacuuccaccucggcgacgacauggacccagaacuacgcggccucgcacaagcccuaaucgaccaaaaagucaaagaaaucagcaaccaagaaccccucaaaaucuaa

SEQ ID NO: 7869 - RNA, 1302 nt, Artificial Sequence
  derived and/or modified CDS sequence (opt11) from PUUV(Bergsjobo/Mg25/05)__GQ339483.1__N
augucagaccucgccgacauccaagacgaaauaacccgccacgaacaacagcucgucgccgcacgccagaaacucaaagacgccgaacgugcagucgaagucgacccagacgacgucaacaaaaacacccuacaagcccgacaacaaaccgucuccgcacuagaagacaaacucgccgacuucaaacgccgaauggcagacgccgucuccagaaaaaaaauggacacaaaacccacagaccccaccggcaucgaacccgacgaccaccucaaagagagaagcuccuuacgguacggcaacguccucgacguaaacgccaucgacauagaagaacccucuggccaaaccgccgacugguacacaauaggcgucuacguaauaggcuuuacccugcccaucaucuuaaaagcccuauauaugcuauccacccgcggccgacaaaccgucaaagaaaacaaaggcacccgaauccgcuuuaaagacgacacauccuucgaagacaucaacggcauccgccgacccaaacaccucuacgucagcaugcccaccgcccaauccaccaugaaagcagaggagcuaacucccggacgcuuccguacaauaguaugcggccuauuccccacccaaauccaaguccgaaacaucaugucacccguaauggggguaaucgguuucuccuucuucgucaaagacugggcagaacgaauccgcgaauucauggaaaaagagugccccuucaucaaacccgaaguaaaaccaggcacccccgcccaagaagucgaauuccucaaaaaaaacaaaaucuauuucaugcaacgacaggacguacucgacaaaaaccacguagccgacaucgacaaacuaauagacuacgcagccagcggagauccaacauccccagacaacaucgaaucccccaacgccccaugggucuucgcaugcgcacccgaccgaugcccacccacaugcauauacgucgccggcauggcagaacucggcgcauucuucucaauccuccaagacaugcgaaacaccaucauggccucaaaaaccgugggaaccgccgaggaaaaacucaaaaaaaaaucauccuucuaccaaucguaccuacgccgcacacaauccaugggcauccaacuagaccaacgcaucauacuacuauacaugcuagaguggggaaaagaaaugguagaccacuuccaccucggcgacgauauggaccccgaacuacgcggccuugcccaagcccuaaucgaccaaaaagucaaggaaaucuccaaccaagaaccacucaaaauauaa

SEQ ID NO: 7870 - RNA, 1302 nt, Artificial Sequence
  derived and/or modified CDS sequence (opt11) from PUUV(CG14444)__AJ277075.1__N
auguccgaccucaccgacauccaagaagacaucacacgacacgaacaacagcuagucguagcacgccaaaaacucaaagacgccgaaaaagcaguagaaauggaccccgacgacgucaacaaaaacacccuccaagcccgacaacaaaccgucuccgcccuggaagacaaacucgcagacuucaaacggcaaauggcggacgccgucuccagaaagaaaauggacaccaaacccacagaccccacaggaauagaacccgacgaccaccucaaagaacgcucaucacuccgcuacggcaacguccuggacgucaacgccaucgacaucgaagaaccguccggccaaacugcagacugguacaccaucggcgucuacguaauaggcuucacccucccaaucauccucaaagcccuuuacaugcucucaacccgcggccgccaaaccgucaaagagaacaaaggaacccgcaucagauucaaagacgacaccagcuucgaagacaucaacggcauccgacgccccaaacaccucuacguaucuaugcccaccgcacaaagcaccaugaaagccgaagaacucaccccaggcagauuccguacaaucgucugcggccucuucccaacccaaauccaaguacgcaacaucauguccccggucaugggcgucaucggauucagcuucuucgucaaagacugggccgaccgcauccgcgaguucauggaaaaagaaugcccauucaucaaaccagaaguaaaaccaggcacacccgcccaagaagcagaguuccucaaacgcaauaaaaucuacuucaugcaacgacaagaaguucuagacaaaaaccacgucgcagacauagacaaacugaucgacuacgccgcauccggcgaccccacguccccagauaacaucgaagccccaaacgcccccuggguauucgcaugcgccccagacagaugcccaccaaccugcaucuacgucgccggcauggcagaacucggcgccuucuucucaauccuccaagacaugcgaaacaccaucauggccuccaagaccgugggcaccgccgaagaaaaacucaaaaagaaauccuccuucuaccagagcuaccuccggcgaacccagagcaugggaauccaacuagaccaacgaauaauccuacucuacaugcucgaauggggcaaagaaauggucgaccacuuccaccuaggcgacgacauggaccccgaacuacgcggccuagcacaagcccucaucgaccaaaaaguaaaagaaaucagcaaccaggaaccccugaaaaucuaa

SEQ ID NO: 7871 - RNA, 1302 nt, Artificial Sequence
  derived and/or modified CDS sequence (opt11) from PUUV(CG14445)__AJ277076.1__N
augucggaccuuaccgacauacaggaagacauaacccgccaugaacaacagcuagucgucgcccgccaaaaacucaaagacgccgaaaaagccgucgagauggaccccgacgacgucaacaagaacacacuccaagcccgccaacaaaccgucuccgcucucgaagacaaacuagccgacuucaaacgccaaauggccgacgccguuucacgaaagaaaauggacacaaaacccacagaccccaccggcaucgaaccagacgaccaccucaaagaacgauccucccugcgcuacgguaacguacuagacguaaacgcaauagacaucgaagaaccauccggccaaacagcggacugguacaccaucggcguauacgucauaggcuucacccuccccaucauacuuaaagcccucuacaugcucagcacccgcggucgccaaacagucaaagaaaacaaagggacacgaauccgauucaaagacgacaccucauucgaggacaucaacggcauccgacgucccaaacaccucuacgucuccaugcccaccgcccaaagcaccaugaaagccgaagaacucacacccggccgcuuccgcaccauaguaugcggacucuuccccacccaaauccagguacgcaacaucaugucccccguaaugggaguaaucggauucuccuucuucgucaaagacugggccgaccguaucagagaguucauggaaaaagaaugcccauucaucaagcccgaagucaaaccaggcacacccgcacaagaagcagaguuccucaaacgaaacauaaucuacuucaugcaacgccaagaaguccucgacaaaaaccacgucgccgacaucgacaaacucauagacuacgcagcauccggcgaccccaccagcccagacaauauagaagcccccaacgcccccuggguauucgcaugcgccccagaccguugcccaccaaccugcaucuacgucgccggcauggcagagcuaggcgccuucuucuccauacuccaagacaugcgcaacaccauaauggccuccaaaacugucggaacugcagaagagaaacucaaaaagaaauccagcuucuaccaauccuaccuccgccgaacccaauccaugggcauccaacucgaccaaagaaucauccuacucuacauguuagaauggggcaaagaaauggucgaccacuuccaccucggagacgacauggaccccgagcuccgaggacuagcccaagcacucauagaccaaaaaguaaaagaaaucuccaaccaagaaccccuaaaaaucuaa

SEQ ID NO: 7872 - RNA, 1302 nt, Artificial Sequence
  derived and/or modified CDS sequence (opt11) from PUUV(CG1820/POR)__KT885052.1__N
augucagaccuuaccgacauccaagaagaaaucacccgccaugaacagcagcuaguaguagcacgacaaaaacucaaagaugccgaacgagccgucgaagucgaccccgacgacgucaacaaaucaacacuucaagcacgccaacaaaccgucucagcacuagaagacaaacucgccgacuacaaacgacgcauggccgacgccgucucccgcaagaaaauggacaccaaacccaccgaccccaccggaaucgaacccgacgaccaccucaaagaaagaagcucccuccgauacggcaacguccucgacgucaacgccauagacaucgaagaaccguccggccaaaccgccgacugguacaccauaggcgucuacgucauaggauucacaauccccaucauacugaaagcccuauacaugcucagcacccgcggacgccaaacagucaaagaaaacaaaggcacccgaauccgauucaaagacgacaccuccuuugaagacaucaacggcauccgaagacccaaacaccucuacgucucaaugccaaccgcacaaucaaccaugaaagcugaagaacucacccccggccgauuucgaacaaucgucugcggacucuuccccacccaaauccaaguacggaacauaaugagccccgucaugggcgucauaggauucuccuucuucgucaaagacuggcccgaaaagauccgagaguucauggaaaaggaaugccccuucauaaaacccgaagucaaaccaggaacuccagcacaagaagucgaguuccucaaacguaaccgcgucuacuucaugacccgacaagacguacucgacaaaaaucacgucgccgacaucgacaaacucaucgacuacgccgccagcggcgaccccacaagcccagacgacaucgaaucccccaacgccccaugggucuucgccugcgcccccgaccgcugcccacccacaugcaucuacgucgcaggcauggcagaauuaggagccuucuucuccauacuacaagacaugcgcaacacaaucauggcaagcaagaccguaggcacagccgaagaaaaacuaaagaagaaaagcagcuucuaucaaucauaucuccgacgaacacaauccaugggcauccaauuagaccaacgcauaauccuccucuacaugcuagaauggggcaaagaaauggucgaccacuuucaccucggcgacgacauggaccccgaacuccgcggccuagcucaaucccucauagaccaaaaagucaaagaaaucuccaaccaagaaccccuuaaaaucuaa

SEQ ID NO: 7873 - RNA, 1302 nt, Artificial Sequence
  derived and/or modified CDS sequence (opt11) from PUUV(Couvin/59Cg/97)__AJ277034.1__N
augucagaccucacagacauacaagaagauaucacccgccacgaacaacagcuagucgucgcccgccaaaaacucaaagacgccgaaaaagccgucgaaauggaccccgacgacguaaacaaaaacacccuccaagcccgccagcagaccguaucagcccucgaagacaaacucgcagacuucaaaagacaaauggcagacgcggucucccgcaagaaaauggacaccaaacccaccgaccccacuggcaucgaacccgacgaccaccuaaaagagcgcuccucccuacgauauggcaacguccuagacgucaacgcaauagacaucgaagaacccuccggacaaaccgccgacugguacaccaucggcgucuacgucaucgguuucacacuccccauaauacuaaaagcccuauacaugcuauccacucgcggccgccaaacaguaaaagaaaacaaaggcaccagaauacgauucaaagacgacaccagcuucgaagacaucaacggcauccgccgacccaaacaccucuacgucuccaugcccaccgcccaaagcacuaugaaagcugaagaacuaacccccgggcgauuccgcaccaucguaugcggccucuuccccacccaaauccaaguccgcaacauaaugucccccgucaugggagugaucggcuucucuuucuucguaaaagacugggccgaccgaauccgcgaguucauggaaaaagaaugccccuucaucaaacccgaagucaaaccaggaacccccgcacaagaagcagaguuccucaaacguaacaaaauauacuucaugcaacgccaagacguccuugacaaaaaccacguggccgacauagacaaacucauagacuacgcugccucaggagacccaaccucccccgacaacaucgaagccccaaacgcacccuggguauucgccugcgcacccgaccgcugcccaccaaccugcaucuacgucgccggaauggccgagcuaggagccuucuucuccauacuccaagacaugcgcaacaccaucauggcaucaaaaacagucgguaccgccgaagaaaaacucaaaaagaaaagcucauucuaccagagcuaccuacgccgcacccaauccauggguauucaacuagaccaacgcaucauccuacucuauaugcuagaauggggaaaagaaauggucgaccacuuccaccucggcgacgacauggaccccgaacucagaggacucgcccaagcacuaaucgaccaaaaagucaaagaaaucuccaaccaagaaccccucaaaauauag

SEQ ID NO: 7874 - RNA, 1302 nt, Artificial Sequence
  derived and/or modified CDS sequence (opt11) from PUUV(Evo/12Cg/93)__Z30702.1__N
augucggaccuaaccgacauccaagaagacaucacacgacacgaacaacaacugguagucgcucgccaaaaacucaaagacgcagaacgcgccguagaagucgaccccgacgacguaaacaagaacacccuccaagcccgccaacagaccguaucggcacucgaagacaaacuggccgacuacaaacgccgaauggccgacgcagucucccgaaagaaaauggacacgaaaccaaccgaccccaccggcaucgaaccagacgaccaccugaaagagagaagcucccuccgcuacggcaauguccucgacgucaacgcaauagacaucgaagaacccuccggacaaacagccgacugguacaccaucggcguuuacgucaucggcuucaccauccccaucauccucaaagcccuauacaugcucucaacgcgcggcagacaaaccguaaaagaaaacaaaggcacacgcauacgauucaaagacgacaccucauucgaagacaucaacggcaucagacgcccuaaacaccucuacgucucaaugccaacagcccaaucaacuaugaaagcagaagaacucaccccaggccgcuuccgcaccaucguaugcggacucuuccccacgcaaauccaaguacgcaauaucaugucccccgucauggguguaauaggcuucuccuucuucguaaaagacuggcccgagcgcauccgcgaguucauggaaaaagaaugccccuucaucaaaccagaaaucaaacccggcaccccagcccaagaaauggaaaugcuaaaacgcaacaaaaucuacuucaugcaacgccaggacguccucgacaaaaaccacgucgccgacauagacaaacuaauagacuacgcagccucaggagacccaacaagcccagacaacauagacuccccaaacgccccaugggucuucgccugcgccccagaccgcugcccacccacaugcauuuacgucgccggcauggccgaacucggcgcguucuucuccauccuacaagacaugcgcaacaccaucauggcuucaaagacgguuggcacagcagaagaaaaacuacgcaagaaauccuccuucuaccaauccuaccuccgccgcacccaauccaugggcauacaacucgaccaacgcauuauacuccuauucaugcuagaauggggcaaagaaauggucgaccacuuccaccuaggcgacgacauggacccagaacuccgagggcuagcccaagcccuaaucgaccaaaaagucaaagagaucucaaaccaagagccccuaaaaauauaa

SEQ ID NO: 7875 - RNA, 1302 nt, Artificial Sequence
  derived and/or modified CDS sequence (opt11) from PUUV(Evo/14Cg/93)__Z30704.1__N
augagcgaccuaacagacauccaagaagacaucacucgacacgaacaacaacuggucgucgcaagacaaaagcuaaaagacgccgaacgcgcagucgaagucgacccagacgacgucaacaaaaacacccuccaagcacgacagcaaacagucagcgcccucgaagacaaacucgccaacuacaagcgcagaauggccgacgcagucucccgaaagaaaauggacaccaaacccaccgacccaacaggaaucgaacccgacgaccaccucaaagaacgcagcagccuccgauauggcaacguacuagacgucaacgccauagacaucgaagaaccauccggacaaaccgccgacugguacacaaucggcgucuacguaaucggcuucacaaucccaaucauccucaaagcccuuuacaugcugucaacacgcggacgacaaaccgucaaagaaaacaaaggaacccgcauccgauucaaagacgacaccagcuuugaagacaucaacggaaucagacgccccaaacaccuauacguauccaugccgacagcccaaagcaccaugaaagccgaagaacucacacccggacgcuuccgcaccaucgucugcggacucuuccccacgcagauccaaguccgcaacauaauguccccugucaugggaguaaucggauucucuuucuucgucaaagacuggcccgaacgcauccgagaguucauggaaaaagaaugccccuucaucaaaccagaaaucaaaccaggcaccccggcacaagaaauggaaaugcuaaagcgaaacaaaauauacuucaugcaacgccaagacguacuagacaaaaaccacgucgcagacaucgacaaacuaaucgauuacgcagcauccggcggccccaccagccccgacaacaucgacuccccaaacgcccccuggguauucgcaugcgcacccgaccgcugcccgccuacaugcaucuacguagccggcauggccgaauuaggcgcauucuucuccauccuacaagacaugcgcaacaccauaauggcaagcaaaaccgucggcaccgccgaagaaaaacugaaaaagaaaucaucauucuaccaauccuaccuccgccggacccaaagcaugggcauacaacuugaccagcgaaucauccucuuauucaugcucgaauggggcaaagaaauggucgaccacuuccaccucggcgacgacauggaccccgaacuccgaggccucgcacaagcccucauagaccaaaaagucaaagagauaucaaaccaagaaccccuaaaaaucuaa

SEQ ID NO: 7876 - RNA, 1302 nt, Artificial Sequence
  derived and/or modified CDS sequence (opt11) from PUUV(Evo/15Cg/93)__Z30705.1__N
augagcgaccuaacagacauacaagaagacaucacccgccacgaacaacaacucgucgucgcucgacagggccucaaagacgcagaacgggccgucgaaguagacccagacgacgucaauaaaaacgcccuacaagcacgacaacaaacuguauccgcccuggaagacaaacuagccgacuacaaacgccgaauggcagacgcaguaagccgcaagaaaauggacacaaaaccaacagaccccaccgguaucgaacccgacgaccaccugaaagagcgaagcucccuccgcuacggcaacguauucgacgucaacgccaucgacaucgaagaacccucaggccaaaccgccgacugguacaccaucggcgucuacguaaucggcuucaccauacccaucauccugaaagcccuauacaugcucucaacccgcggacgccaaaccgucaaagaaaacaaaggcacccgcauaagauucaaagacgacaccagcuucgaagacauaaacggcauccgcagacccaaacaccuauaugucuccaugccaacagcccaaucaacaaugaaagccgaagaacucacaccagguagauuccggaccaucgucugcggccucuuccccacccaaauccaaguccgaaacaucaugucccccgucaugggcguaaucggauucucauucuucguaaaagacuggcccgaacgcauaagagaguucauggaaaaagaaugccccuucaucaaacccgaaaucaaaccagggaccccagcacaagaaauggaaaugcuaaaacgcaacaaaaucuacuucaugcaacggcaagacguccuagacaaaaaccacgucgcagauaucgauaaacucauagacuacgccgcauccggcgaccccacaucccccgacaacaucgacuccccuaacgcccccugggucuucgcaugcgcccccgaccgaugcccacccacgugcauuuacguagccggaauggccgaacuuggagcauucuucagcauccuacaagacaugcgcaacaccaucauggccucaaaaacagucggcaccgccgaagaaaaacucaaaaagaaaagcuccuucuaccaaucauaccuacgccggacccaaagcaugggcauccaacucgaccaacgcauaauccuccucuucaugcuagaauggggcaaagaaauggucgaccacuuccaccuaggagacgacauggaccccgaacuccgcggccucgcccaagcacucaucgaccaaaaaguaaaagaaaucucaaaccaagaaccccucaaaauauaa

SEQ ID NO: 7877 - RNA, 1302 nt, Artificial Sequence
  derived and/or modified CDS sequence (opt11) from PUUV(Faboviken/Mg26/05)__GQ339484.1__N
augucagaccuggccgacauccaagacgaaaucacccgacacgaacaacagcuagucgccgcacgacaaaaacucaaagacgccgaacgcgccguggaaauggaccccgacgacgugaacaaaaacacccuacaagcacgacaacaaaccgucagcgcccuagaagacaaacucgccgacuucaaacgacgcauggccgacgccguaucaaggaagaaaauggacacaaaaccaaccgacccaaccggcauagaaccagacgaccaccucaaagaaaucuccucccuccgauacggcaacguccucgacgucaacgcaauagacauagaagaacccuccggacaaaccgccgacugguauacaaucggcgucuacgucaucggcuucacauuacccaucauacucaaagcccucuacaugcucuccacacgcggccgacaaaccgucaaagaaaacaaagggacccguauccgauucaaagacgacaccagcuucgaagacaucaacggcauacgaagaccaaaacaccuuuacgucuccaugcccaccgcacaaagcacaaugaaagccgaagaacuaacaccaggacgauuccgaaccaucgucugcggacucuucccgacccaaauccaaguccgaaacaucauguccccagucaugggcgucaucggcuucuccuucuucgucaaagacugggccgaacgcauccgcgaguucauggaaaaagaaugucccuucaucaaacccgaagugaaaccaggcacccccgcacaagaagucgaguuccucaagaaaaacaaaaucuacuucaugcaaagacaagacguacuggacaaaaaccacguagccgacaucgacaaacucaucgacuacgccgccucaggcgaccccaccucccccgacaacaucgaaagccccaacgcccccuggguauucgccugcgccccagaccgcugcccaccaaccugcaucuacgucgccggaauggccgaacugggcgcauucuucucaauacuccaagauaugagaaacaccaucauggccucaaaaaccguaggaacagccgaagaaaaacugaaaaagaaaaguuccuucuaccaauccuaucuacgccgaacacaauccaugggcauccaacuagaccaacgcauaauccuacucuacaugcuagaauggggcaaagaaauggucgaccacuuccaccucggcgacgacauggacccagaacuccgaggacuagcacaagcccuaaucgaccaaaaaguaaaagaaaucuccaaccaagaaccccucaaaauauaa

SEQ ID NO: 7878 - RNA, 1302 nt, Artificial Sequence
  derived and/or modified CDS sequence (opt11) from PUUV(Fyn)__AJ238791.1__N
augagcgaccucaccgacauacaagaagacaucacccgccacgaacaacaacucguagucgcacgacaaaaacuaaaagacgcagaaaaggccguggaaauggacccagacgacgucaacaaaaacacccuacaggcccgccaacaaaccguuucagcacuugaagacaaacuugccgacuucaaacggcgcauggcagacgcagucucacgcaaaaaaauggacaccaaaccaaccgacccaaccggcaucgaacccgacgaccaccucaaagaacgaucaucccuccgauacggcaacguccucgacgugaacgcgaucgacaucgaagaacccuccggacaaaccgcagacugguacaccaucgguguguacgugaucggcuucacacucccaaucauacucaaagcccucuacaugcucagcacccgcggcagacaaaccguaaaagaaaauaaaggcacccgcauccgguucaaagacgacacauccuucgaggacaucaacggcaucagacgcccaaaacaccucuacgucucaaugcccacagcccaauccaccaugaaagcggaagaacuaacgccaggccgcuuccgaacgaucgucugcggccucuuccccacccaaauacaaguccgcaacauaauguccccagucaugggagucaucggguucucauucuucguaaaagacugggccgaacgcauccgcgaauucauggagaaagaaugcccauucaucaaacccgaacuuaaaccaggaaccaacgcccaagaagccgaauuccuaaaaaaaaaccgcguguacuuccucaaccgccaagacguccuagacaaaaaccacgucgccgacaucgacaaacucaucgauuacgccgcaucaggcgaccccaccuccccagacaacaucgaagccccgaacgcccccugggucuucuccugcgcccccgaccgaugcccccccacaugcaucuacgucgccggaauggccgaacucggcgccuucuucagcauacuacaggacaugcgcaacaccaucauggcauccaaaacagucggaacggccgaagaaaaacuaaaaaaaaaaagcucauucuaccaguccuaccuccgucgaacacaauccaugggcauccaacucgaccagcgaauaauccuacuguacaugcucgaauggggcaaagaaauggucgaccacuuccaccuaggagacgacauggacccagaacuccgcggcuuagcccaagcccucaucgaccaaaaagugaaagagaucucaaaccaagaaccccucaaaaucuaa

SEQ ID NO: 7879 - RNA, 1302 nt, Artificial Sequence
  derived and/or modified CDS sequence (opt11) from PUUV(Fyn131)__AJ278093.1__N
auguccgaccugacagacauccaagaagacauaacccgccacgaacaacaacucguaguagcccgccaaaaacucaaagacgccgaaaaagccgucgaaauggaccccgacgacgucaacaaaaacacacuggaagcacgccaacaaacaguauccgcccuagaagacaaacucgccgacuucaaacgcagaaugaccgacgcagucagccgcaaaaaaauggacaccaagccgacagauccaaccggcaucgaaccagacgaccaccucaaagaacgcuccucccuaagauacggcaacguccuagacgucaacgccaucgacaucgaggaaccaucaggacaaaccgccgacugguacaccaucggagucuauguaaucggcuucacccuaccaaucauccucaaagccuuauacaugcucuccacccgcggcagacaaacagucaaagaaaacaaaggaacccgcaucagauucaaagacgacaccuccuucgaagacaucaacggaauaagacgaccaaaacaccuauacgucuccaugcccaccgccccuucaacaaugaaagccgaagaacucacccccggccgcuuccgcaccaucgucugcgggcuauuccccacacaaauccaaguccgaaacaucaugagcccaguaaugggcgucaucggaucauccuucuucgucaaggacugggccgaccgaauacgagaauucauggaaaaagaaugccccuucguaaaacccgaacucaaacccggcaccaaugcccaagaagcagaauuccugaaaaaaaaccgugucuacuucaugaaccgccaagacguacucgacaaaaaccacguagcagacaucgacaaacuaaucgacuacgccgcaucaggcgacccaaccugcccagacaacauagaagcccccaaugcccccuggggcuucgccugcgccccccaccggugcccgcccaccugcauauacguagcaggcauggccgagcuaggcgcauucuucagcauccuucaagacaugcgcaacaccaucauggccagcaaaacagucggcaccgccgaagaaaaacucaaaaaaaaauccucuuucuaccaaucauaucugcgccgcacccaaagcaugggcauccaacucgaccaacgcauaauccuacucuacaugcucgaauggggaagagagaugguagaccacuuccaccuuggagacgacauggacccagaacugcgaggccucgcacaagcacucauaaaccaaaaagucaaagagauaucaaaccaagagccccuaaaaauauaa

SEQ ID NO: 7880 - RNA, 1302 nt, Artificial Sequence
  derived and/or modified CDS sequence (opt11) from PUUV(Fyn47)__AJ278092.1__N
auguccgaccucaccgacauccaggaagacaucacccgccacgaacaacaacucgucguagcccgccaaaaacucaaagacgccgaaaaagcaguagaaauggaccccgacgacgucaacaaaaacacccuccaggcccgccaacaaacagucuccgcucucgaagauaaacucgcagacuucaaacgacgcauggccgacgcagucucacgcaagaaaauggacaccaaacccaccgaccccacaggaaucgaaccagaugaccaucucaaagaacgcuccagccuccgauacggcaauguccucgacgugaacgccaucgacauagaagaacccuccggccaaaccgcagacugguacacgaucggcguauacguaaucggcuucacccuccccauaauccuuaaagcccuauacaugcuauccacacgcggccgccaaaccgucaaagaaaacaaaggcaccagaauccgcuucaaagacgacaccagcuucgaagacauaaacggcauccgccgccccaaacaccuauacgucuccaugccaaccgcccccuccacaaugaaagccgaagaacuaacucccggccgcuuccgaacaaucgucugcggacucuucccaacacagauccaagucagaaaaauaaugucaccagucaugggcgucaucggauucuccuucuucguaaaagacugggucgaaagaaucagagaguucauggaaaaagaauguccauucgucaaaccggaacuaaaacccggcacaaacgcccaagaagccgaguuccuaaagaaaaacagagucuacuucaugaaccgacaagacguccuagacaaaaaccacgucgcagacaucgacaaacuaaucgacuacgccgccuccggagacccaaccucccccgacaacaucgaagccccaaacgcccccugggucuucgcuugcgcaccccaccgcugcccaccgaccugcaucuacguagccggaauggccgaacucggcgccuucuucucaauccuccaagacaugcgcaacgccaucauggccuccaaaaccgucggcaccgccgaagaaaaacucaaaaagaaaucaucauucuaccaauccuaucugcgacgcacacaaucagucggcauccaacuggaccaacgaauaauccuacuauacaugcucgaauggggccgagaaauggucgaccacuuccaccucggagacgacauggacccagaacuccgaggucucgcccaagcccuaaucgaccaaaaagucaaagaaaucuccaaccaagaaccgcucaaaaucuaa

SEQ ID NO: 7881 - RNA, 1302 nt, Artificial Sequence
  derived and/or modified CDS sequence (opt11) from PUUV(Gomselga)__AJ238790.1__N
augucggaccucaccgacauccaagaagacaucacaagacacgagcaacagcuagucgucgcacgacaaaaacucaaagacgcagaaagagcagucgaagucgaccccgacgacguaaacaaaaacacccuacaagcccgccaacaaacaguaagcgcccuagaagacaaacucgccgacuacaaacgcaaaauggcagacgcagucucccgcaagaaaauggacaccaaaccaaccgaccccacaggcaucgaacccgacgaccaccucaaagaacgauccucccuccgcuacggaaacguacuagacguaaaugccaucgacaucgaagacccauccggacaaacagcagacugguacaccauuggagucuacgucauaggcuucacacuccccaucauucucaaagcccucuacaugcucucaacccgaggccgccaaaccgucaaagaaaacaaaggaacacgcauccgcuucaaagacgacaccucauucgaagaaauaaacggcauccgacgccccaaacaccuauacgucagcaugcccacagcgcaaagcacaaugaaagccgaggagcugacaccuggacgcuuccgaaccaucgugugcggccucuucccaacacaaauacaagucagaaacaucguaucacccgucaugggagucaucggcuucuccuucuucgucaaagacuggucccaacgcaucaccgaguucauggaaaaagaaugccccuucaucaaaccagaaguaaaacccggaacccccgcccaagaaauagaaauguucaaacgaaacaagaucuacuucaugcaacgccaagacguccucgacaaaaaccacgucgccgacauagacaagagcaucgacuacgccgccuccgaagaccccaccucacccgacaacaucgacucacccaacgcccccugggucuucgcaugcgcccccgaccgcugcccaccaacaugcauauacgucgcaggaauggccgaacuaggagccuucuucuccauccuccaagacaugagaaacaccaucauggccuccaagaccguaggcaccgccgaagaaaaacucaagaagaaaucaucauucuaccaaucauaccuccgccgcacccaauccaugggaauccagcuagaccaacgcaucauccuccucuuuaugcuagaaugggguaaagaaauggucgaccacuuccaccuaggcgacgacauggacccagaacuccgcggccucgcccaagcacuaaucgaccaaaaaguaaaagaaaucucaaaccaagaaccccuuaaaaucuaa

SEQ ID NO: 7882 - RNA, 1302 nt, Artificial Sequence
  derived and/or modified CDS sequence (opt11) from PUUV(Gyttjea/Mg19/05)__GQ339480.1__N
auguccgaccucacagauauccaagaagacaucacccgccacgaacaacagcuagucguggcacgccaaaaacucaaagaugccgaaaaagccgucgaaauggaccccgacgacguaaacaagaacacccugcaagcccgccaacaaaccgucucagcacuagaagacaaacucgccgacuucaaacgacaaauggccgacgccgucagccgcaagaaaauggacaccaaacccaccgaccccacaggcaucgaacccgacgaccaccuaaaagaacgcucaucgcuccgauacggcaacguacucgacgucaacgccaucgacaucgaagaacccucaggccaaacagccgacugguacaccauaggcguauacgucaucggauucacacucccaaucauucuaaaagcccucuacaugcuauccacacgaggccgacagacagucaaagaaaacaaaggcacccgaauccgcuucaaagacgacacauccuucgaagacaucaacggaauccggcgccccaaacaccucuacgucucaaugccaaccgcccaaucaaccaugaaagccgaagaacucacaccaggccgcuuccgaacaaucgugugcggccucuuccccacccaaauccaaguccgcaacaucaugagcccagucaugggcgucauaggcuucgcauucuucguaaaaggcugggccgaccgcauacgcgaauuuauggaaaaagaauguccauucaucaaaccagaagucaaaccaggaacccccacccaagaaauagaauuucucaagaaaaacaaaguauacuuccuagaccgccaaaccguacuugacaaaaaccacgucgccgacauagacaaacucaucgacuacgccgccuccggcgaccccacgucccccgacaacaucgaauccccaaacgccccaugggucuucgccugcgccccagaccgaugcccaccaaccugcauauacgucgccggcauggcagaacucggagccuucuucucaauccuccaagauaugcgcaacacaaucauggccuccaaaaccguaggaacggccgaagaaaaacuaaagaagaaaagcucauucuaccaauccuaccuccgccgaacacaauccaugggaauccaacucgaccaacgcaucauccuacucuucaugcucgaauggggcaaagaaaugguagaccacuuucaccuaggcgacgacauggaccccgaacucagaggccuagcccaagcccucaucgaccaaaaagucaaagaaaucuccaaccaagaaccccucaaaaucuaa

SEQ ID NO: 7883 - RNA, 1302 nt, Artificial Sequence
  derived and/or modified CDS sequence (opt11) from PUUV(Karhumaki)__AJ238788.1__N
augucagaccucaccgacauccaagaagacaucacccgccacgaacaacagcuaguagucgcccgacaaaaacucaaagacgccgaacgcgccguagaaguagaccccgacgacguaaacaaaaacacacuucaagcccgccaacaaaccgucuccgcccuggaagacaaacuugcagacuacaaacgcaagauggccgacgcagucucccgcaagaaaauggacacaaaaccgacagaccccacaggcaugaaaccagacguccaccuaaaagaaagaucaagccucgaauacggcaacguacucgacgucaacgccaucgacaucgaagaacccagcggccaaacagcagacugguacacuaucggcgucuacgucauaggauucacccuucccaucauccucaaagcccuauacaugcucuccacccgaggccgccaaaccgucaaagaaaacaaaggaaccagaauacgcuucaaagacgacacuuccuucgaagacaucaacgguauacgacgccccaaacaccuauacgucuccaugcccaccgcccaauccacaaugaaagcagaagaauuaacccccggacgcuuccgaaccaucgucugcggccucuuccccacacaaauacaagugcgcaacaucaugagccccgucaugggcguaaucggauuuucauucuucgugaaagacugguccgaacgcauacgcgaguucauggaaaaagaaugccccuucauaaaaccagaaguaaagcccggaacccccgcccaggaaaucgaaaugcuccgaagaaacaaaaucuacuucaugcaacgucaagacguccucgacaaaaaccacgucgcagacaucgacaaacucaucgaccuagccgccuccggggaccccacaucccccgacaacauagacagccccaacgcccccugggucuucgcuugcgcaccagucagaugcccaccgaccugcaucuacguagccggcauggccgaacucggggccuucuucucuauccuccaagacaugcgcaacaccaucauggccagcaagaccgucggcaccgccgaagagaaacucaaaaagaaauccucauucuaccaaagcuaccuacgccgcacccaaagcaugggaauccaacuagaccaacgcauaauccuucucuucaugcuugaauggggcaaagaaauggucgaccacuuucaccucggagacgacauggaccccgaacucagaggccuugcacaagcacucaucgaccaaaaagucaaagaaaucucaaaccaagaaccccucaaaaucuaa

SEQ ID NO: 7884 - RNA, 1302 nt, Artificial Sequence
  derived and/or modified CDS sequence (opt11) from PUUV(Kolodozero)__AJ238789.1__N
augucagaccucacggacauccaagaagacaucacccgccacgaacaacaacucguagucgcccgacaaaaacucaaagacgcagaacgcgccgucgaaguagaccccgacgacguuaacaaaaacacucuccaggcccgccaacaaacugucucagcacuugaagacaaacucgccgauuacaaacgccgaauggccgacgccgucucccgaaagaaaauggacaccaaacccaccgaccccaccggcauugaacccgacgaccaccucaaagaaagauccucccuccgcuacggcaacguccuagacgucaacgccaucgacaucgaagaacccuccggacaaaccgcugacugguacaccaucggaguauacguaauaggcuucacccuucccauaauccuaaaagcccuauacaugcucucaacccgcggcagacaaaccgugaaagaaaacaaaggcaccagaauccgcuucaaagacgacacauccuucgaggacaucaacggcauucgccgucccaaacaccucuacguauccaugcccaccgcccaaucaacuaugaaagccgaggaacucacccccggacgcuuccgcacaaucguaugcggacuaauccccacccaaauacaaguccgcaacaucaugucccccgucaugggcgucauaggauucagcuucuucgucaaagacuggucagaacgcauccgcgaguucauggaaaaagaaugccccuucaucaaaccagaaguaaaacccggcacauccgcacaagaaaucgaaaugcucaaacgcaacaaaaucuacuucaugcaacgccaagacguccucgacaaaaaccacguagccgacauagacaaacuaauugacuacgccgccuccggcgacccaaccucccccgacaacaucgacagccccaacgcaccauggguauucgccugcgcacccgaccgaugcccaccaaccugcaucuacguagcgggcauggccgaauuaggagccuucuucucgauccuccaagauaugcgcaacaccauaauggccuccaaaaccgucggcaccgccgaagaaaaacuaaagaagaaaagcucauucuaccaauccuaccuccgccgaacccaauccaugggcauaccccucgaccaacgaaucauccuccuauucaugcuagaaugggggcaagaaaugguggaccacuuccaccucggcgacgacauggaccccgaacuccgcggacuagcccaagcacuaaucgaccaaaaagucaaagaaauauccaaccaagaaccccucaaaauauag

SEQ ID NO: 7885 - RNA, 1302 nt, Artificial Sequence
  derived and/or modified CDS sequence (opt11) from PUUV(Kuhmo/X11)__GU808825.1__N
augucagaccuaacagacauucaagaagacaucacccgccacgaacaacaacucgucgucgcccgacaaaaacucaaagaugcagaacgcgcaguaggcguggaccccgacgacgucaacaaaaacacacuccaagcccgucaacaaaccgucuccgcccucgaagacaaacuugccgacuacaaacgccgcauggcagacgccguaucccgcaagaaaauggacacaaaacccacugaccccaccggcaucgagcccgacgaccaccugaaagaaagauccagccuccgcuacggcaacguacuagacgucaacgccaucgacaucgaagaacccucaggccagaccgccgacugguacacaauaggcgucuacgugaucggcuucacccuucccaucauccuuaaagcccuauacaugcucucaacccguggucgacaaacaguaaaagaaaacaaaggcacacgcauuagauucaaagacgacaccuccuucgaggacaucaacggcauccgccgccccaaacaccuauacgucuccaugccaaccgcccaguccaccaugaaagcagaggagcucacccccggacgcuuccgaaccaucgucugcggccuauucccaacccaaauccaaguacgcaacaucaugucccccgucaugggcguaaucggcuucuccuucuucgucaaagacuggucagaaagaauacgcgaauuuauggaaaaagaaugccccuucaucaaacccgaagucaaacccggcacccccgcucaagaaaucgaaaugcucaaacgaaaccgaaucuacuucaugcaacgucaagacguccuagacaaaaaccacgucgcagacaucgacaaacucaucgacuacgcggccucaggcgaccccacaucacccgacaacauagacucccccaacgcucccuggguuuucgccugcgccccagaccgcugcccaccaaccugcaucuacgucgccggcauggcagaacuaggagcauucuucucaauccuccaggacaugcgaaacacaaucauggcauccaaaaccgucggcacauccgaagaaaaacuuaaaaagaaauccucauucuaccaauccuaccuccgccgaacccaauccaugggaauccaacucgaccagcgcauaaucuuacucuucaugcucgaauggggaaaagaaaugguagaccacuuccaccucggcgacgacauggaccccgaacuacggggccucgcccaagcccuaauagaccaaaaaguaaaagaaaucuccaaccaagaaccccuaaagauauag

SEQ ID NO: 7886 - RNA, 1302 nt, Artificial Sequence
  derived and/or modified CDS sequence (opt11) from PUUV(Kuhmo/X5)__GU808824.1__N
augagcgaccugacagacauccaggaagacaucacgcgccacgaacaacaacucgucguagcacgccaaaaacucaaagacgccgaacgcgccgucgaagucgaccccgacgacgucaacaaaaacacacuccaagccagacaacaaaccgucagcgcacuggaagacaaacucgcagacuacaagcgucgcauggccgacgccguaucccguaagaaaauggacacaaaacccacagacccuaccggcaucgaaccagacgaccaccuaaaagagcgcucaagccuccgcuacggaaacguacucgacgucaacgccaucgacaucgaagaacccuccggacaaacagccgacugguacacaaucggcguauacguaaucggcuucacacuccccaucauccucaaagcccucuacaugcuauccacccgcggccgacaaacagucaaagaaaacaaaggaacacgcauccgauucaaagacgacaccagcuucgaagacaucaacggcauccgccgccccaaacaccuuuacgucuccaugccaaccgcacaauccacuaugaaagccgaagaacucacccccggccgauuccgaaccauagucugcggccucuucccaacacaaauacaaguccgaaacaucauguccccagucaugggcgucaucggcuucucuuucuucguaaaagacugguccgaacgcaucagagaguucauggaaaaagaaugccccuucaucaaaccagaagucaaaccaggcacccccgcacaagaaaucgaaaugcucaaacgcaaccgcaucuacuucaugcaacgccaagacguacucgacaaaaaccacgucgcagacaucgacaaacuaaucgacuacgccgcaucaggcgaccccaccagccccgacaacaucgacucccccaacgccccaugggucuucgccugcgcacccgacagaugcccacccacaugcaucuacguagccggaauggcagaacuaggagccuucuucuccauacuacaagacaugcgcaacaccauaauggcaagcaaaaccgucggcacagccgaagaaaagcuaaagaagaaaucauccuucuaccaaucauaccuccgccgaacccaauccaugggcauccaacucgaccaacgaaucauccuccuguucaugcuagaauggggcaaagaaaugguagaccacuuccaccuaggcgacgacauggacccagaacucagagggcuagcccaagcccucaucgaccaaaaaguaaaagaaauauccaaccaagaaccccucaaaaucuaa

SEQ ID NO: 7887 - RNA, 1302 nt, Artificial Sequence
  derived and/or modified CDS sequence (opt11) from PUUV(Ljustrask/Mg20/05)__GQ339481.1__N
augagcgaccucacagacauacaagaagacaucacacgccacgaacaacaacucgucgucgcccgccaaaagcucaaagacgcagaaaaagcaguagaaauggacccagacgacguaaacaaaaacacccuacaagcacggcaacaaacaguauccgcccucgaagacaaacucgccgacuucaaacgacagauggcagacgccguuucacgcaaaaagauggacaccaaaccaaccgaccccaccggcaucgaacccgacgaccaccucaaagaaagauccagccuaagauacggcaacguccucgacgucaacgccauagacaucgaagaacccagcggacaaacagccgacugguacaccaucggcguauacgucaucggcuuuacacuccccaucauacucaaagcccucuacaugcucucaacccgcggacgccaaacggucaaagaaaacaaaggcacacgcauccgcuucaaagacgacaccucauucgaagacauaaacggcaucagacgccccaaacaccucuacgucuccaugccaacagcccaaucaaccaugaaagccgaagaacucacaccaggccgcuuccgcacgauagugugcggccucuuccccacacaaauccaagucagaaacaucaugagcccagucaugggcgucaucggauucgcauucuucguaaaaggcugggccgaccgaauccgcgaauuuauggaaaaagaaugccccuucaucaaaccagaagucaaaccaggcaccccaacccaagaaauagaguuccuaaagaaaaacaaaguauacuuccucgaccgccaaaacguccucgacaaaaaccacguagccgauaucgacaaacucauagacuacgccgccuccggcgaccccacguccccagacaacaucgaaucccccaacgcccccugggucuucgccugcgccccggaccgaugcccacccacgugcaucuacguggcaggcauggccgaacuaggcgccuucuucucaauccuccaagacaugagaaacaccaucauggcauccaaaaccgucggaaccgccgaagaaaaacucaaaaagaaaucauccuucuaccaaagcuaccuccgccgaacccaaagcaugggcauacaacuugaccagcgcaucauccuccuguucauguuagaauggggcaaagaaauggucgaccacuuccaccuaggagacgacauggaccccgaacuccgcggccucgcccaagcucucaucgaccaaaaagucaaagaaaucagcaaccaagaaccccucaaaaucuaa

SEQ ID NO: 7888 - RNA, 1302 nt, Artificial Sequence
  derived and/or modified CDS sequence (opt11) from PUUV(Mangelbo/Mg1/05)__GQ339485.1__N
auguccgaccucaccgacauccaagacgaaaucacccgccacgagcaacaacucgucgccgcccgccaaaaacuaaaagacgccgaacgggccgucgaaauggaccccgacgacguaaacaaaaacacacuccaagcacgccaacaaacggucuccgcacucgaagacaaacucgccgacuucaaacgccgcauggccgacgcaguaucccgcaagaaaauggacaccaaaccaaccgaccccaccggaaucgaacccgacgaccaccuaaaagaacgcuccucccuccgcuacggcgacguacucgacguaaacgccaucgacaucgaagaaccaagcggccaaaccgccgacugguacaccauaggcgucuacgucaucggcuucacccuacccaucauccuuaaagcacuuuacaugcucagcacccgcggcaggcaaaccgucaaagaaaacaaaggcacccgcauccgauucaaagacgacacauccuucgaagacaucaacggcauacgccgccccaaacaccucuacgucucaaugcccacagcccaaucuaccaugaaagcagaagaacuaacacccggacguuuccgcaccaucgugugcggacuauuccccacgcaaauccaaguccgcaacaucauguccccagucaugggcgucauaggcuucuccuucuucgucaaggacugggccgaacgcaucagagaguucauggacaaagaaugccccuucaucaagccagaagucaaaccaggcacccccgcacaagagauagaguuccuaaagaaaaacaaaauauacuucaugcaacgccaagacguccuagacaaaaaccacgucgccgacaucgacaaacugaucgauuacgcagccuccggcgacccaacaucccccgacaacaucgaaucccccaacgcccccugggucuucgcuugcgcacccgaucgcugcccacccacaugcauauacguagccggcauggcagaacuaggcgcauucuucuccauacuucaagacaugcgcaacaccaucauggcauccaaaaccguaggcaccgccgaagaaaaacucaaaaagaaaucgagcuucuaccagucauaccuccgccgaacacaaagcaugggcauccaacuagaucaacgcauaauccuacuauacaugcucgaauggggcaaagaaauggucgaccacuuccaccuaggagacgacauggaccccgaacuacgaggacuaacccaagcacucaucgaccaaaaagucaaagaaaucucaaacccagaaccgcucaaaauauag

SEQ ID NO: 7889 - RNA, 1302 nt, Artificial Sequence
  derived and/or modified CDS sequence (opt11) from PUUV(Momignies/55Cg/96)__AJ277033.1__N
auguccgaccucaccgacauccaagaagacaucacacgacaugaacaacaacucgucgucgcccggcaaaaacucaaagacgccgaaaaagccgucgaaauggacccagacgacgucaacaaaaacacccuccaagcccgccaacaaacuguauccgcccuagaagacaaacuggccgacuucaaacgccaaauggccgacgcaguuucacgaaagaaaauggacacaaaacccaccgacccuaccggcauagaacccgacgaccaccucaaagaacgcuccucccuccgcuacggcaacguccuagacgucaacgccauagacaucgaagaacccagcgggcaaacagcagacugguacaccaucggagucuacguaaucggcuucacacuccccauaauacucaaagcacucuacaugcucucaacccgaggccggcaaacagucaaagaaaacaaaggaaccagaauccgcuucaaagacgacaccucauucgaagacauaaacggcauacgccgguccaaacaccucuacguuuccaugcccaccgcacaauccaccaugaaagccgaagaacucacccccggccgauucagaaccaucgucugcggccucuuccccacccaaauccaaguccgcaacauaauguccccagucaugggcguaaucggcuucuccuucuucgucaaagacugggcagaccguauccgcgaguucauggaaaaagaaugccccuucaucaaacccgaaguaaaacccggcacacccgcccaagaagcagaguuccuaaaacgaaacaaaaucuacuucaugcaacgccaagacguccucgacaaaaaccacgucgccgacaucgacaaacuaaucgacuacgccgcauccggagaccccacaucccccgacaacaucgaagccccgaacgccccaugggucuucgcaugcgccccagaccgaugcccuccaaccugcaucuacguagccgggauggcugaacugggagcauucuucuccauccuccaagacaugagaaacaccaucauggcauccaaaaccguaggaacagccgaagaaaaacucaaaaagaaauccuccuucuaucaauccuaccuccgacgcacccaaagcaugggcauacaacuugaccagcgaauaauucuacuauacaugcuggaauggggcaaagaaaugguagaccacuuccaccucuccgacgacauggaccccgaacuccgcggccucgcacaagcccucaucgaccaaaaaguaaaagaaaucuccaaccaagaaccccuaaaaauauaa

SEQ ID NO: 7890 - RNA, 1302 nt, Artificial Sequence
  derived and/or modified CDS sequence (opt11) from PUUV(Montbliart/23Cg/96)__AJ277031.1__N
augucagaccugacagacauccaggaagacaucacccgucacgaacaacaacucguaguugccaggcaaaaacucaaagaugccgaaaaagccgucgaaauggaccccgacgacgucaacaaaaacacacuccaagcacgacaacaaaccgucucagcccuggaagacaaacucgcagacuucaaacgccaaauggcagacgccgucucacgcaagaaaauggacaccaaacccacagaccccaccggaaucgaacccgacgaccaucuaaaagaaagaagcucccuacguuacggcaacguccuugacgucaacgccauugacaucgaagaaccaagcgggcaaacagccgacugguacaccaucggcguauacguaaucggcuucacccuucccauaauacuaaaagcccucuacaugcuauccacccgcggccgccaaacagucaaagaaaacaaaggaacccgaauacgauucaaagacgauaccuccuucgaagacaucaacgguauccgacgacccaaacaccucuaugucagcaugccaacagcccagucaacaaugaaagccgaagaacucacccccggccgcuuccgaacaauaguauguggacucuucccaacccaaauccaaguccgcaacaucaugucccccgucaugggagugauaggguucuccuucuucguaaaagacugggccgaccgcauccgcgaauuuauggaaaaagaaugcccauuuauaaaacccgaaguaaaacccggcacccccgcacaagaagccgaguuccuccgccgcaacaaaaucuacuucaugcaacgccaagaaguucuagacaaaaaccacgucgccgacaucgacaaacuaaucgacuacgcagcauccggagaccccaccagcccagacaacaucgaagcccccaacgcacccugggucuucgccugcgcccccgaccgcugcccaccaaccugcaucuacaucgcuggcauggccgaacuaggcgccuucuucuccauccuccaagacaugcgaaacaccauaauggcauccaaaaccgucggcaccgccgaagaaaaacucaaaaagaaaagcucauucuaccaaucauaccuacgccgcacccaaucaaugggcauccagcuagaccaacgcaucauacuccucuacaugcuagaauggggaaaagaaaugguugaccacuuccaccucggagacgacauggaccccgaacuccgcggacucgcccaagcacucaucgaccaaaaagucaaagaaaucuccaaccaagaaccccucaaaauauaa

SEQ ID NO: 7891 - RNA, 1302 nt, Artificial Sequence
  derived and/or modified CDS sequence (opt11) from PUUV(MuEb10Karlstadt/10)__JN696373.1__N
augucagaccuaaccgacauacaagaagacaucacgcgccacgaacaacagcucgucgucgcccgccaaaaacucaaagacgcagaaaaggccguagaaauggaccccgacgacgucaacaaaaacacccuacaagcacgccaacagacagucucagcacuagaagacaaacuggcagacuacaaaaggcgcauggccgacgccguaagccgcaagaaaauggacaccaaaccaacagaccccacaggcaucgaacccgacgaccaccuaaaagagcgcagcucauuacgguacggcaacguccucgacgucaacgccaucgacaucgaggaaccauccggacaaaccgccgacugguacaccaucggcgucuacguaaucggcuucacccuacccaucauacucaaagcccuuuacaugcucuccacccgaggcagacaaaccguaaaagaaaacaaaggaacccgcauccgcuucaaagacgacaccuccuucgaggacaucaacggaauccgccgacccaaacaccuauacgucucaaugcccaccgcacaauccaccaugaaagcagaagaacucacccccggccgcuuccgaacaaucguaugcggccucuuccccacccaaauccaaguacgcaacaucaugagcccaguaaugggcgugaucggcuucuccuucuucgucaaagacugggccgaacgcauucgagaguucauggaaaaagaaugcccauucaucaagcccgaaaucaaaccaggcaccccaguacaagaagcagaguuccuaaaacgcaacaaagucuacuucaugcaacgccaggaaguacuagacaaaaaccacgucgccgacaucgacaaacuaaucgacuacgcagccuccggagaccccaccucccccgacaacaucgaaagccccaacgcaccauggguauucgccugcgccccagaccgcugcccucccacaugcaucuacgucgccgggauggcagaacuaggcgccuucuucagcauccuccaggacaugcgcaauacaaucauggcauccaaaaccguaggcacagccgaagaaaaacucaaaaagaaauccucauucuaccaauccuaccucagaagaacucaaagcaugggcauccaacucgaccaacgaauaauacuccucuacaugcuagaauggggaaaagaaauggucgaccacuuccaccuaggcgacgacauggaccccgaacuccgcggacucgcccaagcccuaauagaccaaaaagugaaagaaaucucgaaccaagaaccccucaaaauauag

SEQ ID NO: 7892 - RNA, 1302 nt, Artificial Sequence
  derived and/or modified CDS sequence (opt11) from PUUV(MuEb12Lackenberg/10)__JN696374.1__N
auguccgaccuaaccgacauacaagaagacaucacacgacacgaacaacagcucgucgucgccagacaaaaacucaaagacgccgaaaaagcggucgaaauggaccccgacgacguaaacaaaaacacccuccaagcccgccaacagaccguaucagcacucgaagacaaacuggccgacuacaaacgccgaauggcagacgcagucucucgcaagaaaauggacaccaaacccacugaccccacaggcaucgaacccgacgaccaccuaaaagaacguuccucccugagguacggaaacguccucgacgucaacgccaucgacaucgaagaaccauccgggcaaaccgccgacugguacacaaucggaguauacguaauaggcuucacacugccaaucauccucaaagcacuauacaugcucuccacacgcggccgccaaaccgucaaagaaaacaaaggaacccgcaucagauucaaagacgacacauccuucgaagacaucaacggcauccgacgacccaaacaucucuacgucuccaugcccaccgcccaaagcacuaugaaagcggaagaacucacacccggacgcuuccgcaccauagucugcggacuauuccccacccaaauacaaguccgcaacaucaugagccccgucaugggagucaucggcuucuccuucuucgucaaagacugggcagaacgaauccgcgaguucauggaaaaggaaugccccuuuauuaaacccgaaaugaaacccggcacaccagcacaagaagccgaguuccucaaacgcaacaaaguauacuucaugcaacgacaggacguccucgacaaaaaccacgucgccgacaucgacaaacucaucgacuacgccgcaucaggagaccccacaagcccagacaacaucgaaucccccaacgccccaugggucuucgcaugcgcacccgacagaugcccaccaaccugcaucuacguagcaggcauggcagaacucggagcauucuucucaauacuccaagacaugcgcaacaccauaauggcaagcaagaccgucggaaccgccgaagaaaaacucaaaaagaaauccucauucuaccaaucauaccuacgccgcacccaaagcaugggcauccagcuagaccagcgcaucauccuccucuacaugcucgaauggggcaaagaaaugguugaccacuuccaccuaggcgacgacauggaccccgaacuccgcggacuagcccaagcacucaucgaccagaaagucaaagaaaucucaaaccaagaaccccucaaaauauaa

SEQ ID NO: 7893 - RNA, 1302 nt, Artificial Sequence
  derived and/or modified CDS sequence (opt11) from PUUV(Munga/Mg16/05)__GQ339487.1__N
augucggaccucacagacauccaagacgaaaucacccgacacgaacaacaacucguagccgccagacagaaauuaaaagacgcagaacgagccguagaaauggaccccgacgacgucaacaaaaacacacuccaggcccgacaacaaacagucucugcgcucgaagacaaacucgccgacuucaagcggcgcauggcagacgccgucagccgcaaaaaaauggacaccaaaccuaccgaccccaccggcaucgaacccgacgaccaccucaaagaacgauccucccuccgauacggcaacguccuagacgucaacgccauagacaucgaagaacccuccggccaaaccgcagacugguacacaauaggagucuacgucauuggauucacccuaccaaucauacucaaagcacucuacaugcucuccacccgcggucgacaaaccguaaaagaaaacaaaggcacacgcauacgcuucaaagacgacacauccuucgaggacaucaacggcauccgccgccccaaacaccuauacgucuccaugcccaccgcccaguccacaaugaaagccgaagaacucaccccaggaagauuccgaacaauaguauguggccucuuccccacccaaauccaaguccgcaacauaaugucccccgucaugggcgugauaggcuucagcuucuucgucaaagacugggccgaacgcauccgcgaauucauggaaaaagaaugccccuucauaaaaccagaaguaaaacccggcacucccgcccaagaaaucgaauuccuaaaaaaaaacaagauauacuucaugcaacgccaagacguccuagacaaaaaucacguugcagacauagacaaguuaauagacuacgccgccuccggcgaccccaccuccccagacaacaucgaaucgcccaacgcccccuggguauucgccugcgcccccgaccgcugcccacccaccugcaucuacgucgcaggcauggcugaacuaggcgcauucuucagcauccuccaagacaugcgcaacaccaucauggccuccaagaccgucggcaccgccgaagaaaaacucaaaaaaaaaagcuccuucuaccaaagcuaccuccgcagaacccaauccaugggcauccaacuagaccaacgcauaauacugcuguacaugcucgaauggggcaaagaaauggucgaccacuuccaccucggcgacgacauggacccagaacuaagaggccucgcacaggcacucauagaccaaaaagucaaagaaauauccaaccaggaaccccucaaaaucuaa

SEQ ID NO: 7894 - RNA, 1302 nt, Artificial Sequence
  derived and/or modified CDS sequence (opt11) from PUUV(Munga/Mg2/05)__GQ339486.1__N
augucggaccuaaccgacauucaagacgaaaucacacgccacgaacaacagcuagucgcagcacgccaaaaacuaaaagacgccgaaagggccgucgaaauggaccccgacgacgucaacaagaacacccuccaagcccgccaacaaaccgucagcgcacucgaagacaaacucgcagacuucaaacgcagaauggccgacgccgucucacgcaagaaaauggacacuaaacccacagaccccacaggcauagaaccagacgaccaccucaaagaacgcuccucacucagauacggaaacguccuggacaugaaugcgaucgacaucgaagaacccagcggacaaacggccgacugguacaccaucggagucuacguaauaggcuucacucuacccaucauacucaaagcccucuacaugcuauccacacgcggccgccaaaccguaaaagaaaacaaaggcacccgcauccgauucaaagacgacacuuccuuugaagacaucaacggcauccguagacccaaacaccuauacguauccaugcccaccgcccaaagcaccaugaaagccgaagaacucacccccggacgcuucaggaccauaguaugcggccuauuccccacccaaauccaaguacgcaacaucauguccccagucaugggaguaaucggguucagcuucuucgucaaagacugggccgaacgcauccgcgaguucauggaaaaagaaugcccauucaucaaacccgaaguaaaaccagggacccccgcccaagaaauagaguuccuaaagaaaaacaaaaucuacuucaugcaacgacaagacguacucgauaaaaaccacgucgccgacaucgacaaacucaucgacuacgcggcaagcggagaccccacauccccagacaacauagaaucucccaacgcaccaugggucuucgcaugcgcaccggacagaugcccacccacaugcaucuacguagccggaauggccgaacuaggcgccuucuucagcauccuacaagacaugcgcaacaccauaauggcauccaaaaccgucggcaccgcagaagaaaaacucaaaaagaaaucauccuucuaccaguccuaccuccgaagaacccaaagcaugggcauccaacucgaccaaagaaucauccuacucuacaugcucgaauggggcaaagaaaugguagaccacuuccaccuaggagacgacauggaccccgaacuccgcggacucgcacaagcccugauugaccaaaaaguaaaagaaaucucaaaccaagaaccccucaaaaucuga

SEQ ID NO: 7895 - RNA, 1302 nt, Artificial Sequence
  derived and/or modified CDS sequence (opt11) from PUUV(PUU/Cg-Erft)__AJ238779.1__N
augucagaccucacagacauccaagaagacauaacccgacacgaacaacagcuagucgucgcacgccaaaaacuuaaagacgccgaaaaagccgucgaaauggaccccgacgacguaaacaaaaacacccuccaagcccgacaacaaaccgucuccgcacucgaagacaaacuagccgacuucaaacgccaaauggccgacgccgucucacgcaagaaaauggacacuaaacccacagaccccaccggaaucgaacccgacgaccaccucaaagaacgaucaucccuccgcuacggcaacguccucgacguaaacgccaucgacaucgaagaaccauccggccaaaccgccgacugguacaccaucggcguauacgucauaggcuucacacuacccaucauccucaaagcccucuacaugcuauccacccgcggccggcaaaccgucaaagaaaacaaaggaacccgaauacgcuucaaagacgauacauccuucgaagacauaaacgggauccgacgcccaaaacaccuauacgucuccaugccaacagcacaaucaacuaugaaagccgaagaacucacucccggccgcuuccgaacgaucgucugcggccuauuccccacacaaauacaaguacgcaacaucauguccccagucaugggaguaaucggcuucuccuucuucgucaaagauugggccgaccgcauaaagaaauucauggaaaaagaaugccccuucaucaaacccgaagucaaacccggcacaccgucccaagaagcagaguuccuaaaaaugaaccgcaucuacuucaugcaacgccaagaaguccucgacaaaaaccacgucgcagacaucgacaaacucauagacuacgccgcaagcggagaccccaccucccccgacaacaucgaagcccccaacgcaccaugggucuucgccugcgcaccagaccgcuguccacccacaugcaucuacguagccggcauggccgaauugggcgccuucuucagcauccuacaagacaugcgcaacaccaucauggccuccaaaaccgucggaaccgcagaagaaaagcuaaagaagaaaagcuccuucuaccaguccuaccucagaagaacccaauccaugggcauccaacuagaccaacgcaucauacuccuauacaugcucgaauggggaaaagaaauggucgaucacuuccaucucggugacgacauggaccccgaacuaagaggacucgcacaagcccuaauugaccagaaagucaaagaaaucuccaaccaagaaccccucaaaaucuaa

SEQ ID NO: 7896 - RNA, 1302 nt, Artificial Sequence
  derived and/or modified CDS sequence (opt11) from PUUV(Puu/Kazan)__Z84204.1__N
auguccgaccucacagacauccaagaagaaaucacacgccacgaacaacagcuagucguugcccgccaaaaacucaaagacgccgaacgagccguggaagucgaucccgacgaugucaacaaaaacacacuccaagcacgccaacaaaccgucucugcccuagaagacaaauuagccgacuacaaacgccgcauggcggacgcgguaucccgcaagaaaauggacaccaaacccaccgauccuaccggcaucgaacccgacgaccaccucaaagagcgaagcucccuacgcuacggcaacguacuugacguaaacgcaauagacaucgaagaacccagcggccaaaccgcagacugguacacaaucggaguguaugugaucggcuuuaccaucccaaucauacucaaagcccucuauaugcuauccacccgcggccgacaaaccguaaaggaaaacaaaggcacacgcauacgauucaaggacgacaccuccuucgaggacaucaacggaauaagacgcccaaaacaccucuacgucucaaugccaacagcgcaaagcaccaugaaagcagaagaacucacucccggccgcuuccgcaccaucgucugcggcuuauuccccacccaaauacaaguccgaaacaucaugucccccgucaugggcgucaucggcuucuccuucuucgucaaggacuggcccgaacgcauccgcgacuucauggaaaaagaaucuccauucaucaaacccgaaguaaaaccaggcacccccgcccaagaaaucgaguuccuaaaacgaaaccgcguauacuucaugacucgccaagacguccuagacaaaaaccacguagcagacaucgacaaacuaaucgacuacgcagccuccggagaccccaccagccccgacgacauagaaucccccaacgccccaugggucuucgcaugcgccccagaccgaugcccaccaaccugcaucuacgucgccggcauggccgaacucggcgccuucuucuccauccuacaggacaugcgaaacaccaucauggcgagcaaaaccgucggcacagcagaagaaaaacuuaagaagaaaagcucauucuaccagucauaccuccgccgcacacaaucaaugggcauccaacucgaccaacgcaucauccuacucuacauguuagaauggggcaaagagaugguagaccacuuccaccucggcgacgacauggaccccgaacuccguggccucgcacaaucccuaaucgaccaaaaagucaaagaaaucucaaaccaagaaccccucaaaaucuga

SEQ ID NO: 7897 - RNA, 1302 nt, Artificial Sequence
  derived and/or modified CDS sequence (opt11) from PUUV(PUU/Mignovillard/CgY02/2005)__AM695638.1__N
augggcgaccucaccgacauccaagaagacauaacccgccacgaacaacaacuggucgucgcccgccagaaacucaaagacgccgaaaaagccgucgaaauggaccccgacgacgucaacaaaaacacccuccaagcaagacaacaaacagucagcgcccucgaagauaaacuugccgacuucaaacgucgcauggccgacgccgucagcagaaagaaaauggacaccaaaccaaccgacccaacaggcaucgaacccgacgaccaccucaaagaacgcucaagccuacgcuacggcaacguccuagacguaaacgcgauagacaucgaagaacccagcggacaaacagcagacugguacaccaucggagucuaugucauaggcuucacccucccaaucauacucaaagcccucuacaugcucucgacacgaggccgacaaaccgucaaagaaaacaaaggaacccgcauacgauucaaagacgacaccagcuucgaagacaucaacggaauacgccgucccaaacaccuauacgucucaaugcccaccgcucaaagcacaaugaaagcagaagaacucacacccggacgauuccgcaccaucgucugcggccucuuccccacccaaauccaagugcgcaacauaaugagccccguaaugggcgucaucggauucagcuucuucgucaaagacuggacagaucgcauacgagaauuuauggaaaaagaaugccccuucauuaaaccagaaaugaaacccggcacccccgcacaagaagcagaguuccucaaacgaaacaaaaucuacuucaugcaacgccaagauguccuagacaaaaaccacguagccgacaucgacaaacuaaucgacuaugccgccucgggagaucccaccagccccgacaacaucgaauccccaaacgccccaugggucuucgcaugcgcacccgaccggugcccacccacaugcaucuacgucgcaggcauggccgaacucggagcauucuucagcauccuacaagacaugagaaacaccaucauggccagcaaaaccguaggcacagccgaagaaaaacuaaagaagaaaagcagcuucuaccaaucauacuuacgccgaacccaauccaugggcauacaacucgaccaacgcaucauacuccucuacaugcuggaauggggcaaagaaauggucgaccacuuccaccucggagacgacauggacccugaacuccgaggccuggcccaagcacuuauagaccaaaaagucaaagaaaucucaaaccaagaaccacuaaaaaucuaa

SEQ ID NO: 7898 - RNA, 1302 nt, Artificial Sequence
  derived and/or modified CDS sequence (opt11) from PUUV(PUUV/Croatia_Gerovo/Mg938/2008)__KC676609.1__N
auguccgaccucaccgacauucaagaagacaucacccgccacgaacaacaacucguagucgcacgccaaaaacuaaaagacgccgaaaaagccguagaaauggacccggacgacgucaacaaaaauacccuccaagcccgacagcaaacaguauccgcccuggaagacaaacucgccgacuucaaacgccgaauggccgacgccgucucacguaagaaaauggacaccaaacccaccgaccccaccggcaucgaaccugacgaccaccucaaagagcgcucuagccuucgauacggcaacguccucgacgugaacgccaucgacaucgaagaacccagcggacaaaccgcagacugguacaccauaggcgucuacguaaugggcuucacccucccuaucauacucaaagcccucuacaugcucuccacccgaggccgccaaaccguaaaagaaaacaaaggcacccgcauaagauuuaaagacgacaccucauucgaggacaucaacgguauccgacgcccaaaacaccucuacgucuccaugccaaccgcccaauccaccaugaaagcggaagaacuaacccccggccgcuuccgcaccaucgugugcggccucuuccccacucaaauacaaguccgaaacaucaugagccccguaaugggaguaauaggcuucucauucuucgucaaagacuggagcgaacgcguccgcgacuucauggaaaaagaaugccccuucauaaaacccgaaaucaaacccggaacaccccaacaagaagcagaguuccucaaacgcaacaaagucuacuucaugcaacgccaagacguucucgacaaaaaccacguggcugacauagacaaacuaaucgacuacgcagcauccggcgaucccaccuccccagacaacaucgaaagccccaacgcccccugggucuucgcaugcgccccagaccgcugcccuccaaccugcaucuacguagcagguauggccgaauuaggcgcauucuucagcauccuccaggacaugcgcaacaccaucauggccuccaagacagucggcaccgccgaggaaaaacucaagaaaaagucaucguucuaucaauccuaccugcgccgcacccaauccaugggaauccaacuagaccaacgcaucauccuccucuacaugcucgaauggggcaaagaaaugguagaccacuuccaccucggcgacgacauggaccccgagcuacgcggccucgcccaagcacuaaucgaccaaaaagucaaagaaauauccaaccaagaaccccuaaagaucuaa

SEQ ID NO: 7899 - RNA, 1302 nt, Artificial Sequence
  derived and/or modified CDS sequence (opt11) from PUUV(PUUV/Croatia_Gerovo/Mg979/2008)__KC676613.1__N
augucagaccucacagacauccaagaagacauaacccgccacgaacaacaacucgucgucgcccgccaaaaacucaaagacgccgagaaagccgucgaaauggaccccgacgacgucaacaaaaacacccuacaagcccgccaacaaaccgucucagcccucgaagacaaacucgccgacuucaaacgccgcauggccgacgccgucucacgcaagaaaauggacacaaaacccaccgaccccaccggcauagaaccagacgaccaccuaaaagaaagauccucccuacgcuacggcaacguccuagacguaaacgcgauagacaucgaggaaccaucagggcaaacggcagacugguacaccauaggcgucuacgucaucggguucacacuaccaaucauccucaaagcccucuacaugcucuccacccgcggccggcaaacggucaaagaaaacaaaggcacccgaauccgauucaaagacgacacauccuucgaagacaucaacggcauccgacgccccaaacaccucuacgucucgaugccaaccgcccaauccaccaugaaagcagaagaacucaccccugggcgcuuucgcaccaucgucugcggccuauucccgacccaaauacaaguacgcaacaucaugagcccagugaugggaguaaucggcuucuccuucuucgucaaagacuggagcgaaagaguccgagacuucauggaaaaagaaugccccuucauaaaaccagaaaucaagccaggaaccccgccucaagaagccgaguuccucaaacgcaacaaaguauacuucaugcagcgucaagacguccuggacaaaaaccacguagcagacaucgacaaacuaaucgacuacgccgcaagcggcgaccccaccagccccgacaacaucgaaucuccaaacgcgcccugggucuucgccugcgcacccgaucgcugcccacccacaugcaucuacguagcaggcauggcagaacucggagcguucuuuuccauccuccaagacaugcgaaacacaauaauggccagcaaaaccgucggcacugccgaagaaaaacucaaaaagaaaagcucauucuaccaauccuaccuccgcagaacccaaagcaugggaauacaacucgaccaacgcaucauccuccuauacaugcuggaauggggcaaagagaugguagaccacuuccaccucggcgacgacauggaccccgaacuacgcggccuagcccaagcacucaucgaccaaaaagucaaagaaaucagcaaccaagaaccacucaaaauauaa

SEQ ID NO: 7900 - RNA, 1302 nt, Artificial Sequence
  derived and/or modified CDS sequence (opt11) from PUUV(PUUV/Konnevesi/Mg_M114B/2005)__JQ319171.1__N
auguccgaccuaaccgacauccaagaagacauaacacgccacgaacaacagcuagucguagcaagacaaaagcuaaaagacgcugaacgagccguagaggucgaccccgacgacguaaacaaaaacacgcuccaagcccgccaacaaacaguguccgcccuagaagacaaacuagccgacuacaaacgccgcauggcggacgcagucucccgaaagaaaauggacaccaaacccaccgaccccaccggcaucgaacccgacgaccaccucaaagaacgcuccucccucagguacggaaacguccuagacguaaacgccauugacaucgaggaacccuccggacaaaccgccgacugguacaccauaggcgucuacguaauaggauucacccuacccaucauacucaaagcccuauauaugcucucaacccgcggccgacaaacagucaaagaaaacaaagggacccgcauccgcuucaaagacgacaccucauucgaagacaucaacggcauccgccgccccaaacaccuauacgucucaaugcccaccgcgcaaagcaccaugaaagccgaggaacuaacccccggccgcuuccgaacaauaguaugcggacucuucccaacucaaauacaaguccgcaacauuaugagccccgucaugggcgucaucggcuucuccuucuucguaaaagacuggcccgaacgaauacgcgaguucauggaaaaagaaugccccuucaucaaacccgaagucaaaccaggcaccccggcacaagaaauagaaaugcucaaacgcaacaaaaucuacuucaugcaacgacaagacguauuggacaaaaaccacgucgcagacaucgacaaacucaucgacuacgcagccuccggagacccaacaucacccgacaacaucgacagccccaacgcccccugggucuucgccugcgcacccgaccgcugcccaccaaccugcaucuacguugccggaauggccgaacucggagccuucuucagcauccuccaagauaugcgaaacaccaucauggccuccaaaaccgucggcaccgccgaagaaaaacucaagaaaaagagcucauucuaccaauccuaccuaagacgaacccaauccaugggcauccaacucgaccaacgcauaauccuccuauucaugcuggaauggggcaaggaaauggucgaccacuuccacuucggagacgacauggaccccgaacuucgaggacucgcccaagcacucaucgaccaaaaagugaaagaaaucucaaaccaggaaccccucaaaaucuga

SEQ ID NO: 7901 - RNA, 1302 nt, Artificial Sequence
  derived and/or modified CDS sequence (opt11) from PUUV(PUUV/Konnevesi/Mg_M94A/2005)__JQ319163.2__N
auguccgaccugacugacauacaagaagacaucacacgacaugaacaacaacucguagucgcccgccaaaaacucaaagacgcagaacgagccgucgaagucgauccggacgacgucaacaaaaacacccuccaagcucgccaacaaaccguaucagcccucgaagauaaacucgccgacuacaaaagaagaauggccgacgcaguaagccgcaagaaaauggacacaaaaccaaccgaccccaccggcaucgaacccgacgaccaccuaaaagaacgaucgucccuccgguacggcaacguccucgacguaaacgccauagacaucgaagaaccauccggacaaaccgccgacugguacaccauaggcgucuacgucaucggcuucacacuacccaucauacuuaaagcccucuacaugcuuuccacccgcggccgacaaacagucaaagaaaacaaaggaacacgcauccgcuucaaagacgacaccuccuucgaagacaucaacggaauccgacgccccaaacaccucuacgucucaaugcccaccgcgcaaucaaccaugaaagccgaagaacucacacccggccgcuuccgaaccaucgucugcggacucuuccccacccaaauccaaguacgcaacaucaugagcccaguaaugggcguaaucggcuucuccuucuucguaaaagauuggcccgaacgaauaaaagaguucauggaaaaagaaugccccuucaucaaacccgaaguuaaaccaggcaccccagcccaagaaaucgaaaugcuaaaacgaaacaaaaucuauuucaugcaacgacaagacguacucgacaaaaaccacgucgccgacaucgacaaacuuaucgacuacgcggccagcggcgaccccaccagccccgacaacaucgacuccccaaacgcccccugggucuucgccugcgcuccugaccgcugcccaccaaccugcauauacgucgccggcauggcagaacucggcgccuucuucagcauacuccaagacaugcgaaacaccaucauggccuccaaaacaguaggcaccgccgaggaagaagucaaaaagaaaaguuccuucuaccaaagcuaccuccgccggacccagucaaugggcauacaacuggaccaacgaaucauccuccucuucaugcuagaauggggcaaagaaauggucgaccacuuccaccuaggcgacgacauggaccccgaacugcgcggacucgcccaagccaugaucgaccaaaaaguaaaagagauauccaaccaagaaccccuaaaaauauaa

SEQ ID NO: 7902 - RNA, 1302 nt, Artificial Sequence
  derived and/or modified CDS sequence (opt11) from PUUV(PUUV/Konnevesi/Mg_O14B/2005)__JQ319166.1__N
augagcgaccucaccgacauccaagaagacaucacccgccacgaacaacagcuagucgucgcccgacaaaaacuaaaagacgccgagagggccguagaagucgaccccgacgacgucaacaaaaacacacuacaagcccgccaacaaacagucuccgcccucgaagacaaacucgccgacuacaaacgacgcauggcagacgccgucucccgcaagaaaauggacacaaaaccaaccgaccccaccggcaucgaacccgacgaccaccucaaagaaagauccagccuacgcuacggcaacguccucgacguaaacgccauagacaucgaagaaccauccggccaaaccgcagacugguacacaauaggagucuacguaauaggcuucacccuacccaucauccucaaagcacuauacaugcucuccacccgcggccgccaaaccgucaaagaaaacaaaggcacccgcauccgcuucaaagacgacaccagcuucgaagacaucaacggcauccgccgccccaaacaucucuacgucuccaugccaaccgcccaaucaaccaugaaagcagaagaacucacccccggccgguuccgcacaaucgucugcggccuauuccccacacaaauccaaguacgaaacauaaugucacccgucaugggcguaauaggauucucauucuucgucaaggacuggccagaacgcauacgcgaguucauggaaaaagaaugccccuucaucaaacccgaaguaaaaccaggaacgcccgcacaagaaaucgaaaugcuaaaacgcaacaagauauacuucaugcaacgacaagacguccuagacaaaaaccacgucgcagacaucgacaaacuaauagacuacgccgccuccggagaccccaccucccccgacaacaucgacucaccaaacgcccccugggucuucgcaugcgccccggaccgcugcccacccacaugcauauacguagccggcauggccgaacugggagccuucuucuccauccuucaagacaugcgcaacacuauaauggcaagcaaaaccgugggaaccgccgaagaaaaacuaaagaagaaaagcuccuucuaccaguccuaccuccgccgcacacaauccaugggaauacaacucgaccagagaaucauccuacuauucaugcucgaguggggaaaagaaaugguagaccacuuucaccucggagacgacauggaccccgaacuccgaggacuagcacaagcccucaucgaccaaaaaguaaaagagauaagcaaccaagaaccccucaaaauauaa

SEQ ID NO: 7903 - RNA, 1302 nt, Artificial Sequence
  derived and/or modified CDS sequence (opt11) from PUUV(PUUV/Konnevesi/Mg_O22B/2005)__JQ319168.2__N
auguccgaccucacagacauacaagaagacaucaccagacacgaacaacagcuagucguagcccgacaaaaacucaaagacgcagaacgcgccguagaaguagaucccgacgacgucaacaaaaacacgcuacaagcccgacaacaaaccgucucagcccuagaagacaaacuugcagacuacaaacgacgcauggccgacgccgucagccgcaagaaaauggacacaaaaccaacagaccccaccggcauagaacccgacgaccaccucaaagaaagauccagccucagguacggcaacguacucgacgucaacgcaaucgacauagaagaaccauccggacaaacagccgauugguacaccaucggcgucuacgucauaggcuucacccuccccauaauccuaaaagcccuauacaugcugucaacccgaggccgacaaaccgucaaagaaaacaagggcacccgaauccgcuucaaggacgacacauccuucgaggacauaaacggcauacgacgccccaaacaccucuacgucucuaugcccaccgcccaaagcaccaugaaagccgaagaacuaacccccggccgauuccgcaccaucgucugcggacuauucccaacacaaauccaaguacgcaacaucaugucacccgucaugggcguaaucggcuucagcuucuucgucaaggacuggccagaacgcauccgagaguucauggaaaaagaaugccccuucaucaaacccgaagucaaacccggcaccccugcccaagaaaucgaaaugcucaaacgaaacaaaaucuacuucaugcaaagacaagacguccuggacaaaaaccacguagcagacaucgacaaacucaucgacuacgcagcuucaggcgaccccaccagccccgaaaacaucgacagccccaacgcccccuggguguucgccugcgcccccgaccgcugcccacccacaugcauauacguagccggcauggcagaacucggcgcauucuucucaauccuacaagacaugcgaaacacaaucauggccuccaaaaccgucggcaccgcggaagaaaaacucaagaaaaagagcagcuucuaccaaagcuaccugcgcagaacacaaagcauggguauacaacucgaccaacgcaucauccuacuauucaugcucgaauggggaaaagaaaugguagaccacuuccaccucggcgacgacauggaccccgaacuacgaggccacgcacaagcacucaucgaccaaaaagugaaagaaauaucaaaccaagaaccccucaaaaucuaa

SEQ ID NO: 7904 - RNA, 1302 nt, Artificial Sequence
  derived and/or modified CDS sequence (opt11) from PUUV(PUUV/Konnevesi/Mg_O57A/2005)__JQ319161.2__N
auguccgaccuaaccgacauccaagaagacaucacccgccacgaacaacaacucgucgucgcccgacaaaaacucaaagacgccgaacgagcaguagaagucgacccagacgacgucaacaaaaacacccuacaagcacgacaacaaacagucuccgcccuagaagacaaacuggcagacuacaaaagacgcauggccgacgccgucucgcgcaagaaaauggacacgaaacccaccgaucccacaggcaucgagccagacgaccaccuaaaagaacgauccagccuacgcuacggaaacguccuagacgucaacgccaucgacaucgaagaacccagcggccaaaccgccgacugguacaccaucggcguauacgucaucggguucacccucccgaucauccucaaagcacuauacaugcuaagcacacgaggccgccaaacagucaaagaaaacaaaggaacacgcauacgcuucaaagaugacaccucguucgaagacauaaacggcauccgccgccccaaacaccuauacguaucaaugcccaccgcccaaucaaccaugaaagccgaagaauuaacaccaggcagauuccgcaccaucguaugcggccucuucccaacccgcauccaagugagaaacaucaugucccccguaaugggagugaucggguucuccuucuucgucaaagacuggcccgaacgcaucaaagaguucauggaaaaagaaugcucauucaucaaacccgaaguaaaaccaggcacaccagcccaagaaaucgaaaugcucaaacgcaacaaaaucuauuucaugcagcgccaggacguccucgacaaaaaccacguagcagacaucgacaaacucaucgacuacgcagccagcggcgaccccaccucccccgacaacaucgacuccccgaacgcccccuggguuuucgccugcgcccccgaccgcugcccacccacaugcaucuacgucgccggcauggccgaacucggcgcguucuucagcauccuccaagauaugcgaaacacaaucauggcaucaaaaacagucggcaccgccgaagaagaagucaaaaagaaaagcuccuucuaccaauccuaccuccgccgcacccagagcaugggcauccaacuggaccaacgcaucauccuccucuucaugcucgaauggggcaaagaaaugguagaccacuuccaccucggcgaugacauggacccagaacuacgcggacucgcacaagcacuaaucgaccaaaacgucaaagaaaucuccaaccaagaaccccuaaaaauauaa

SEQ ID NO: 7905 - RNA, 1302 nt, Artificial Sequence
  derived and/or modified CDS sequence (opt11) from PUUV(PUUV/Konnevesi/Mg_O6B/2005)__JQ319164.1__N
auguccgaccuaaccgacauccaagaagacaucacccgccacgaacaacaacucgucgucgcaagacaaaaacuaaaagacgccgaacgcgccgucgaagucgaccccgacgacgucaacaaaaacacacuacaggcacgccaacaaacugucuccgcccuugaagacaaacucgcagacuacaaacgcaggauggcagacgccgucucccgaaagaaaauggacaccaaaccaacagaccccaccggcauugaacccgacgaccaccucaaagaacgcucaucauuacgcuacggcaacguccuagacgucaacgcaauagacaucgaagaacccagcggccaaacggcagacugguacaccaucggcgucuacguaaucggauucacccuccccaucauccucaaagcacucuacaugcucucaacccgaggcaggcaaaccgucaaagaaaacaaagggacccgcauccgcuucaaagacgacacaucauucgaagacaucaacggcauaagacgccccaaacaccucuacgucucaaugccuacagcacaaucaaccaugaaagccgaggaacucacccccggccgcuucagagccaucguaugcggacucuuccccacccaaauacaaguccgcaacaucaugagccccgucaugggcguaauaggcuucucguucuucgucaaagacuggcccgaacgaauccgcgaguucaugggaaaagaaugccccuucauaaagccugaagucaaacccggcacccccgcacaagaaauagaaaugcuaaaacgcaacaaaauauacuucaugcagcgacaagacguccuggacaaaaaccacgucgcugacauagacaaacuaaucgacuacgccgccuccggcgaucccaccagcccagacaacauagacaguccgaacgcacccugggucuucgccugcgcccccgaccgaugcccgccgaccugcaucuauguagccggaauggccgaacucggcgcauucuucuccauucuccaagacaugagaaauaccaucauggccagcaaaacaguaggcaccgccgaagaaaaacucaaaaagaaaagcucguucuaccaauccuaccuacgcagaacccaaucaaugggcauccaacucgaccaacgcaucauccuccuauuuaugcucgaguggggcaaagaaauggucgaccacuuccaccuaggcgacgacauggaccccgaacuacgaggccucgcccaagcccucaucgaccaaaaaguuaaagaaauaagcaaccaagaaccccuaaaaaucuaa

SEQ ID NO: 7906 - RNA, 1302 nt, Artificial Sequence
  derived and/or modified CDS sequence (opt11) from PUUV(PUUV/Konnevesi/Mg_O74B/2005)__JQ319170.1__N
augagcgaccucaccgacauccaagaagacaucaccagacacgaacaacagcuagucgucgcccggcaaaaacucaaagacgccgaacgcgccguagaagucgaccccgacgacgucaacaaaaacacacuccaagcccgccaacaaaccguauccgcacuagaagacaaacuagccgacuacaaacgccguauggccgacgccgucucccguaagaaaauggacacaaaaccaaccgaccccacaggcaucgaaccggacgaccaccucaaagaacguuccucacuacgcuacggcaacguccucgacguaaacgcaaucgacauugaggaacccuccggccaaacagccgacugguacacaaucggcgucuacgucaucggcuucacccucccaauaauacuaaaagcacuauacaugcugagcacccgcggucgccaaacagucaaagaaaacaaaggcacccgcauccgauucaaagacgacaccuccuucgaagacaucaacggcauccgucgccccaaacaccuguacgucuccaugcccacagcccaauccacaaugaaagccgaagaacuuacaccaggccgcuuccgcacaaucgucugcggccuauuccccacccaaauacaaguaagaaacauaaugucccccguuaugggcguaauaggcuucuccuucuucgucaaagacuggcccgagcgcauccgcgaguucauggaaaaggaaugccccuucaucaagcccgaaguaaaacccggaacccccgcccaagaaaucgagaugcuaaaaagaaacaaaaucuacuucaugcaacgacaagacgugcuagacaaaaaccacguagccgacaucgacaaacuaaucgacuacgcagcaucaggcgaccccaccagcccagacaacauagacucgcccaacgcccccuggguauucgccugcgcacccgaccgcugcccacccacaugcaucuacgucgcaggcauggccgaacucggcgccuucuucucaauccuccaagacaugcgcaacacaauaauggcguccaaaaccgucggcacaguagaagaaaagcuaaagaagaaauccagcuucuaccaaagcuaccuccgccggacccaauccaugggcauacaacuagaccaacgcauuauccuacuauucaugcucgaguggggcaaagaaauggucgaccacuuccaccucggggacgacauggacccagaacuccgcggccucgcccaagcccuaaucgaccaaaaagucaaagaaaucucaaaccaagaaccccuaaaaauauaa

SEQ ID NO: 7907 - RNA, 1302 nt, Artificial Sequence
  derived and/or modified CDS sequence (opt11) from PUUV(PUUV/Konnevesi/Mg_O78A/2005)__JQ319162.2__N
auguccgaccuuaccgacauacaagaagacauuacccgccacgaacaacaacuggucgucgccagacaaaaacugaaagacgccgaaaaagccgucgaaguagaccccgacgacguaaacaagaacacccuccaagcccgccaacaaaccgucucagcccucgaagacaaacucgcugacuacaaacgccgaauggccgacgccguaucacgaaagaaaauggacacaaaacccaccgaccccacaggcaucgaacccgacgaccaccucaaagaacgcagcuccuuacgcuacggcaacguccuggacgucaacgcaaucgacaucgaggagcccuccggccaaaccgccgacugguacacaauaggcguauacguaauaggauucacccucccgaucauccucaaagcccucuacaugcucagcacacgcggccgccaaacagucaaagaaaacaaaggaacacgaauccgcuucaaagacgacaccagcuucgaagacaucaacggaauccgccgccccaaacaccucuacguuuccaugcccacugcccaauccacaaugaaagccgaagaacuaacccccggacgcuuccgcaccaucgucugcggccucuucccaacacaaauccaaguccgaaacaucaugagcccagucaugggcgucauaggcuucuccuucuucgucaaagacuggccagaaagaauacgagaguucauggaaaaagaaugccccuucaucaaacccgaagucaaaccaggcacaccagcacaagaaaucgaaaugcuuaaacgaaacaaaaucuacuucaugcaacgccaagacguacucgacaaaaaccacguagcggacaucgacaaacuuaucgauuacgcagccuccggcgaccccaccucccccgacaacaucgacuccccaaacgcucccuggguccuugcaugcggacccgaacgcugcccaccaaccugcaucuacgucgcuggcauggccgaacuuggcgccuucuucucaauacuccaggacaugcgaaacaccaucauggccagcaaaacaguaggaagcgacgaggucaaacucaaaaagaaauccuucuucuaccaguacuaccuacgacgaacccacuccaugggcauccaacucgaccaacgcaucaucuuacucugcaugcuagaauggggcaucgaaauggucgaccacuuccaccuaggcgacgacauggaccccgaacuccgcggccuagcacaagcaaugaucgaccagaaagucaaagaaauauccaaccaagaaccccuaaucauauaa

SEQ ID NO: 7908 - RNA, 1302 nt, Artificial Sequence
  derived and/or modified CDS sequence (opt11) from PUUV(PUUV/Mg23/HungaryTR17/00)__FN377822.1__N
augucagaccucacagacauccaagaagacaucacacgacacgaacaacagcuagucgucgcacgacaaaaacuaaaagacgcagaaaaggccguagaaauggacccagacgacgucaacaagaacacauuacaagcacgccaacaaacagucuccgcgcucgaagacaaacucgccgacuucaaacgaagaauggcagacgccgucagccgcaagaaaauggacacgaaaccaacagaccccaccggcaucgaaccagacgaccaccuaaaagaacgcuccagccuccgcuacggcaacguacucgacgucaacgccauagacaucgaagaacccagcgggcaaaccgccgauugguacaccauaggcgucuacgucaucggauucacccuccccauuauucucaaagcacuguacaugcucucaacccgcggcagacaaaccgucaaagaaaacaaaggcacccgcauacgauucaaagacgacacauccuucgaagacaucaacggcauccgccgacccaaacaccucuacgucuccaugccgaccgcgcaauccacaaugaaagccgaagaacuaaccccaggccgauuccgcaccaucgucugcggacucuuccccacacaaauacaaguacgaaacauaaugagccccguaaugggcgucauaggguucucauucuucgucaaagacugguccgaacgcguacgagaguucauggaaaaagaaugcccauucauaaagccagaaauaaaaccaggcaccccaccccaagaagccgaguuccuaaagcgcaacaaaguauacuucaugcagcgacaagacguacucgacaaaaaccacgucgcagacauagacaaacucaucgacuacgccgcaucaggcgaccccacauccccagacaauaucgaaagccccaacgcccccuggguauucgccugcgcucccgacagaugcccgccaaccugcaucuacguagccggaauggccgaacucggagcauucuucagcauccuacaagacaugcgaaacaccaucauggccagcaaaaccgucgggaccgcggaagaaaagcucaaaaagaaauccagcuucuaccaaagcuaccuccgcagaacacaaagcaugggcauccaacuggaccaacgaauuauccuccucuauaugcuagaauggggcaaggaaauggucgaccacuuccaccucggagacgacauggaccccgaacuccgcggccuggcccaagcacucauagaccaaaaagucaaagaaaucuccaaccaagaaccccuaaaaaucuaa

SEQ ID NO: 7909 - RNA, 1302 nt, Artificial Sequence
  derived and/or modified CDS sequence (opt11) from PUUV(PUUV/Mg9/HungaryTR17/00)__FN377821.1__N
auguccgaccucgccgacauccaagaagacaucacccgacacgaacaacaacucgucgucgcaaggcaaaagcuaaaagacgcggaaaaagccguagaaauggacccagacgacgucaacaaaaacacacuacaagcccgccaacaaacugucucagcacucgaagacaagcucgccgacuucaaaagacgcauggcagacgcagucucaagaaagaaaauggacaccaaaccaaccgaccccacaggaaucgaacccgacgaccaccucaaagaacgcuccagccucagauacggcaacguccucgacgucaacgccaucgauaucgaagaaccgagcggccaaacagccgacugguacaccaucggcgucuacgucaucggcuucacccucccgauaauccuaaaagcccuguacaugcuaucaaccaggggcagacaaacugucaaagaaaacaaaggcacacgcauccgauucaaagacgacaccucguucgaagacaucaacggaauccgccgccccaaacaccuauacgucucaaugccaaccgcacaaucaaccaugaaagcagaagaacucacacccgggcgcuuccgaaccaucgucugcggccuauuccccacacaaauccaagugcgaaacaucaugagcccagucaugggcgucauaggauucagcuucuucgucaaagacuggucagaacgagugcgcgaguucauggaaaaagaaugccccuucaucaaacccgaaaucaaacccggaaccccaccccaagaagccgaguuccugaagcgcaacaaaguauacuucaugcaacgccaagacgugcucgacaaaaaccacguagccgacauagacaaacucauagacuacgcagccucuggcgaccccaccagccccgacaacaucgaaagcccgaacgcacccugggucuucgccugcgcccccgaccgaugcccacccacaugcaucuacgucgccggcauggccgaacucggcgcauucuucuccauacuccaagacaugcgcaacacaauaauggcauccaagaccgucggcaccgccgaagaaaagcugaaaaagaaauccucguucuaccaaucauaccugcgcagaacccagagcaugggcauccaacuagaccagcgaauaauccuacuauacaugcucgaauggggcaaagaaauggucgaccacuuccacuugggcgacgacauggaccccgaacuccguggccucgcacaagcacucauagaccaaaaagugaaagaaaucucaaaccaagaaccacuaaaaaucuaa

SEQ ID NO: 7910 - RNA, 1302 nt, Artificial Sequence
  derived and/or modified CDS sequence (opt11) from PUUV(PUUV/NL/Mg1012/2010)__KU314900.1__N
auguccgaccucaccgacauacaggaagacauaacccgccacgaacaacagcuaguaguagcaagacaaaaacucaaagacgccgaaaaggccgucgaaauggacccagacgacgucaacaaaaauacccuacaagcccgccaacaaacagucucagcucuagaagacaaacucgccgacuacaaacgacgcauggcggacgccgucucgcgcaagaaaauggacacaaaacccaccgacccaaccggcauagaaccagacgaccaccucaaagaacgcucaagccuccgcuacgggaacguccucgacgucaacgccaucgacauagaggaacccagcggccaaaccgccgacugguacacaaucggcgucuacgucaucggauucacccuccccaucauccucaaagcacuauacaugcucuccacucgaggacggcaaacagucaaagaaaacaaagguacucguauccguuucaaagacgacaccuccuucgaagacauaaacggaauccgaagaccgaaacaccuauacgucuccaugcccaccgcccaauccacaaugaaagccgaagaacuaacccccggccgauuccgcacaaucguaugcgggcuauuccccacccaaauccaagugcgcaacaucauguccccuguaaugggcguaaucggcuucuccuucuucgucaaagacuggccagaccgaauccgagaguucauggaaaaagaaugccccuucaucaaaccagaagucaaacccggcacccccgcccaagaagccgaguuccuaaaacgcaacaaagucuacuucaugcaacggcaagacguccucgacaaaaaccacguagcagacaucgacaagcuaaucgacuacgccgccuccggcgaccccaccuccccagacaacaucgaaucacccaacgcacccugggucuucgccugcgcgccagaccguugcccacccacaugcaucuacguggccggcauggccgaacucggcgcauucuucuccauacuacaagacaugcgcaacacuauuauggccagcaaaaccgucggcgccgccgaagaaaaacucaaaaagaaauccucauuuuaccaauccuaccuccgccgaacccaaagcaugggcauccaacuggaccaacgcaucauccuacuauacaugcuagaauggggcaaagaaauggucgaccacuuccaccuaggcgacgacauggaccccgaacuccgcggccucgcccaagcccucaucgaccaaaaagucaaagaaaucuccaaccaagaaccccuaaaaaucuaa

SEQ ID NO: 7911 - RNA, 1302 nt, Artificial Sequence
  derived and/or modified CDS sequence (opt11) from PUUV(PUUV/NL/Mg1439/2011)__KU314901.1__N
augagugaccuaaccgacauccaggaagacaucacccgacacgaacaacaacucguagucgcccgccaaaaacuaaaagacgccgaaaaagcagucgaaauggaccccgacgacgucaacaaaaacacacuccaggcccgccaacagacaguaucggcccucgaagacaaacuagccgacuacaagcgccgaauggccgacgccguaucaagaaagaaaauggacacgaaaccaacugacccaaccggcauagaaccagacgaccaccuaaaagaacgcucaucccugcgauacggcaacguccuagacgucaacgccaucgacaucgaagaaccauccggccaaaccgcagacugguacacaaucggcguauacgucauaggauucacacuccccauaauccucaaagcccucuacaugcucuccacacgcggccgacaaaccgucaaagaaaacaagggagcacggauccgcuucaaagacgacaccucguucgaggacaucaauggaauccgcagaccaaaacacuuauacgucuccaugccuacagcgcagucaaccaugaaagcagaagaacucacccccggacgcuuccgaaccauugucugcggccuguuccccacacagauccaaguccgcaacauaaugagccccgucaugggcgucauaggcuuuagcuucuucgucaaagacuggccagaccgcauacgcgaguucauggaacgcgaaugccccuucauaaaacccgaagucaaacccggcacgcccgcacaagaagcagaguuccugaaacgcaacaaagucuacuucaugcaacgccaagacguccucgacaaaaaccacgucgccgacaucgacgaacuaaucgacuacgccgcaagcggagacccgacaagcccagacaacaucgaaucaccaaacgcccccugggucuucgccugcgcccccgaccgcugcccaccaaccugcauauacgucgcaggcauggccgaacuaggagcauucuucuccauccuccaggacaugaggaacaccauaauggccagcaaaaccgucggcacagccgaagaaaagcucaaaaagaaauccucguucuaccagucauaucuacgacgcacacaaagcaugggcauccaacuagaccagcgcauaauccuccuauacaugcucgaauggggaaaagaaaugguagaccacuuccaccuaggcgacgacauggaccccgaacuccgcggccucgcccaagcccucauagaccaaaaagucaaagaaaucuccaaccaagaaccccucaaaaucuag

SEQ ID NO: 7912 - RNA, 1302 nt, Artificial Sequence
  derived and/or modified CDS sequence (opt11) from PUUV(PUUV/NL/Mg2/2008)__KU314902.1__N
augagcgaccucaccgacauccaggaagacaucacacgccacgaacaacagcuaguagucgccagacaaaaacucaaagacgccgaaaaagcaguagaaauggaccccgaugacgucaacaaaaccacccuccaagcacgacaacaaaccgucagcgcccucgaagacaaacucgccgacuucaaacgccaaauggccgacgccgucucccgcaagaaaauggacacaaaacccgccgaccccaccggaaucgaacccgacgaccaccucaaagaacgaagcucccuaagauacggaaacguccucgacgucaacgcgaucgacaucgaagaaccgagcggccaaaccgccgacugguacacaauaggagucuaugucaucggcuucacacuccccaucauccuaaaagcccucuacaugcucucaacccgaggccgacaaaccgugaaagaaaacaaaggaacccggaucagauucaaagacgacacauccuucgaagauaucaacggcauaagacgacccaaacaccucuacgucucgaugcccaccgcccaaagcacaaugaaagcugaggaacucacacccggccgcuuccgcaccaucgucugcggucuauuccccacccaaauccaaguccgcaacauaaugagccccguaaugggcguaaucggcuucucauucuucgucaaagacugggccgaccgcauccgcgaguucauggaaaaagaaugcccauucauaaaaccagacguaaaacccggaacccccgcccaagaagcagaguuccucaaacgcaacaagaucuacuucaugcagcgacaagaaguucuagacaaaaaucacguagccgacaucgacaaacuuauagacuacgcagccucaggcgaccccaccucacccgacaacaucgaaagccccaacagcccauggguguucgccugcgcccccgaccgcugcccgccaaccugcauuuacgucgcaggcauggcagaauuaggcgccuucuucucaauccuccaggacaugcgcaacacgauaauggccagcaaaacaguagguacagccgaagaaaaacucaagaagaaaucauccuucuaccaauccuaccugcgacgcacccaaagcaugggcauccaacucgaccaacgcaucauccuccucuacaugcuagaauggggaaaagaaauggucgaccacuuccaccucggagacgacauggaucccgaacuccguggacucgcccaagcccuaaucgaccaaaaagucgaagaaaucagcaaccaagaacccuuaaaaaucuaa

SEQ ID NO: 7913 - RNA, 1302 nt, Artificial Sequence
  derived and/or modified CDS sequence (opt11) from PUUV(PUUV/NL/Mg25/2007)__KU314897.1__N
auguccgaccuaacagacauacaagaagacauaacccgacacgaacaacagcuagucguagcacgccaaaaacucaaagacgcagagaaagcagucgagauggaccccgacgacgucaacaaaaacacccugcaagcacgacaacaaaccgucagcgcccuagaagacaaacuagccgacuacaaacgccgcauggccgacgccguaucacgcaagaaaauggacaccaaacccaccgaccccaccggcaucgaaccagacgaccaccucaaagaacgcucaucccuccgauacggcaacguccucgacguaaacgcaauagacaucgaagaaccauccggacaaaccgccgacugguacaccaucggagucuacgucaucggcuucacacuaccaaucauacucaaagcucucuacaugcucagcacccgaggucgccaaaccguaaaagaaaacaaaggcacccgcauccgcuucaaagacgacaccagcuucgaagacauaaacggcaucagacgccccaaacaucuauacguaucaaugccaacagcccaauccacaaugaaagccgaagaacucacccccggccgguuccgcaccaucgucugcggacuauuccccacacaaauccaaguaagaaacaucaugucucccgucaugggagucaucggcuucucauucuucgucaaagacuggcccgaccgaauacgcgaauuuauggaaaaagaaugcccuuucaucaaacccgaggucaaacccggcacgccagcacaagaagccgaguuccucaaacgaaacaaagucuacuucaugcaacgccaagacguacucgacaaaaaccacguagccgacauagacaaacuaaucgacuacgccgcaucgggugaccccaccagccccgacaacauugaauccccaaacgcccccugggucuucgccugcgcaccagaccggugucccccaaccugcauuuacgucgccggcauggcagaacugggagccuucuucuccauccuccaagacaugagaaacaccaucauggccuccaaaacagucggcaccgcagaagaaaaacucaaaaagaaaucauccuucuaccaaagcuaccuccgacggacacaaagcaugggaauccaacucgaccaacgaauaauccuacucuacaugcucgaauggggcaaagaaauggucgaucacuuccaccuaggcgacgacauggacccugaacuccguggccucgcccaagcccucaucgaccaaaaagucaaagaaaucagcaaccaagaaccccucaaaaucuga

SEQ ID NO: 7914 - RNA, 1302 nt, Artificial Sequence
  derived and/or modified CDS sequence (opt11) from PUUV(PUUV/NL/Mg31/2007)__KU314896.1__N
auguccgaccuaaccgacauccaagaagacaucacccgccacgaacaacaacuaguagucgccagacaaaaacucaaagacgccgaaaaagccgucgaaauggaccccgacgacgucaacaaaaacacccuacaagcccgacaacaaaccgucuccgcccuugaagacaaacucgccgacuacaaacgccgcauggccgacgccgucucucguaaaaaaauggacaccaaacccaccgacccaaccggcaucgaaccagacgaccaccucaaagaacgcucaagccuccgcuacggcaacguccuagacgucaacgccauagacauagaagaacccagcgggcaaaccgccgacugguacaccaucggcguauacguaaucggcuucacccucccgaucauccucaaagcccucuacaugcucucaacccggggcagacaaaccgugaaagaaaacaaaggcacgcgcaucagguucaaagacgacaccagcuuugaagacaucaacggaauccgccgcccaaaacaccucuacgucagcaugccaaccgcucaauccaccaugaaagcagaggaacucacacccggccgcuuccgaacaaucgucugcggccuauuccccacccagauccaaguccggaacaucaugucccccguaauggguguaaucggcuucuccuucuucgucaaagacuggcccgaccgcaucagagaauucauggaaaaagaaugccccuuuauaaaacccgaagucaaacccggaaccccggcucaagaagccgaauuccuaaaacgcaacaaagucuacuucaugcaacgucaagacguacccgacaagaaccacgucgcagacaucgacaaacucaucgacuacgccgcguccggcgaccccacauccccagacaacauagaaucccccaacgcccccugggucuucgcaugcgccccagacagaugcccaccgaccugcaucuacgucgcgggaauggccgaacuaggcgcauucuucuccauacuccaagacaugcgaaacaccaucauggccuccaaaaccgucggaacagccgaggaaaaacuaaaaaaaaaaucaucauucuaccaaagcuaucuccgacgcacacagucgaugggcauccaacuagaccaacgcauuauccuauuauacaugcuagaauggggcaaagaaauggucgaccacuuccaccucggagacgacauggacccagaacuccgcggccucgcccaagcacuaaucgaccaaaaagucaaagaaaucuccaaccaagaaccccuaaaaaucuaa

SEQ ID NO: 7915 - RNA, 1302 nt, Artificial Sequence
  derived and/or modified CDS sequence (opt11) from PUUV(PUUV/NL/Mg502/2008)__KU314904.1__N
auguccgaccucaccgacauccaagaagacauaacacgacacgaacaacaacuagucgucgcccgccagaaacuaaaagacgcagaaaaagccgucgaaauggaccccgacgacgucaacaaaaacacccuccaagcccgacaacaaaccgucagcgcccucgaagacaaacucgccgacuucaaacgccaaauggcagacgccgucucccgcaaaaaaauggacaccaaacccgccgacccaaccggcaucgaacccgacgaccaccuaaaagaacgcagcagccuccgauacgguaacguccuagacgucaacgccaucgauaucgaagaacccuccggacaaacagcugacugguacacaaucggcgucuacgucaucggcuucacccuccccaucauccuaaaagcacucuacaugcugucaacacgaggaagacaaaccguaaaagaaaacaaagguacacgaauccgcuucaaagacgacacaagcuucgaagauaucaacggcauaagacggcccaagcaccuguacgucuccaugcccaccgcccaauccaccaugaaagccgaagagcucaccccaggacgcuuucgcacaaucgucugcggccuauuccccacccaaauccaaguccgaaacauaaugagccccguaaugggcguaaucggcuucagcuucuucguaaaagacugggccgaccgcauacgagaguucauggaaaaagaaugucccuucaucaaaccggauguaaaaccaggaaccccagcccaagaagcagaauucuuaaaacgcaacaaaaucuacuucaugcaacgccaagagguccucgacaaaaaucauguagccgacaucgacaaacuaaucgacuacgccgcaagcggagaccccacaucccccgacaacaucgagucccccgacagccccugggucuucgccugcgcccccgaccgcugccccccaacaugcauauacgucgccggcauggcagaacucggcgccuucuucuccauucuccaagacaugcgaaacaccaucauggccagcaaaaccguaggaacagccgaagaaaaacucaaaaaaaaaagcuccuuuuaccaaucauaccuccgccgaacccaaucaaugggaauacaacuagaccaacgcauaauccuacucuacaugcuagaguggggcaaagaaaugguagaccacuuccaccucggagacgacauggaccccgaacuaagaggccuagcccaagcccucaucgaccaaaaagucaaagagaucagcaaccaagaaccccuaaaaauauaa

SEQ ID NO: 7916 - RNA, 1302 nt, Artificial Sequence
  derived and/or modified CDS sequence (opt11) from PUUV(PUUV/NL/Mg591/2008)__KU314905.1__N
auguccgaccuaaccgacauccaagaagacaucacacgccacgagcagcagcuagucgucgcccgccaaaagcucaaagacgcagaaaaagccgucgaaauggaccccgacgacgucaacaaaaacacccuacaagccagacaacaaaccgucagcgcccucgaagacaaacucgccgacuucaaacgacaaauggcagacgccgucucacguaagaaaauggacaccaaacccaccgaccccaccggcaucgaacccgacgaccaccuaaaagaacgguccagccuccgcuacggaaacguccuagacgucaacgccaucgacaucgaagaacccucaggccaaaccgcagacugguacaccauaggcgucuacgugaucggauucacccuccccaucauccucaaagcccuauacaugcucagcacccgcgggcgacaaaccgucaaagaaaacaaaggcacacgcauccgcuucaaagacgacaccuccuucgaggacauaaauggcauacgccgaccuaaacaccucuacguaagcaugcccaccgcccaauccaccaugaaagcagaagaacuaacacccggccgauuccgaaccaucguaugcggucuauuccccacccaaauacaaguacgcaauaucaugagccccgucaugggcguaaucggcuucucauucuucgucaaagacugggccgaccgcauacgagaguucauggaaaaagaaugcccauucaucaaacccgacgucaaaccaggcacccccgcccaagaagccgaguuccucaaacgaaacaaaaucuacuucaugcaacgucaagaagugcuggacaaaaaccacgucgccgauaucgacaaacucaucgacuacgccgcaagcggagacccaaccuccccagacaacaucgaauccccaaacucacccugggucuucgccugcgccccagaccgcugcccaccaaccugcaucuacgucgcaggcauggcagaacuuggagccuucuucucgauccuacaagacaugcgcaacacaaucauggcguccaaaaccgucggaacagccgaagaaaaacucaaaaagaaauccucauucuaccaaagcuaccuucgccgaacccaauccaugggcauccaacucgaccaacgaaucauacuccucuacaugcuagaauggggcaaagaaauggucgaccacuuccacuuaggcgacgacauggaccccgaacuacgcagccuagcacaagcucuaaucgaucaaaaagucaaagaaaucuccaaccaagaaccccugaaaaucuga

SEQ ID NO: 7917 - RNA, 1302 nt, Artificial Sequence
  derived and/or modified CDS sequence (opt11) from PUUV(Samara_49/CG/2005)__AB433843.2__N
augucugaccuaacagacauacaagaagaaaucacucgucacgaacaacaacuagucgucgccaggcaaaaacucaaagacgccgaacgggccguagaaguagaccccgacgacgucaacaaaaacacccugcaagcacgacaacaaacagucagcgcccuagaagacaaacucgccgacuacaaacgccgcauggcagacgcggucucccgcaaaaaaauggacacuaaaccaaccgaccccaccggaaucgaacccgacgaccaccucaaagaacgauccucccuacgcuacggcaacguccuagacgucaacgcaaucgacaucgaagaacccagcggccaaacagcagacugguacacaaucggaguauacguuaucggcuucaccauaccaauuauccuaaaagcccucuauaugcuaucaacccgaggccgccaaacagucaaagaaaacaaaggcacccgcauccgauuuaaagacgacacaucauucgaagacauaaacggcauacgccgacccaaacaccucuacguuucaaugcccaccgcccaauccacaaugaaagccgaagaacuuacccccgggagauuccgcacaauaguaugcggccucuucccaacccaaauccagguucgcaacaucaugagccccgucaugggagucaucggcuucagcuucuucgucaaagacuggcccgaaaggauccgcgaauucauggagcgagaaugccccuucaucaaaccagaaguaaaacccggaacccccgcccaagaaguagaauuccuaaaacgcaaccguguguacuucaugacccgacaagacguccucgacaaaaaccacguagccgacaucgauaaacucaucgacuacgccgcauccggcgaccccaccucaccagacgacaucgaauccccaaacgccccaugggucuucgcaugcgcucccgaccgaugcccacccacaugcaucuacgucgcuggcauggcugaacucggcgccuucuucuccauccuccaggauaugcgcaacacaauaauggccuccaaaaccgucggaacagccgaagaaaaacucaaaaaaaaauccuccuucuaccaauccuaccugagacgcacacaaagcaugggcauacaacuggaccaacgcaucauccuccuauacaugcuagaauggggaaaagaaauggucgaccacuuccaccugggcgacgacauggauccagaacuccgaggccucgcccaaucacucaucgaccagaaagucaaagaaaucucgaaccaagaaccccucaaaaucuaa

SEQ ID NO: 7918 - RNA, 1302 nt, Artificial Sequence
  derived and/or modified CDS sequence (opt11) from PUUV(Thuin/33Cg/96)__AJ277030.1__N
auguccgaccucacagacauccaagaagacaucacccgacacgaacaacaacucgucgucgccagacaaaaacuaaaagaugccgaaaaagcagucgaaauggaccccgacgacguaaacaaaaacacccuccaagcacgccaacaaacggucucagcccuagaagacaaacucgcggacuucaaaagacaaauggccgacgccgucucccgcaagaaaauggacacaaaaccaaccgaccccacaggcaucgaacccgacgaccaccucaaagaacgcucaucacuacgauauggaaacguccuagacgucaacgccauagacaucgaagaaccaagcggccaaacggccgacugguacaccaucggcguauacguaaucggcuucacccucccaaucauccucaaagcccucuacaugcucucaacccgcggccgccaaaccgucaaagaaaacaaaggaacacgaauccgauucaaagacgacaccuccuucgaagacaucaacgguauacgccgcccaaaacaccuauacgucucaaugcccacagcgcaauccacaaugaaagccgaagaacucacaccaggccgauuccgaaccaucgucugcggccuauuccccacccaaauccaaguccgcaacauaaugucuccaguaaugggcgucaucggcuucucauucuucgucaaagacugggccgaccgaauccgagaauuuauggaaaaagaaugcccuuucaucaagccugaaguaaaacccggaacacccgugcaagaagccgaguuccucaagcgcaacaaaaucuacuucaugcaacgccaggaaguacucgacaaaaaccacgucgcagacauagacaaacuaaucgacuacgcagccagcggcgaccccaccucccccgacaacauagaagcacccaacgcgcccuggguguuugcaugcgccccagaccgcugcccgccaaccugcaucuacguagccgggauggccgaacuuggcgccuucuucagcauccuccaagacaugcggaacaccaucauggccuccaagaccgucggcaccgcagaagaaaaacucaaaaagaaaagcucauucuaccaauccuacuuacgaagaacccaaagcaugggcauacaacucgaccaacgcauuauccuccucuauaugcuagaauggggcaaagaaaugguagaccacuuccaccuaggcgacgacauggaccccgaacuacgcggccucgcccaagcacuaaucgaucaaaaagucaaagaaaucagcaaccaagaaccccuaaaaaucuaa

SEQ ID NO: 7919 - RNA, 1302 nt, Artificial Sequence
  derived and/or modified CDS sequence (opt11) from PUUV(Udmurtia/338Cg/92)__Z30708.1__N
augucagaccucaccgacauccaagaagaaauaacacgccacgaacaacagcuagucguagcacgccaaaagcuaaaagacgccgaacgagccgucgaagucgaccccgacgacgucaacaaaaacacccuccaagcacgacaacaaacgguaagcgcccuagaagacaaacuggccgacuacaagcgccguauggcagacuccguuucacgcaagaaaauggacaccaaacccacagacccaacagggaucgaacccgacgaccaccucaaagaacgcucaagcccccgauacggcaacguacucgacguaaacgccaucgacaucgaagaacccucaggccaaaccgcagacugguacaccaucggcgucuauguaaucggcuucacaauccccauaauacuaaaagcacucuacaugcucucaacccgcggccgacaaaccaucaaagaaaauaaaggcacccgcauccgauucaaagacgauaccucuuucgaagacaucaacggcauccgccgccccaaacaccucuacgucucaaugccaacagcacaaucaacaaugaaagccgaagaacuaaccccaggacguuuccguacaauagucugcggccuauucccaacccaaauccaaguccgcaacaucaugucccccgucaugggaguaaucggauucucauucuucguaaaagacuggcccgaacgcauccgcgacuucauggaaaaagaaugcccuuucaucaaacccgaggucaaacccggcacaccagcccaagaaaucgaguuccucaaacgcaaccgaguauacuucaugacccgccaagacguacuugacaaaaaccacguagccgacaucgacaaacucauagacuacgccgccuccggagaccccaccucucccgaugacauagagucccccaacgcccccugggucuucgcaugcgcccccgaccgaugcccuccaaccugcaucuacgucgccggcauggccgaacuaggagccuucuucucuauacuccaagacaugcgcaacaccaucauggccagcaaaaccgucggaacugcagaagaaaaacucaagaagaaaucguccuucuaccaaucauaccuccgucgcacacaauccaugggaauccaacuugaccagagaaucauccuacucuacaugcucgaauggggaaaagaaauggucgaccacuuccaccucggcgacgacauggaccccgaacuccgcggccucgcccaaagccuaaucgaccaaaaaguaaaagaaaucucaaaccaagaaccccuaaaaauauaa

SEQ ID NO: 7920 - RNA, 1302 nt, Artificial Sequence
  derived and/or modified CDS sequence (opt11) from PUUV(Udmurtia/444Cg/88)__Z30706.1__N
augagcgaccucaccgacauccaagaagaaaucacucgccacgaacaacaacucgucgucgcacgacaaaaacucaaagacgcagaaagagccguagaagucgaccccgacgacgucaacaaaaacacccuccaagcgcgccaacaaaccguaucagcauuagaggacaaacuagccgacuacaaacgccgcauggccgacgccgucucccgcaagaaaauggacacaaaacccaccgaccccacaggcaucgaacccgacgaccacuuaaaagaacgauccucccuccgcuacggcaacguccuagacguaaacgccauagacaucgaagaacccuccggccaaaccgcagacugguacaccaucggcgucuacgucaucggauucaccauccccaucauccuaaaagcccuauacaugcucuccacccgaggccgacaaacagucaaagaaaacaaaggcacacgcauccgguucaaagacgacaccucauucgaagacauaaacggcaucagaaggccaaaacaccucuacguauccaugccaaccgcgcaaagcaccaugaaagccgaggaacucacgccaggcagauuccgcaccaucgucugcggacuauuccccacccaaauccaaguccguaacauaaugucaccagucauggggguaaucggcuucucauucuucguaaaagacuggcccgaacgcauacgagacuucauggaaaaagaaugucccuucaucaaacccgaaguaaaacccggaacccccgcccaagaaaucgaguuccucaaacgcaaccgagucuacuucaugacacgccaagacguccuagacaaaaaccacguggccgacaucgacaaacucaucgacuacgcagcuuccggcgaccccacgucccccgacgacaucgaauccccaaacgcccccugggucuucgccugcgcccccgaccgcugcccgccaaccugcaucuacgucgcagggauggcagaacuaggcgccuucuucagcauccuacaagacaugcgaaacaccaucauggcaucaaaaaccgugggcaccgccgaagaaaaacuaaagaagaaauccagcuucuaccaaucauaucuccgacguacccaaagcaugggcauacaacucgaccaacgaaucauccuacucuacaugcuagaauggggcaaagaaauggucgaccacuuccaccuaggcgacgacauggaccccgaacugcgcggccuagcacaaucccucaucgaccaaaaagucaaagaaauuagcaaccaggaaccccucaaaaucuaa

SEQ ID NO: 7921 - RNA, 1302 nt, Artificial Sequence
  derived and/or modified CDS sequence (opt11) from PUUV(Udmurtia/894Cg/91)__Z21497.1__N
augagcgaccucacagacauccaagaagaaaucacccgccacgaacaacagcucgucguagcccgccaaaagcuaaaagacgcagaaagagccgucgaaguagaccccgacgacgucaacaaaaacacccugcaagcccgucaacaaacagucuccgcccucgaagacaaacucgccgacuacaaacgccgcauggcagacgccguaucacgcaagaaaauggacaccaaacccaccgacccaacaggcauagaaccggacgaccaccucaaagaacgaucaagccuacgcuacggcaacguccucgacgucaacgccaucgacaucgaagaacccucaggccaaaccgccgacugguacacaaucggagucuacguaauaggcuucaccauccccauaauccucaaagcacuauacaugcucuccacacgaggaaggcaaaccguaaaagaaaacaaagguacccgaauccgcuucaaagacgacaccuccuucgaagacauaaacggcauccgccgcccaaaacaucuauacgucagcaugccaaccgcccaaucaacaaugaaagccgaagaacuaacacccgggcgcuucagaaccauagugugcggucucuucccaacacaaauccaaguacgcaacaucaugagccccgucaugggcguaaucggcuucucauucuucgucaaagacuggcccgaacgaauccgagacuucauggaaaaagaaugcccauuuaucaaaccagaaguaaaaccaggcacccccgcccaagaaaucgaguuccucaaacgcaaccgcgucuacuucaugacacgacaagacguccucgacaaaaaccacgucgccgacaucgacaagcucaucgacuaugcagccuccggcgacccgacauccccagacgauaucgaauccccaaacgcacccuggguauucgcaugcgcccccgaccgcugcccacccacaugcaucuacgucgucggcauggcggaacugggcgccuucuucagcauccuucaagacaugcgcaacaccaucauggccagcaaaaccguaggaaccgccgaagaaaaacucaaaaagaaaagcucauucuaccaauccuaccuccgacgcacacaaucgaugggaauccaacucgaccaaagaaucauacuccuauacaugcuagaauggggcaaagagauggucgaccacuuccaccuaggcgaugacauggaccccgaacuccgaggccucgcccaaucccucauagaucaaaaagucaaagaaauaagcaaccaggaaccacuaaaaauauga

SEQ ID NO: 7922 - RNA, 1302 nt, Artificial Sequence
  derived and/or modified CDS sequence (opt11) from PUUV(Fusong-Cr-247)__EF442087.1__N
auguccgaccucaaagacauacaagaagacaucgcccgccacgaacaacagcuaguagucgcacgacaaaaacuacgugacgccgaaaaagcagucgaaauggacccagacgacgucaacaacaacacucuccaggcccgacaacaaacaguaagcgcccucgaagacaaaaucgcagacuucaaacgacgaauggcugacaucguaagccgcaagaaaauggacaccaaacccgcugacccaaccgguaucgaaccagacgaccaccucaaagaacgcuccagccuacgauacggaaacguacuagacgucaacgccaucgacauagaagaacccucaggccaaacagccgauugguacaccaucggcguuuacauaaucggcuucacacuacccaucauccucaaagcacucuacaugcuauccacccgcggccgccaaaccgugaaagaaaacaaaggcacccgaaucagauucaaagacgacacauccuucgaagacgucaacggaauccgucgccccaaacaccucuacguaagcaugccaacagcccaaucaacaaugaaggccgaagaacucaccccaggccgcuuccgaaccauagucugcggacucuuccccacccaaauccaagucaggaacacaaugucaccaguaaugggcgucaucggcuucuccuucuucgccaaagacuggccagaccgaauaaaagaguucauggaaaaagaaugcccauucauaaaacccgaagucaaaccaggcacacccgccaaagaaguagaaauccucaaacgcaacaaaauauacuucaugcaacgacaagacguccucgacaaaaaccacguacccgauaucgacaaacuaauagacuacgccgccuccggcgacccaacaagcccagaaaacaucgacucccccaacgcccccugggucuucgccugcgcccccgaccgcugcccacccacaugcaucuacgucgccggcauggccgaacuaggagccuucuucucaauccugcaagacaugcgcaacaccauaauggcaucaaaaacagucggcacagccgaagagaaacuaaagaagaaaagcagcuucuaccaaagcuaccuaagaagaacccaauccaugggaauccaacucgaccaacgcaucauccuccuauacaugcucgaauggggcaaagaaauggucgaccacuuccaccuaggcgacgacauggaccccgaacucagaagccucgcccaagccuuaaucgaucaaaaaguuaaagaaaucuccaaccaagaaccccuaaaaaucuaa

SEQ ID NO: 7923 - RNA, 1302 nt, Artificial Sequence
  derived and/or modified CDS sequence (opt11) from MUV(11-4)__JX046484.1__N
augagcgaccucaaagaaauccaagaagacaucgcccgccacgaacagcaacucguagucgcucgccaaaaacuccgagacgccgaaaaagccgucgaagucgaccccgaugacguaaacaaaaacacccuacaagcccgucaacaaaccgucucagcccuggaagacaaacucgcagacuucaaacgacaaauggccgacuucgucagccgcaagaaaauggacacaaaacccaccgaccccacaggcaucgaacccgacgaccaccucaaagaacgcuccagccuccgcuacggcaacguccuagacgucaacgccaucgacaucgaagaacccuccggccaaacagccgacugguacaccauaggcgucuacauaaucggcuucacacuccccaucguacucaaagcccucuacaugcuauccacacgcggccgccaaaccgucaaagaaaacaaaggcacgcgaauccgauucaaagacgacacauccuucgaagacauaaacggcauucgacgccccaaacaccucuacgucuccaugcccaccgcccaaucaaccaugaaagcagaagaacucaccccugggcgcuuucguaccaucguaugcggccuauuccccacccaaauacaaguccgcaacaucaugucccccgucaugggagucaucggauucuccuucuucgucaaagacugggccgaccgcaucaaagaauuuauggaaaaggaaugucccuucaucaaaccugaacccaaacccggcacccccgccagcgaagucgaguuccucaaacgaaacaaaaucuacuucaugucccgccaagacguccucgacaaaaaccacguccccgacaucgacaagcuaauagacuacgccgccuccggcgaccccaccuccccagacaacaucgaagaccccaacgcccccuggguauucuccugcgcaccagaccgcugcccuccaaccugccucuacgucgcaggcauggccgaacucggcgccuucuucagcauacuacaagacaugcggaacaccauaauggcgucaaaaaccguaggcaccgccgaagaaaaacucaagaaaaagagcuccuuuuaccaauccuaccuacgacgcacccaaagcaugggaauccagcucgaccaacgcaucauacugcuauacaugcucgaauggggcaaagaaauggucgaccacuuccaucuaggcgacgacauggaccccgaacuccgcacucucgcacaagcccucaucgaccagaaagucaaagaaauauccaaccaggaaccccuaaaaaucuaa

SEQ ID NO: 7924 - RNA, 1302 nt, Artificial Sequence
  derived and/or modified CDS sequence (opt11) from MUV(00-18)__DQ138128.1__N
auguccgaccucaaagagauccaggaggacaucgcccgccacgaacaacaacucgucgucgcccgccaaaaacuccgcgaugccgaaaaagcagucgaagucgaccccgacgacgucaacaaaaacacacuacaagcccgccaacaaacagucucggcccucgaagacaaacuugccgauuucaaacgacaaauggcagacuucgucucaagaaagaaaauggacacgaaacccacagaccccacaggcauagaacccgacgaccaccucaaagaacguucaagccuccgcuacggaaacguacucgacgucaacgccaucgauaucgaagaacccagcggacaaaccgccgacugguacaccaucggcguauacgucaucggcuucacccuccccaucguacucaaagcacucuacaugcucucuacccgcggccgacaaaccgucaaagaaaacaaaggaacccgcauacgcuucaaagacgacaccuccuucgaagacauaaacggcauacgacgaccaaaacaccucuacgucuccaugcccacagcacaauccaccaugaaagccgaagaacuaacccccggccgcuuccgcacaauagucugcggccucuuccccacccaaauacaaguccgcaauaucauguccccagucaugggcguaaucggauucagcuucuucguaaaagacuggguagaacgcaucaaagaauuuauggaaaaagaauguccauucaucaaaccagaacccaaacccgggaccccagccucagaagucgaguuccuaaaacgcaacaaaaucuacuucaugaaccgacaagacguccucgacaaaaaccacgucccagacaucgacaaacugaucgacuacgcggcauccggugacccuaccucccccgacaacauagaagacccaaacgcacccuggguauucuccugugcccccgacagaugcccaccaaccugccucuacgucgccggcauggccgaacuaggagcauucuucuccauucuccaagacaugcgaaacaccauuauggcauccaagacagucggcaccgccgaagaaaaacucaagaaaaaguccuccuucuaccaaucauaccuacgccgcacccaauccaugggaauccaacuagaccaacgcauaauacuccuauacaugcuagaauggggaaaagaaauggucgaccacuuccaccucggcgaugacauggaccccgaacuacgcacccuagcacaagcccuuaucgaccaaaaaguuaaagagauauccaaccaagagccccucaaaaucuga

SEQ ID NO: 7925 - RNA, 1302 nt, Artificial Sequence
  derived and/or modified CDS sequence (opt11) from MUV(11-1)__JX028273.1__N
augucagaccugaaagaaauccaagaagacaucgccagacacgaacaacagcucgucguagcacgccaaaaacucagagacgccgaaaaagcagucgaagucgaccccgacgacgucaacaaaaacacccuacaagcccgccagcaaacagucucagcccuagaagacaaacucgccgacuucaaacgacaaauggcagacuucguaucgagaaagaaaauggacaccaaaccaaccgaccccaccggaaucgaaccagacgaccaccugaaagaacguucaucccuacgcuacggcaacguccuagacguaaacgcaaucgacauagaagaacccucaggccaaaccgccgacugguacacaauaggcguauacaucaucggcuucacccucccaaucguccuaaaagcccucuacaugcuauccaccaggggcagacaaaccguuaaagagaacaaaggcacaaggauccgcuucaaagacgacaccuccuucgaagacaucaacggaauacgccgcccaaaacaccucuacgucuccaugcccaccgcccaguccaccaugaaagcggaagaacuuaccccaggccgauucagaaccaucgucugcggccucuuccccacgcaaauccaaguccgcaacauaauguccccagucaugggcgucaucggauucuccuucuucgucaaagacugggcagaccgaaucaaagaauuuauggaaaaagaaugccccuucauaaaaccagagccaaagcccggcacaccggcauccgaaaucgaguuccucaaacgcaacaaaauauacuucaugucacgacaagacguccucgacaaaaaccacguccccgacaucgacaaacucaucgacuacgcagccuccggcgaccccaccucacccgacaacaucgaagacccgaacgcccccuggguauucuccugcgcccccgaccgcugcccaccuaccugccucuacgucgccggcauggcggaacucggcgccuucuucagcauccuccaagacaugcgcaacaccauaauggccagcaaaaccguaggcacagcagaagaaaaacucaaaaagaaauccuccuucuaccaauccuaccuccgccgaacccaaagcaugggcauacaacucgaccaacgcaucauacuacucuacaugcuagaauggggcaaagaaauggucgaccauuuccaccuaggugacgacauggaccccgaacuacgaacccucgcccaagcccucaucgaccaaaaaguaaaagaaaucuccaaccaagaaccccuaaaaauauaa

SEQ ID NO: 7926 - RNA, 1302 nt, Artificial Sequence
  derived and/or modified CDS sequence (opt11) from MUV(96-1)__DQ138133.1__N
auguccgaccuaaaagaaauccaagaagacauagcccgccacgaacaacaacuugucguagcccgccaaaagcuccgcgacgccgaaaaagccgucgaagucgaccccgacgacguuaacaaaaacacauuacaagcccgccaacaaaccguauccgcccuagaagacaaacuagcagacuucaaaagacaaauggccgacuucgucucucgcaagaaaauggacacuaaaccaaccgacccaaccggcaucgaaccagacgaccaccucaaagaacgcuccucccuccgcuacggaaacguccucgacgucaacgcuauagacaucgaagaaccaagcggacaaacagccgacugguacacaaucggcgucuacgucaucggcuucacccucccaaucguacucaaagcccuauacaugcugucaacacgcggccgacaaacggucaaagaaaacaaagggacacgaaucagguucaaagacgacaccuccuucgaagacauaaacggaaucaggcgacccaaacaccuauacgucucaaugcccaccgcccaaucaacaaugaaagcagaagaacucaccccaggccgcuucaggacaaucguaugcggccucuuccccacccaaauccaaguccgcaacaucaugagcccagucaugggcgucauccgcuucagcuuccuaguaaaagacuggagcgaaaagaucaaagaguucauggaaaaagaaugcccauucaucaaaccagaacccaaaccaggcacccccgccuccgaaauagaguuccucaaacgaaacaaaauauacuucaugaaccgacaagacguacuagacaaaaaccacguccccgacauagacaaacucaucgacuacgccgccuccggcgacccaaccagccccgacaacaucgaagcccccaacgcccccugggucuucuccugcgcccccgaccgcugucccccaaccugccuguacguagcaggcauggccgaacucggcgcuuucuuuagcauccuccaggacaugcgcaacaccauaauggccucaaaaaccguaggaacagccgaagaaaaacucaaaaagaaauccuccuucuaccagucauaccuccgccgaacccaauccaugggcauccaacucgaccaacgcaucauccuucuauacaugcuagaauggggcaaagaaauggucgaccacuuccaccuaggcgacgacauggaccccgaacuccgcacccuugcacaagcucucaucgaccaaaaagucaaagaaauauccaaccaagaaccccucaaaauauag

SEQ ID NO: 7927 - RNA, 1302 nt, Artificial Sequence
  derived and/or modified CDS sequence (opt11) from MUV(99-28)__DQ138142.1__N
auguccgaccuaaaagaaauccaagaagacaucgcucgccaugaacaacaacucgucguagccaggcaaaaacuaagggacgcggaaaaagccguagaagucgaccccgacgaugucaacaaaaacacccuccaagcccgacaacaaaccgucuccgcccucgaagacaaacuggcagacuucaaacgccaaauggccgacuucgucucacgcaagaaaauggacaccaaaccaaccgaccccacaggcauugaaccagacgaccaccuaaaagaacgcuccagccugcgcuacggcaacguacuggacgucaacgccauagacaucgaggagccaagcggccaaacagccgacugguacaccauaggcgucuacgucauaggcuucacacuccccaucguacucaaagcccuauacaugcugagcacccgcggacgacagacagucaaagaaaacaaagguacccgcaucagauucaaagacgacaccuccuucgaagacauaaacggcauccgcagucccaaacaccuauacguaucaaugcccacagcccaaucgacuaugaaagcagaagaacucacaccaggccgauuccgcaccaucgucugcggccucuuucccacccaaauccaaguccgcaacauaaugucacccgucaugggcgucaucggcuucucauucuuugucaaagacugggucgagcgcaucaaagaguucauggaaaaagaaugcccuuucaucaaacccgaacccaaaccaggcacacccgccucagaaguagaguuccucaaacgaaacaaaaucuacuucaugaacagacaagacguacuagacaagaaccacguccccgacaucgacaaacuaaucgacuacgccgcaagcggcgaccccaccagccccgacaacaucgaagaccccaacgcccccuggguauucuccugcgcccccgaccgcugcccaccaaccugccucuacgucgccggaauggcagaacucggcgccuucuucucaauccuccaagacaugcgcaacaccauaauggcguccaaaaccgucggcaccgccgaagaaaaacucaaaaagaaauccuccuucuaccaaucauaccuccgccgaacacaaagcaugggcauccaacucgaccagcgcaucauccuccuauacaugcuggaauggggcaaagaaauggucgaccacuuccaccuaggcgacgacauggaccccgaacuccgcacccucgcccaagcccucaucgaccaaaaagucaaagaaaucuccaaccaagaaccccucaaaaucuag

SEQ ID NO: 7928 - RNA, 1290 nt, Artificial Sequence
  derived and/or modified CDS sequence (opt11) from SANGV(SA14)__NC_034526.1__N
auggccacacucgaagaaauacaaaaagaaauaaauauacacgaaggacaacucaucaucgccaaacaaaaggucaaagacgcagaaaaacaauacgaaaaagacccagacgaccucaacaaacgcgcacuauccgaccgcgaaggcauagcccacuccauccaauccaaaaucgacgaacuccgccgccaacuagcugaccgaguagccgccgguagaaaccuaggccaagaacgcgaccccaccggcguagaacccggggaccaccuccgagaaaaauccaugcuauccuacggcaauguaaucgaccucaaccaccuagacaucgacgagcccacaggacagaccgcagauuggcucuccaucgucaucuaccucaccuccuucgucguccccauacuccuaaaagcgcuauacaugcucaccacaagaggacgacaaacuacaaaagacaacaaaggaaugcguauccgcuucaaagacgacagcuccuucgaagacgucaacggcauccgcaaacccaagcaccucuuccuauccaugcccaacgcccaauccagcaugaaagccgaggaaaucacccccggccgauuccgaacagccgucugcggccucuacccugcccaaauaaaagcccgcaacauggucucacccgucaugagcgucauaggcuucaucacccucgcccgcgacuggaccgaacgcaucgaaaacuggcucgaccaaccuugcaaauucauguccgaaccaagccaaacaucccuacaaaaaggacccgccaccaaccgggacuaucucaaccagcgacaagcuagccuggcccaaauggaaacaaaagaagcucaagcggucagacaacaggccgucgaugccggcugcaaucuaguagaucacauagacagccccuccucaauaugggucuucgccggcgcaccagacagaugcccacccacaugccucuucauaucaggcauggccgaacuuggagcauucuucucgauacuacaagacaugcgcaacaccaucauggccagcaaaacagucggcaccuccgaagaaaaacucagaaagaaaucguccuucuaccaauccuaccucagacgcacucaauccaugggcauccagcucgaccaacgcaucaucauaauguucaugguagaauggggcaaagaggccgucgacggcuuccaccuaggagacgacauggaccccgaacuccgauccuucgcccaagcccugaucgaccaaaaagucaaagaaaucuccaaccaagaaccccuaaaaauauag

SEQ ID NO: 7929 - RNA, 1290 nt, Artificial Sequence
  derived and/or modified CDS sequence (opt11) from SANGV(SA22)__JQ082303.1__N
auggccacccucgaagaaauccaaaaagaaauaaacauccacgaaggacagcuaaucaucgcaaaacaaaaagucaaagacgcagaaaaacaauacgaaaaagaccccgacgaccucaacaaacgcgcccuauccgaucgcgagggcaucgcccacucaauacaaucaaaaaucgacgaauuacgcagacaacucgcugaccgcgucgcagccggccgcaaucugggccaagaacgugaccccaccggggucgaacccggcgaccaccuccgcgagaaaagcaugcuuagcuacggaaacguaaucgaccuaaaucaucucgacauagacgaacccaccggccaaaccgccgacuggcucagcauuguaauauaccucaccucauucguaguccccauacugcucaaagcucucuacaugcuaaccacccguggccgacaaaccaccaaagacaacaaaggcaugcgcauccgcuucaaagacgacuccuccuucgaagacgucaacggcaucagaaaacccaagcaccucuuccucuccaugccaaacgcccaauccuccaugaaagccgaagaaaucacccccggaagauuccgaaccgccgucugcggccuauaccccgcccaaauuaaagcacgcaacaugguaagccccgucauguccgucaucggauuuaucacccucgcaagagacuggaccgaacgaaucgaaaacuggcucgaccaacccugcaaauucauguccgaacccucccagaccucccuccaaaaaggacccgccaccaaccgcgacuaccucaaccaacgccaagccucccucgcacagauggaaacaaaagaagcacaagccguacgccaacaggccgucgacgcagguugcaaccucgucgaccacaucgacucacccucaagcaucuggguauucgccggagccccagaccgaugucccccaaccugccuauucauaagcggaauggccgaacuaggcgcauucuucagcauccuccaagacaugcgaaacacaauaauggccagcaaaacaguaggcacaagcgaagaaaaacuccgaaagaaaucgagcuucuaccaaucauaccuccgccgcacccaauccaugggcauccaacucgaccaacgaauaauaaucauguucaugguagaauggggaaaagaagucguagacggcuuccaccuuggcgacgacauggaccccgaacuacgguccuucgcccaagcccucauugaccaaaaagucaaagaaaucagcaaccaagaaccccucaaaaucuaa

SEQ ID NO: 7930 - RNA, 1290 nt, Artificial Sequence
  derived and/or modified CDS sequence (opt11) from SEOV(L99)__AF288299.1__N
auggccaccauggaagaaauccagagagaaaucuccgcacacgaaggacaacucgucauagcacgacaaaaagucaaagacgcagagaaacaauacgaaaaagaccccgacgaccucaacaaacgaacccuccacgaccgugaauccgucgccgcauccauacaaucaaaaaucgacgagcuaaaacgacaacucgccgacagaauagcagccggcaaaaacaucggccaagaccgcgaccccaccggggucgaacccggcgaccacuuaaaagaaagaucagcccucagcuacggcaacacccucgaccuaaacagccuagacaucgacgaacccacaggccaaacagccgacuggcucacaaucauaguauaccuuaccucguucgucguccccauaauccuaaaagcccuauacaugcucaccacaagaggccgccaaaccuccaaagacaacaaaggaaugcgcauaagauucaaagacgacagcucauacgaggacguaaacggaauccgaaaacccaaacaccuauacgucagcaugcccaacgcccaaagcagcaugaaagcggaagaaaucacacccggccgauuccgcaccgcaguaugcggacucuacccagcccaaaucaaagcacgcaacauggucucccccgucaugagcgucguaggauuccuagcccuagccaaagacuggaccucacgaauugaagaauggcuaggagcgccaugcaaauucauggccgaaagccccauagccggcucacucagcgguaaccccgucaaccgcgacuacauccgccaacgacagggagcgcucgcaggcauggaacccaaagaguuccaggcccuacgccaacacgccaaagacgccggcugcacccuagucgaacacauagaaagccccuccucaaucugggucuucgccggggcacccgaccgcugcccgcccacaugccuauucguaggaggcauggccgaacucggcgcauucuucagcauccuacaagacaugcgcaacaccaucauggccuccaagacagucggcacagccgacgaaaaacuccgaaagaaaucauccuucuaccaaagcuaccuacgacgcacacaaucgaugggaauccaacuggaccagcgaauaauaguaauguucaugguagccuggggcaaagaagccgucuacaacuuccaccucggcgacgacauggaccccgaacuccgcucccucgcacaaauccuaaucgaccagaaagucaaagaaaucuccaaccaagaacccaugaaacuauaa

SEQ ID NO: 7931 - RNA, 1290 nt, Artificial Sequence
  derived and/or modified CDS sequence (opt11) from SEOV(SG42/2011)__KY807171.1__N
auggcaacaauggaagaaauacaacgagaaaucuccgcccacgaaggacaacugguaauagcccgacagaaagucaaagacgcagaaaaacaauacgaaaaagaucccgacgaccucaacaaacgagcccuccacgaccgcgaauccguagccgcauccauccaaucaaaaaucgacgagcucaaaagacaacucgcagaccgaaucgccgccggcaaaaacaucggacaagaccgcgaccccacuggaguagaacccggcgaccaccuaaaagagcgcuccgcccuaagcuacggaaacacccucgaccucaacucccucgacaucgacgaaccgaccggccaaacagcagacuggucgaccauaaucguauaccucaccuccuuugucguuccgaucauccucaaagcccucuacaugcucaccaccagaggccgacaaacaagcaaggacaacaaaggcaugcgaauccgcuucaaagacgacagcuccuacgaagacgucaacggcauccgaaaacccaaacaccuauacgucucaaugcccaacgcccaauccagcaugaaagccgaagaaauaacacccgggcgcuuccgcacagccgugugcggacuauaccccgcacagaucaaagcacgcaacauggucagccccgucaugucagucgucggauuccucgcccucgccaaagacuggagcagccgaauagaagaauggcucggcgcccccuguaaauucauggccgaauccccaaucgccggaagccuaagcggcaacccagucaaccgcgacuacauacgacaacgccaaggcgcacucgccggcauggaacccaaagaguuccaagcccuccgacaacacucaaaagacgccggaugcacccuggucgaacacaucgaaagcccauccagcauaugggucuucgcaggcgcaccagaccgcugcccacccacaugccuguuuguaggcggaauggccgaacuaggcgccuucuucagcauccuacaagacaugagaaacaccaucauggccagcaaaaccgucgguaccgcagacgaaaaacuacggaagaaauccuccuucuaccaauccuaccugcgacgcacccagagcaugggaauccagcuagaccagcgcaucauagucauguucauggucgcuuggggcaaagaagcagucgacaacuuccaccucggagaugacauggaucccgaacuccgcagccuagcacaaauccuaauagaccaaaaaguaaaagaaaucucaaaccaagaaccaaugaaacuauaa

SEQ ID NO: 7932 - RNA, 1290 nt, Artificial Sequence
  derived and/or modified CDS sequence (opt11) from SEOV(XJ2/2011)__KY807169.1__N
auggccaccauggaagaaauccaacgagaaaucuccgcacacgagggccagcuagucauagcacgccaaaaagucaaagacgccgaaaaacaauacgagaaagaccccgacgaccuaaacaaacgcgcccuacacgaccgcgaguccgucgccgccuccauacaauccaaaaucgacgaacucaaacgacaacucgcagaccgaaucgccgcaggcaaaaacauaggccaagacagggaccccaccggcgucgaacccggcgaccaccucaaagaaagauccgcccuaagcuacgggaacacccuagaccuaaacucccuagacaucgacgaacccaccggccaaacagccgacuggcucacaaucaucgucuaccuaaccagcuucguaguacccaucauccucaaagcccuauacaugcuaacaacccguucccgccaaaccuccaaagacaacaaaggcaugcgcauacgauucaaggacgacucaagcuacgaagacgucaacggaauccgaaaacccaaacaccuguacgucuccaugccaaacgcccaaucgucaaugcgcgcagaagaaaucacaccgggccgauuccgcacagccgucugcggccuuuacccagcccaaaucaaagcccgaaacauggucagccccguaaugucugucgucggcuuccucgcacucgcaaaagacuggaccucccgcauagaggaauggcucggcgcccccugcaaauucauggccgaaagccccaucgccggcucccuaucuggcaacccagucaaccgcgacuacauccgccaaagacagggagcacucgccggaugggaaccaaaagaguuccaggcccuccgacaacacuccaaagacgcaggcugcacccuagucgaacacaucgaaucacccuccagcauaugggucuucgccggugcccccgacagaugcccacccacaugccucuucguaggaggcauggcugaacucggcgccuucuuuucuauacuccaagacaugcgcaacaccauaauggccucaaaaacugucgggacagccgacgaaaaacuccgcaagaaauccuccuucuaccaauccuaccuccgccgaacacaaagcaugggcauccaacuagaccaacgcauaauaguuauguucauggucgccuggggcaaagaagcagucgacaacuuccaccugggcgacgacauggacccagaacuacgcagccuagcccaaauccuaaucgaccaaaaaguaaaagaaaucucgaaucaagaaccaaugaaacucuaa

SEQ ID NO: 7933 - RNA, 1290 nt, Artificial Sequence
  derived and/or modified CDS sequence (opt11) from SEOV(XJ5/2011)__KY807170.1__N
auggccacaauggaagaaauccaacgcgaaauaagcgcccacgaaggccaacucgucauagcacgacagaaaguaaaagacgcagaaaaacaauacgaaaaagaccccgacgaccuaaacaagcgcgcccuccacgacagagaauccgucgcagcuagcauccaaagcaaaaucgacgaacugaaacgccaacucgccgaccgcaucgccgccggcaaaaacauaggccaggacagagacccaaccggcgucgaaccaggcgaccaccuaaaagaacgcucagcccucuccuacgggaacacacucgaccucaacagccucgacaucgacgaaccaacaggccaaaccgccgacuggcuaacaaucaucguauaccuaaccagcuucguaguacccaucauacuaaaagcccuuuacaugcuaaccacccgcggccgacaaaccagcaaagacaacaaaggaaugcgcauccgauucaaagacgacuccagcuacgaagacgucaacggcauccgaaagccaaaacacuuauacguaagcaugcccaacgcccaaagcuccaugaaagccgaggaaaucacccccggccgauucagaacagcaguaugcggacucuaccccgcccaaaucaaagcacgcaacauggugucccccgucaugagcgucgucggauuucuagcccucgcaaaagacuggaccagccgcauagaagaauggcuaggagcccccugcaaauucauggccgaaagccccaucgcaggcucccucagcggcaacccagucaaccgcgacuacaucagacaaagacaaggcgcccuagcaggcauggaacccaaagaguuccaagcacuacgacaacacccaaaagacgccggaugcacccucgucgaacacauagaaucacccagcagcaucugggucuucgcaggcgcccccgaccgaugcccaccaaccugccuauucgucggcggaauggccgaacucggcgccuucuucuccauccuacaagacaugcgcaacaccauaauggcaagcaaaaccguauccaccgccgacgaaaaacuaagaaagaaaucaucauucuaccaguccuaccucagacguacacaaagcaugggaauccagcucgaccagagaauaaucgucauguucauggucgccuggggcaaagaagcggucgacaacuuccaccuaggcgacgacauggaucccgaacuccgaucccucgcccaaauacugaucgaccaaaaagucaaagagauaagcaaccaagagcccaugaaacucuaa

SEQ ID NO: 7934 - RNA, 1290 nt, Artificial Sequence
  derived and/or modified CDS sequence (opt11) from SEOV(10-134)__JF693882.2__N
auggccacaauggaagaaauccaacgagaaauaucagcccacgaaggacaacucgucaucgcaaggcaaaaaguaaaagacgcagaaaaacaauacgaaaaagaccccgacgaccucaauaaaagagcccuacacgaccgcgaauccgucgcagccuccauccaauccaaaaucgacgaacucaaacgccagcucgccgaccgcaucgccgccggcaaaaacaucggccaagaccgcgaccccaccggcgucgaaccaggcgaccaccugaaagagcgcucagcacugagcuacggaaacacccucgaccuaaacucccucgacaucgaugagcccaccggccaaacagcggacuggcuaaccaucauaguauaccucaccuccuucguccucccaaucauccucaaagcccuauacaugcucacaacccgaggccgacaaaccagcaaagacaacaaaggaaugcgcauccgguucaaagacgacuccucauacgaagacgucaacggcauacgcaaacccaaacaccuauacgucagcaugccaaacgcacaauccagcaugaaagccgaagaaaucacacccggaagauuccgaaccgcaguuugcggacuauacccugcccaaaucaaagcucgcaacauggugagccccgucaugagcguagucggauuccuagcacuggccaaagacuggaccucaagaauagaagaauggcuaggcgccccaugcaaauucauggcagaaucccccaucgccggcagccuauccggaaaccccgucaaccgcgacuacauccgccaacgacaaggcgcccuggcuggaauggaacccaaagaguuccaagcccuacgccagcacuccaaagacgcaggcugcacucuaguugaacacaucgaaucccccagcucaaucugggucuucgcaggcgcgccggaccgaugcccacccacaugccucuuugucggaggcauggccgaacugggcgccuucuuuagcauacuucaagacaugcgcaacacaaucauggccuccaagaccgucggcacugccgacgaaaaacuccgaaagaaauccuccuucuaccaauccuaccuccgcagaacccaaagcaugggcauacaauuggaccaacgcauaaucgucauguucaugguggccuggggcaaagaagccguagacaacuuccaccucggagacgacauggaccccgaacuccgaucccucgcccaaauccuaauagaccaaaaaguaaaagaaauauccaaccaagaacccaugaaacuauaa

SEQ ID NO: 7935 - RNA, 1290 nt, Artificial Sequence
  derived and/or modified CDS sequence (opt11) from SEOV(DPRK08)__JX853575.1__N
auggccacaauggaagaaauccaacgugaaaucuccgcccacgaaggccagcucgucaucgccagacaaaaagucaaagacgccgaaaaacaauacgaaaaagaccccgacgacuuaaacaagcgcgcccuccacgaccgagaaagcguagccgccagcauacaauccaaaauagacgaacuaaaacgccaacucgcagaccgaaucgcugccggcaaaaacaucggccaagaccgcgaccccaccggagucgagccaggcgaccaccucaaagaacgcuccgccuuaagcuacggaaacacccuagaccuaaacucccuagacauagacgaacccacugggcaaacagccgacuggcuaacaauaaucguauaccucaccucauucguaguacccaucauccucaaagcccuauacaugcucacaacccgaggacgccaaaccuccaaagacaacaagggaaugcgaauccgcuucaaagacgacagcuccuacgaagacguaaacggcauccgcaaacccaaacaccucuacgucucaaugccaaacgcccaaagcuccaugaaagcagaagaaaucacacccggacgcuuccgaaccgcaguaugcggccucuaccccgcccaaaucaaagcaagaaacaugguaagcccagucaugagcguagucggauuccuagcccucgccaaagacuggaccucccgcaucgaagaauggcucggugccccaugcaaauucauggccgaaucccccauagccggcagccucagcggcaacccagucaaccgagauuacaucagacaacgccagggagcccucgccggcauggaaccaaaagaguuccaggcacuccgccaacacgcaaaagacgcaggcugcacccuggucgaacacaucgaaagccccucuucgaucuggguauucgcaggagcccccgaccgcugcccaccaaccugccuauucguaggcggcauggcagaacuaggagccuucuucuccauacuccaagacaugcgcaacacaauaauggcaagcaaaaccgucgguacggcagacgaaaaacuucgcaagaaaagcuccuucuaccaaucauaccuccgaagaacccaauccaugggcauccaacuggaccaacgaaucauagucauguucauggucgccuggggaaaagaagcagucgacaacuuccaccucggagacgacauggaucccgaacuacgcucccuagcccaaauccugaucgaccaaaaagugaaagaaauaucaaaccaagaacccaugaaacucuaa

SEQ ID NO: 7936 - RNA, 1290 nt, Artificial Sequence
  derived and/or modified CDS sequence (opt11) from SEOV(Fj372/2013)__KP645198.1__N
auggccacuauggaagaaauccaacgcgaaaucagcgcacacgaaggccaauuagucaucgcccgccaaaaagugaaagacgccgaaaaacaauacgaaaaagaccccgacgaccuaaacaagcgcgcacuccacgaccgagaauccguagcagccucaauccaaagcaaaaucgacgagcuaaaacgacaacucgccgacagaauagccgccggcaaaaacauaggccaagacagagaccccaccggaguagaacccggagaccaccuaaaagaacgcagcgcccuauccuacggaaacacacucgaccucaacucccucgacauagacgaaccaaccggccagaccgccgacuggcucaccauaaucgucuaccuaaccucauucgucguccccaucauacucaaagcccucuacaugcucaccacacgcggacgacaaacaucuaaggacaacaagggaaugcgcauccgauucaaagacgacuccucuuacgaggacguaaacggcaucagaaagccaaaacaccuauacgucuccaugcccaacgcacaauccuccaugaaagccgaagaaaucacccccggccgauuccgcacagcaguauguggacucuacccagcccaaaucaaagcccgcaacauggucagccccguaaugagcguagucggauuccucgcccucgccaaagacuggaccagccgcaucgaagaauggcuaggcgcaccaugcaaauucauggccgagucuccaaucgccggaagccuaagcggcucccccgucaaccgagacuacauccgacaacgccaaggagcccuagcaggcauggaacccaaagaguuccaagcccuccgccaacacgcgaaagacgcaggcugcacccucguagaacacaucgaaucuccauccucaaucuggguuuucgcaggcgcacccgaccgcugcccacccacaugccuguucgucggcggcauggccgaacucggagccuucuucuccauccuccaagacaugcgcaacaccaucauggccuccaaaacugucggcacagcagacgaaaaacuucgaaagaaaucaucauucuaccaauccuaccuccgacgcacccaaagcaugggaauccaacucgaucaacgaauaaucguaauguucaugguagcuuggggcaaagaagccgucgacaacuuccaccucggggacgacauggaccccgaacuccggucccuagcacaaauccucaucgaccaaaaagucaaagaaaucucaaaccaagagcccaugaaacucuaa

SEQ ID NO: 7937 - RNA, 1290 nt, Artificial Sequence
  derived and/or modified CDS sequence (opt11) from SEOV(HeB38)__JN377553.1__N
auggcaaccauggaggaaauccaacgcgaaaucagcgcccacgaaggacaacucguaauagcccgacaaaaggucaaagacgcagaaaaacaauacgaaaaagaccccgacgaccucaacaaacgcgcccuccacgaccgcgaaucagucgcagccuccauccaauccaaaaucgacgaacuaaaacgccaacucgcagaccgcaucgcagcgggcaaaaacaucggacaagaccgcgaccccaccggagucgaacccggagaccaccucaaagaacgcucggcccucagcuacggcaacacccucgaccucaacucacucgacaucgacgaaccaaccggccaaaccgcugacuggcucaccaucaucgucuaccuaacuagcuucgugguccccaucauccuaaaagcacuauacaugcuaaccacccgcggcagacaaaccuccaaagacaacaagggcaugaagauccgcuucaaagacgacuccuccuaugaagacguaaacggcauccguaaaccaaaacaccucuacgucuccaugcccaacgcgcaauccuccaugaaagccgaagaaauaacaccaggccguuuccgaacagcaguaugcggacuauaccccgcccaaaucaaagcccgcaacauggucucccccgucaugagcgucguaggcuuccuugcccuggcaaaagacuggaccucacgaaucgaagaauggcucggcgccccuugcaaauucauggccgaaucccccaucgcaggcucccugucaggcaacccaguaaaccgcgacuacauucgacaacgccaaggcgcacucgcaggcauggaacccaaagaguuccaagcacuacgccaacacucaaaagacgccggaugcacacucguagaacacaucgaaucccccuccuccaucugggucuucgccggagcaccagacagaugcccaccaaccugccucuucgucggaggcauggccgaacuaggcgcauucuucuccauacuacaggacaugcgaaacacuauaauggccuccaaaaccgucggcacagccgacgaaaaacuccgaaagaaaucccccuucuaccaaucauaccuacgacggacccaaucaaugggcauacaacuggaccaaagaauaauaguaauguucauggucgccuggggcaaagaagccguagacaauuuccaccucggcgacgacauggaccccgaacuacgcggacuagcacaaauccucaucgaccaaaaggucaaagaaauauccaaccaagaacccaugaaacucuaa

SEQ ID NO: 7938 - RNA, 1290 nt, Artificial Sequence
  derived and/or modified CDS sequence (opt11) from SEOV(JiangxiXinjianRn-07-2011)__KP859511.1__N
auggccaccauggaggaaauccaaagagaaauauccgcccacgaaggacaacugguaaucgcgcgccaaaaaguaaaagacgcagaaaaacaguacgaaaaagaccccgacgaccuaaacaaacgggcacuacacgaccgagaauccgucgcagcaagcauccaaucaaaaaucgacgaacugaaacgacaacuagccgaccgaaucgccgcaggcaaaaacaucggacaagaccgcgauccaaccggagucgaaccaggcgaccaccuaaaagagcgauccgcccucucuuacggaaacacacucgaccucaacucccucgacaucgacgaaccaaccggacaaaccgccgacuggcucaccauaaucgucuaccucacauccuucgucguccccaucauccucaaagcccucuacaugcuaacaacccgcggccgacagaccagcaaagacaacaaaggaaugcgcauacgcuucaaagacgacagcagcuacgaagacguaaacggcaucagaaaacccaaacaccuauacgucucaaugccaaacgcacaauccucaaugaaagcagaagaaaucacccccggccgauucagaacagccgucugcggccucuacccagcccaaaucaaagccagaaacauggucuccccagucaugagcguaguaggcuuccucgcccuagccaaagacuggaccagccgcaucgaagaauggcucggcgcccccugcaaauucauggcagaauccccaaucgccggaucccugagcggcaaccccgucaacagagacuacauccgccagagacaaggcgcccuagccggcauggagcccaaagaguuccaagcacuccgucaacacucgaaagacgccggcugcacccuagucgaacacaucgaaagccccagcucaauauggguauuugccggagcaccagacagaugcccacccacaugcuuguucgucggcggaauggccgaacuaggcgcguucuucuccauccugcaagacaugagaaacacaaucauggccagcaaaacaguaggcacagccgacgagaaacuccgaaagaaaagcagcuucuaccaaagcuaccuccgccguacacaaucaaugggcauacaacuagaccaacggaucaucgucauguucauggucgcauggggcaaagaggcagucgacaacuuccaccucggcgacgacauggaccccgaacuccggucccuagcccaaauacucaucgaccaaaaagugaaagaaauauccaaccaagaacccaugaaacucuaa

SEQ ID NO: 7939 - RNA, 1290 nt, Artificial Sequence
  derived and/or modified CDS sequence (opt11) from SEOV(JiangxiXinjianRn-09-2011)__KP859512.1__N
auggccaccauggaagaaauccaaagagaaauaucagcccaugaaggacaacucguaaucgcacgccaaaaagucaaagacgcagaaaaacaauacgaaaaagacccggacgaccucaacaaacgcgcccuacacgaccgcgaauccgucgccgccuccauccaauccaaaauagacgaacucaagcgacaacucgcugaccgcauagccgccggcaaaaacaucggccaagacagagaccccacaggcguagaacccggcgaccaccucaaggaacgaucagcccuaagcuacggcaauacccucgaccuaaacucccucgacauagacgaacccacaggacaaacagccgacuggcuaaccaucaucgucuaccugaccucauucgucguacccaucauccuaaaagcccucuacaugcuaaccacccgcggaagacaaaccuccaaggacaacaaagggaugcgcauccgguucaaagacgacucauccuacgaagacgugaacggcaucagaaaacccaagcaccuauacgucagcaugcccaacgcccaauucuccaugaaagccgaagaaauaacgcccggacgcuuccgaaccgcagucugcggccucuacccugcacaaaucaaagcucguaacauggucagccccgucauguccguagucggcuucuuagcccuggccaaagacuggacaucacgcauagaagaauggcuuggcgcacccugcaaauucauggccgaaucccccaucgccggcagccucagcggcaaccccgucaaccgcgacuacaucagacagcgacaaggcgcacucgccggcauggaaccgaaagaauuccaagcccuacgccaacacagcaaagacgcaggcugcacccucgucgaacacaucgaaagucccuccucaauaugggucuucgccggcgcaccagaccgcugcccacccacgugccucuucguuggcgggauggccgaacucggcgccuucuucuccauccuccaagacaugcgcaacacaauaauggccagcaaaaccgucggcaccgccgacgaaaaacuucgaaaaaaauccucauucuaccaauccuaccuacgacgcacccagagcaugggcauccaacuagaccaacgcauaaucgucauguucaugguagccuggggaaaagaagcaguagacaacuuccaccuaggcgacgacauggaccccgaacugcgcucccucgcacaaauacucaucgaccaaaaagucaaagaaauauccaaccaagaacccaugaaacucuaa

SEQ ID NO: 7940 - RNA, 1290 nt, Artificial Sequence
  derived and/or modified CDS sequence (opt11) from SEOV(Singapore/06(RN41))__GQ274944.1__N
auggcgacuauggaagaaauccagcgcgaaaucuccgcccacgaaggccaacucgucauagcacgccaaaaagucaaagacgccgaaaaacaauacgaaaaagacccagacgaccuaaacaaaagagcccuacacgaccgagaaagcgucgcagcaagcauccaaucaaagauagacgaacuaaaacgucaacuggccgaccgaaucgccgccgggaaaaacauuggacaagaccgagaccccaccggagucgaacccggcgaccaccucaaagaaagauccgcacuauccuacggcaacacacuagaccucaacagccuagacauagacgagccgacuggccaaaccgcagacuggcucaccauaauagucuaccucaccucauucgucguccccaucauacuaaaagcccucuacaugcucacaacacgaggccgccaaaccucaaaggacaacaaaggaaugcgcauccgcuucaaagacgacucaucauacgaggacguaaaugguauccgaaaacccaaacaccuauacgucucaaugccaaaugcccaauccuccaugaaagccgaagaaaucacccccggacgauuccgcacagccgucugcggccucuauccagcccaaaucaaagcccgcaacauggucagccccgucaugagcguagucggauuccuagcccuggccaaagacuggacaagccgaaucgaagaauggcuaggagcccccugcaaauucauggcagaaucccccaucgccggcucccucucuggcaaccccgucaacagagacuacauacgccaacgccaaggcgcccucgcaggcauggaaccaaaagaguuccaagcccuccgacagcacuccaaagacgccggcugcacccucguagaacacaucgaaucaccaagcucgaucugggucuucgccggagcaccugaccgcugcccacccacaugccuauucgucggcggaauggcagaacuaggagcauucuucaguauacuccaagacaugcgaaacacaaucauggccagcaaaaccgucggcacggcggacgaaaaacuccgcaaaaaguccuccuucuaccaauccuaccuacgacgcacacaguccaugggaauccaacucgaccaacgaaucaucgucauguucaugguagccuggggcaaagaagccguagacaacuuccaucucggcgacgacauggaccccgaacuccgcggacucgcccaaauacuaaucgaccaaaaagucaaagaaaucagcaaccaggaacccaugaaacucuaa

SEQ ID NO: 7941 - RNA, 1290 nt, Artificial Sequence
  derived and/or modified CDS sequence (opt11) from SEOV(YaluRiver12)__HQ611980.1__N
auggcaaccauggaagaaauccaacgcgaaaucagcgcccacgaaggacaauuaguaauagccagacaaaaagucaaggacgccgaaaaacaauacgaaaaagacccaggcgaccugaacaaacgagcacuucacgaccgcgaaagcgucgcagccagcauccaaagcaaaauagacgaacuuaaacgccaacuagcagaccgaaucgccgccggcaaaaacaucgggcaagaccgagaccccacgggcguagaacccggcgaccaccucaaggaacgcagcgcccucagcuacggcaacacccucgaccuaaacucacuagacaucgacgaaccgaccggacaaacggcagacuggcuaaccauaaucguauaccuaacauccuucgucguccccauaauacucaaggcccucuacaugcuaacaacccgaggacggcagacaagcaaagauucaaaaggaaugagaaucagauucaaggacgacagcuccuacgaagacguaaacggcaucaggaaacccaaacaccucuacguaucaaugccaaacgcccaaucgucaaugaaaacggaagaaauaacaccaggacgauuccgcacagcaguaugcggccucuaccccgcacaaauaaaagcgcgcaacauggugagccccgucaugagcgucgucggauuccucgcccucgcaaaagacuggacaucccgcaucgaagaauggcugggcgcaccaugcaaauucauggccgagucacccauagccgggagcuuauccgagaacccaguaaaccgagacuacauacgccagcgccaaggagcacucgcaggaauggaacccaaagaguuccaagcccuccgccaacacgcaaaagacgcuggaugcacccucguagaacacauugaaucgcccagcucaauaugggucuucgccggcgccccggaccgcugcccgccaaccugucucuucgucggcggaauggcagaacugggcgccuucuucagcauacuccaagacaugcgaaacaccauaauggcaagcaaaaccgucggcacggcugacgaaaagcuccggaagaaaagcuccuucuaccaaucauaccuacgcagaacccagagcaugggcauacaacucgaccaacgcauaaucguaauguucaugguagccuggggcaaagaagcaguggacaacuuccaccuaggcgacgacauggauccggaacuacgcucacuagcgcaaauacucauagaccaaaaaguaaaagaaauauccaaccaagaaccaaugaaacucuag

SEQ ID NO: 7942 - RNA, 1290 nt, Artificial Sequence
  derived and/or modified CDS sequence (opt11) from SEOV(14D12)__AB618124.1__N
auggccaccauggaagaaauccaaaaagaaaucucagcacacgaaggacaacucgucaucgcacgacagaaaguaaaagacgccgaaaaacaauacgaaaaagaccccgacgaccucaacaaaagagcacuccacgacagagaaucaguagcagccagcauccaaucgaaaaucgacgaacucaaacgccagcucgccgaccgaaucgcggccggcaaaaauaucggacaagaccgcgaccccacaggcguagaaccaggcgaccaccucaaagaacgcagcgcacuaagcuacggaaacacccuagaccucaacucccucgacaucgacgaacccacaggacaaacagcagacuggcuaaccaucaucguauaccuaaccucuuucgucguccccaucauccuaaaagcacucuacaugcucaccacccgaggccgacaaaccagcaaagacaacaaaggaaugcgcauccgguucaaagacgacagcucauacgaggaugucaacggaauccggaaaccgaaacaccucuacguuuccaugcccaacgcgcaaucaagcaugaaagccgaagaaaucacccccggccgauuccgcacagccgucugcggccucuaccccgcgcaaaucaaagcccgaaacauggucucccccgucaugagcgucgucggcuuccuggcccucgcuaaagacuggaccucccgcauagaagaauggcuaggugcccccugcaaauucauggccgaaucacccaucgccggcucccuaagcggaaaccccgucaaucgcgacuacauccgucaacgacaaggugcccuagcaggaauggaaccaaaagaguuccaagcacuacgccaacacagcaaagacgccggcugcacccucguagaacacaucgaaagccccaguuccaucuggguauucgccggcgcccccgacaggugcccacccacgugccuauucgugggaggcauggccgaacucggcgccuucuucagcauccugcaagacaugcggaacaccauaauggccucaaaaaccgucggcaccgccgacgaaaaacuccgaaagaaaagcuccuucuaccaaagcuaccuaagacggacccaaagcaugggcauccaacuugaccaacgaaucaucgucauguucauggucgccuggggcaaagaagccguugacaacuuccaccuaggcgacgacauggaccccgaacuacgaucacucgcccaaauccucaucgaccaaaaaguaaaagaaaucagcaaccaagaaccaaugaaacucuag

SEQ ID NO: 7943 - RNA, 1281 nt, Artificial Sequence
  derived and/or modified CDS sequence (opt11) from SEOV(19CSG)__AB618114.1__N
auggaagagauacaacgcgaaauaagcgcccacgaaggccaacucgucaucgcccgacaaaaagucaaagacgcagaaaaacaguacgagaaagaccccgacgaccucaacaaacgcgcccuccacgaccgcgaauccgucgccgccucaauacaaagcaaaaucgacgagcucaaaagacaacuagcagaccgcaucgccgccggcaaaaacaucggacaagaccgcgaccccaccggagucgaacccggagaccaccuaaaagaacgcagcgcacucagcuacggaaacacccucgaccuaaacucccucgacauagacgaacccacagggcaaacagccgacuggcucaccauaaucguauaccucaccagcuucguagucccaaucauacucaaagcgcuauacaugcuaacaacccgaggccgccaaacauccaaagacaacaagggcaugaggauccgauucaaagacgacagcaguuacgaagacgucaacggcaucagaaaaccaaaacaccucuacgucagcaugcccaacgcccaaagcagcaugaaagccgaagaaaucacccccggccgauuccgcaccgcagucugcggacucuaccccgcccaaaucaaagccagaaacauggucuccccggucaugagcgucgucggcuuccucgcccuggcaaaagacuggaccucccgaauagaagaauggcucggagcccccugcaaauucauggccgagucacccaucgccggcagcuuaagcggcaacccagucaaccgcgacuacaucagacaacgccaaggagcccucgccggaauggaaccaaaagaguuccaagcccuccggcaacacagcaaagacgccggaugcacccucguagaacacaucgaaucccccuccagcauauggguauucgccggagccccagaccgcugcccgccaaccugccuauucgucggcggcauggcagaacuaggcgcauucuucucgauacuccaggacaugagaaacaccauaauggcuucaaagaccguaggcaccgccgacgaaaaacuccgcaaaaagagcuccuucuaccagucauaccuccgcagaacccaaucaaugggcauacaacuagaucaacgcaucaucgucauguucauggucgcauggggaaaagaagcaguggacaacuuccaccucggagacgacauggacccagaacuccgcagccuagcacaaauccuaaucgaccagaaagucaaagaaaucagcaaccaagaacccaugaagcucuaa

SEQ ID NO: 7944 - RNA, 1290 nt, Artificial Sequence
  derived and/or modified CDS sequence (opt11) from SEOV(93HBX12)__EF192308.1__N
auggcaaccauggaagaaauacaacgcgaaaucuccgcccacgaaggacagcuagucauagcccgccaaaaggucaaagacgccgaaaaacaauacgaaaaagacccggacgaccucaacaaacgagcccuccacgaccgagaaagcgucgccgccuccauacaaagcaaaaucgacgaacucaaacgccaacuagccgaccgcauagcagccggcaaaaacaucggacaagaucgagaccccaccggcgucgaacccggcgaccaccuaaaagaacgcucagcacuaucauacggcaauacccucgaccuaaacucccucgacaucgacgaacccaccggccaaaccgccgacuggcucaccauaaucguauaccucaccucauuugucguacccaucauccucaaagcgcucuacaugcuaaccacgcgcggccgccaaacaucaaaggacaacaaaggcaugcgcauccgauucaaagacgacagcucauacgaagacgucaacggcauaggcaaacccaaacaccucuacgucuccaugccgaacgcacaauccagcaugaaagccgaagaaaucacccccggccgauuccgaaccgcagucugcggacucuacccagcccaaaucaaagcccgcaacaugguaagccccgucaugagcguagucggcuuccucgcccucgcaaaagacuggaccucacgcaucgaagaguggcuaggcgcccccugcaaguucauggccgaaagcccaaucgccggcagccuaagcggaaaccccgucaaccgcgacuauauacgacaacgacaaggcgcacucgccggcauggaaccaaaagaguuccaggcccuccgacagcacagcaaagacgccggaugcacccuaguagaacacauagaauccccauccuccauaugggucuucgcaggagccccagaucgcuguccucccacaugccucuucgugggcggcauggcagaacuaggagccuucuucuccauccuccaggacaugcgcaacaccaucauggccuccaaaacaguaggcaccgcagacgaaaaacuacgcaagaaaagcucauucuaccaauccuaccuccgcaggacccagagcaugggaauacaacuagaccaacgcauaaucguaauguucauggucgcauggggcaaagaagccgucgacaacuuccaccucggcgacgacauggaccccgaacuccgcggccuagcccagauccuaaucgaccaaaaaguaaaagaaaucuccaaccaagaacccaugaaacucuaa

SEQ ID NO: 7945 - RNA, 1290 nt, Artificial Sequence
  derived and/or modified CDS sequence (opt11) from SEOV(Cherwell)__KC626089.1__N
auggccaccauggaagaaauccaacgagagaucuccgcacacgaaggccagcuagucauagccagacaaaaagucaaagacgcggagaaacaauacgaaaaagaccccgacgaccucaacaaaagggcccuacacgaccgcgaaagcgucgcagccagcauacaaagcaaaaucgacgaacucaaaagacaacucgccgaccgaaucgcagccggcaaaaacaucggacaagaccgagaccccaccggcguggaacccggcgaccaccucaaagaaagauccgcccucuccuacggaaacacccuagaccucaacucacucgacaucgacgaacccacugggcaaaccgcagacuggcucacaaucauaguauaccucaccuccuucguaguccccauaauccucaaagcacucuacaugcuaaccaccagaggccgccaaacauccaaagacaacaaaggcaugagaauccgcuucaaagacgacucauccuacgaagacgucaacggaauccgcaaacccaaacaccucuacgucuccaugccaaacgcgcaauccagcaugaaagcggaagaaaucacgcccggccgcuuccgcacggccguaugcggccucuaccccgcacaaauaaaagcacgcaacauggucuccccagucauguccgucgucggcuuccuagcccuagccaaagacuggacaucccgaauagaagaauggcuaggagcccccugcaaauucaucgccgaaagccccaucgccggcagccucagcggcaacccggucaaccgcgacuacauccgccaaagacaaggcgcccucgcuggaauggaacccaaagaguuccaagcccuaagacaacauagcaaagacgcaggaugcacccucgucgaacacauagaaagccccagcagcauaugggucuucgcaggcgcccccgacagaugcccaccaaccugccuauucgucggaggaauggccgaacuaggagccuucuucagcauccuccaagacaugcgcaacaccaucauggccagcaaaacagucggcaccgccgacgaaaaacuccggaaaaagagcagcuucuaccagucauaucucagacgaacccaaagcaugggcauacaacucgaucaacgaauaaucgucauguucaugguagccuggggcaaagaagccguagacaacuuccaccuaggcgacgacauggaccccgaacuccgcucccuagcgcaaauacucaucgaccaaaaagugaaagaaaucucgaaccaagaacccaugaaacucuaa

SEQ ID NO: 7946 - RNA, 1290 nt, Artificial Sequence
  derived and/or modified CDS sequence (opt11) from SEOV(CixiRf23)__FJ803201.1__N
auggccacaauggaagaaauccagcgcgagauauccgcacacgaaggccaacuugucaucgcacgacagaaagucaaagacgccgaaaaacaauacgaaaaagaccccgacgaccucaacaagcgcgcacuccacgaccgcgaaucgguagccgccuccauccagagcaaaauagacgaacucaaaagacagcuagccgaccgcauagcagccggcaagaacaucggccaagaccgagaccccacaggcgucgaaccaggcgaccacuuaaaggaacguagcgcacucucauacggaaacacacuagaccugaacucccucgacaucgacgaaccaacaggccaaaccgcggacuggcucacaauaaucguauaccucaccucauucguaguccccauaaucuuaaaggcccucuacaugcucacaacacgaggccgccaaaccuccaaagacaacaaaggcaugcgcauccgcuucaaagacgauagcucauacgaagacgucaacggcauccgcaaaccaaaacaccuauacguauccaugcccaacgcccaauccagcaugaaggccgaagaaaucacccccggccgcuuccgaacagccgugugcggacuauacccagcacagauaaaagcacgcaacaugguaucgcccgucaugucggucgucggguuccuagcacuggccaaagacuggacaucccgcaucgaagaauggcucggcgccccaugcaaauucauggcagaaucacccaucgcaggaucacuaaguggaaacccagucaaccgcgacuacauccgccaacgccagggggcacucgcaggaauggagccaaaagaguuccaagcccugcgccaacacgccaaagacgccggacgaacacucguagaacacaucgaaagccccuccuccauaugggucuucgcaggagcccccgaccgcugcccaccaaccugccucuucgucggaggcauggccgaacucggcgccuucuucucaauacuccaagacaugagaaacaccauaauggcauccaaaacagucggcaccgccgacgaaaaacuaagaaagaaaagcucauucuaccaauccuaccuacgccgaacccagagcaugggcauccagcucgaccaacgcauaauagucauguucauggucgccuggggaaaagaagccgucgacaacuuccaccuaggcgacgacauggaccccgaacuccgcagcuuagcccaaauccucauagaccaaaaagugaaagaaaucucaaaccaagaacccaugaaacuauag

SEQ ID NO: 7947 - RNA, 1290 nt, Artificial Sequence
  derived and/or modified CDS sequence (opt11) from SEOV(CixiRf56)__FJ803202.1__N
auggccaccauggaagaaauccagcgagaaaucuccgcacacgaaggccaacucgucauagcccgacaaaaagucaaagacgccgaaaaacaauacgaaaaagaccccgacgaccuaaacaaacgggcccuccacgaccgcgaaagcgucgccgccagcauccaauccaaaauagacgaacucaaaagacaacucgccgaccgcaucgccgccggcaaaaacaucgggcaagaccgcgaccccaccggcgucgaacccggcgaccaccucaaagaacgguccgcccucuccuacggcaacacacuagaccuaaacucccuagacaucgacgaaccaaccggccaaacggccgacuggcuaacaaucaucgucuaccugaccuccuucgucguccccaucauccucaaagcccuauacaugcucaccacacggggccgccaaaccagcaaagacaacaaaggcaugcgcauccgcuucaaagacgacagcagcuacgaagacgucaacggaauacgaaaacccaaacaccucuaugucuccaugcccaacgcccaaucaagcaugaaagccgaagaaaucacccccggacgcuuccgaaccgccgucuguggccucuacccugcccaaauaaaagcacgcaacauggucucacccgucauguccguaguuggauuccuagcacuagccaaggacuggaccucacgaaucgaagaauggcuaggagcccccugcaaauucauggcagaaucccccaucgccggcucccuaagcggcaacccagucaacagagacuacauccgacaaggucaaggcgcccuagccggcauggaacccaaagaguuccaagcccuucgccaacacgcaaaagacgccggcugcacccucgucgaacauaucgaaucccccucaucaauaugggucuucgccggggcaccagacagaugcccacccacaugccuuuucgucggcggcauggccgaacuaggcgccuucuucuccauccuccaagacaugcgcaacaccauaauggccagcaaaaccgucggcacggccgacgaaaaacuaagaaagaaaagcucauucuaccaaucguaccuacgccgaacacaauccaugggcauacaacucgaccaaagaaucauagucauguucauggucgccuggggcaaagaagccgucgacaacuucccccucguccacgacauggacccaaaacucagaagucuaucccaaauacuaaucgaccaaaaagucaacgagaucucgaaccaagaaccaaugaaacuauaa

SEQ ID NO: 7948 - RNA, 1290 nt, Artificial Sequence
  derived and/or modified CDS sequence (opt11) from SEOV(CixiRn21)__FJ803205.1__N
auggccaccauggaagaaauccagcgagaaaucagcgcccacgaaggacaacucgucauugcccggcaaaaagucaaggacgccgaaaaacaauacgaaaaggacccagacgaccuaaacaaacgcgcacuccacgaccgagaaagcguagcagcauccauacaguccaaaaucgacgaacucaaaagacaacucgccgaccgaaucgcagccggcaaaaacaucggccaagacagagaccccaccggagucgaacccggagaccaccucaaagaacgaagcgcacuauccuacggcaacacccuagaccuaaacucccucgacaucgacgaacccaccggccaaaccgccgacuggcucaccauaaucgucuaccugaccuccuucgucguacccaucauccucaaagcccuauacaugcucaccacccgcggaagacaaacaagcaaagacaacaaaggcaugagaauccgauucaaggacgacagcucauacgaagacgucaacggaauccgaaaacccaaacaccucuacguauccaugccaaacgcacaaucaagcaugaaagccgaagaaauaaccccaggccgcuuccgcaccgcggucugcggccuauaccccgcccaaauaaaagcccgcaacauggucucaccaguaaugucugucgucggauuccuagcccucgcaaaagacuggacuucccgcaucgaagagugguuaggagcacccugcaaauucauggcugaaucacccaucgcaggaagccucagcgggaacccaguaaacagagacuacauacgacaacgacaaggcgcgcucgcaggaauggaaccaaaagaguuccaagcgcuccgccaacacucaaaagacgccggcugcacccuagucgaacacaucgaaucccccucgucaaucuggguauucgccggagcccccgaccgaugcccacccacaugccucuucgucggcggcauggacgaacucggagccuucuucagcauccuacaagacaugcgaaacaccaucauggcgagcaaaaccgucgguaccgcggacgaaaaacucagaaagaaauccuccuucuaccaaagcuaccuccgacgaacacaaagcaugggcauccaacuagaccaccgcaucauaguaauguucauggucgccuggggcaaggaggccguagacaacuuccaccuaggcgacgacauggaccccgaacuccgaacccucgcccaaauccucauagaccaaaaagucaaagaaaucagcaaccaggaaccaaugaaacucuaa

SEQ ID NO: 7949 - RNA, 1290 nt, Artificial Sequence
  derived and/or modified CDS sequence (opt11) from SEOV(CixiRn76)__FJ803206.1__N
auggccaccauggaagaaauccaacgcgaaauaagcgcacacgaaggacaacugguaauagcccgccaaaaagucaaagacgccgagaaacaauacgaaaaagacccggacgaccucaacaaaagggcacuccacgaccgagaaagcguagccgccaguauacaauccaaaaucgacgaacucaaacgccaacuagccgacagaaucgccgcuggcaaaaacaucggacaagaccgcgacccaaccggcgucgaaccaggagaccaccucaaagaacgcucagcacuaagcuacggcaacacccuagaucuaaacagcuuagacauagacgaacccaccggccaaacagcagacuggcucaccaucauagucuaccucaccagcuucgucguccccaucauccuaaaagcccuauacaugcuaacaacacgaggcagacaaaccagcaaagacaacaagggaaugcgcauccgcuucaaagacgacuccucauacgaagacgucaacgguauccgaaaacccaaacaucucuacgucucaagccaaaacgcccaaucguccaugaaagcagaagaaaucacccccggccgcuuccgcaccgccgucugcggccucuaccccgcccaaauaaaagcacgcaacauggucagcccagucaugagcgucgucgguuuccuagcccuagccaaagacuggaccuccagaauagaagaauggcucggcgcgccaugcaaauucauggccgaaagccccaucgccgguagccuaagcggcaaccccgucaaccgcgacuacauccgacaaggacaaggcgcacucgccggcauggaaccaaaagaguuccaggcgcuacgccaacacgcaaaggacgcaggaugcacacucgucgaacacaucgaaaguccuuccagcaucugggucuucgccggagccagagaccgaugcccucccacaugccucuucgucggcggcauggccgaacuaggagccuuuuucagcauccuccaagacaugcgaaacacaaucauggccagcaaaaccgucggcacagcagaugaaaaacuaagaaagaaaagcagcuucuaccaaucauaccuccgacgaacccaauccaugggcauccaacuggaccaacgcaucauagucauguucaugguggccugggggaaagaagccgucgacaacuuccaccucggcgacgacauggaccccgaacuccgcucccucgcccaaauccuaaucgaccaaaaaguaaaagaaaucucaaaccaagaacccaugaaacuauag

SEQ ID NO: 7950 - RNA, 1290 nt, Artificial Sequence
  derived and/or modified CDS sequence (opt11) from SEOV(CUI)__GQ279395.1__N
auggccaccauggaagaacugcaacgcgaaaucucggcccacgaaggccaacucgucaucgccagacaaaaagucaaagacgcagaaaaacaauacgaaaaagaccccgacgaccuaaacaaaagagcccuccacgaccgcgaauccgucgccgccagcauccaaucaaaaaucgacgaacuaaaacgccaacucgcagaccgcaucgccgcaggcaaaaacaucggccaagaccgagacccaacaggcgucgaacccggagaccaccucaaagaaagauccgcccucuccuacggcaacacccucgacuuaaacucacucgacaucgacgaacccaccggccaaacggccgacuggcuaacuaucaucguauaccugaccagcuucgucguaccuaucauacuaaaagcacucuacaugcucacuacccgaggccgacaaaccucaaaagacaacaagggcaugcgaauccgcuucaaagacgacuccagcuacgaagacgucaacggcauacgaaaacccaaacaccuauacguaagcaugcccaacgcccaaucauccaugaaagccgaagaaaucacccccggccgcuucagaacagccgucugcggccucuacccagcacaaauaaaagcccgaaacaugcucuccccagucauguccguaguaggcuuccucgcccuagccaaagacuggacaucccgcauagaagaauggcuaggcgcccccugcaaguucauggccgaaucccccaucgcugguagccuaucaggcaaccccgucaaccgcgacuacauccgccaacgccaaggagcccucgccggaauggaaccaaaggaguuccaggcccuacgacaacacucaaaagacgccggaugcacccuagucgaacauauugaaucacccagcuccaucugggucuucgccggcgcaccagaccgaugcccgcccacaugccucuucgucggcggaauggccgaacucggcgccuucuucagcauccuccaagacaugcgcaacaccaucauggccagcaaaacaguaggcaccgcagacaagaaacuacgaaagaaauccagcuucuaccaaucauaccuccgccgcacccaaucaaugggcauacaacuagaccaacgcaucauagucauguucauguucgccuggggcaaagaagccguagacaacuuccaccucggagacgacauggaccccgaacuccgaggacucgcccagauucuaaucgaccaaaaaguaaaagagaucucaaaccaagaaccaaugaaacuuuaa

SEQ ID NO: 7951 - RNA, 1290 nt, Artificial Sequence
  derived and/or modified CDS sequence (opt11) from SEOV(FeixianRn1)__GU592942.1__N
auggccacaauggaagaaauccaacgcgaaaucuccgcccacgaaggccaacucgucaucgcccgccaaaaaguaaaagacgcagaaaaacaguacgaaaaagaccccgacgaccucaacaaacgagcccuccacgaccgggaaucagucgcagccucaauccaauccaaaauagacgaacucaaacgccaacucgccgaccgcaucgcagccggcaaaaacauaggacaagaccgagacccaaccggcgucgagcccggagaccaccuaaaagaacgcuccgcccuauccuacggaaacacccucgaccuuaacagccucgacaucgacgaacccacaggccaaaccgcagacuggcuaacgaucaucguauaccucaccagcuucguaguccccaucauacuaaaagcccuauacaugcuuaccacccgcggcagacaaaccuccaaagacaacaaaggaaugcguauccgcuucaaagacgacucauccuacgaagacgucaacggcauacgcaaaccaaaacaccuauacguuuccaugcccaacgcucaauccuccaugaaagcagaagaaaucacccccggaagauuccgaaccgccgucugcggacucuacccagcgcaaauaaaagcccgcaacaugguaucccccgucauguccgucguuggcuuucucgcccuagccaaagacuggacaucccgcaucgaagaauggcucggcgcaccaugcaaauucauggccgaaucccccaucaccggcucccuauccggcaacccagucaaccgggacuacauacgacaacgacaaggcgcccuugccggcauggaacccaaagaauuccaagcccuccgccaacacgccaaagacgccggaugcacccuagucgaacacauagaauccccauccucgaucugggucuucgcaggagcaccagaccgaugcccccccaccugccucuucgucggaggcauggccgaacucggcgccuucuucucgauacuccaagacaugagaaacacgaucauggccucuaaaacagucggcacagccgacgagaaacuaagaaaaaaaucgucauucuaccaauccuaccuccgacgcacccaaagcaugggcauacaacuagaccaacgcaucauagucauguucaugguagccuggggcaaagaagccguagacaacuuccaccuaggagacgacauggaccccgaacuccgaucccucgcccagauacuaauagaccaaaaaguaaaagaaaucuccaaccaagaaccaaugaaacucuaa

SEQ ID NO: 7952 - RNA, 1290 nt, Artificial Sequence
  derived and/or modified CDS sequence (opt11) from SEOV(GanyuRn66)__GU592932.1__N
auggccaccauggaagaaauacaacgcgaaauaucagcacacgaaggacaacucgucaucgcacgccaaaaaguaaaagacgcagaaaaacaauacgaaaaagaccccgacgaccugaacaaacgcgcccuacacgaccgcgaguccgucgccgccagcauccaaagcaagauagacgaacucaaacgccaacucgccgacagaaucgccgcaggcaaaaacaucggacaagaucgcgacccaacaggcguagaaccgggagaucaccucaaagaacgcucagcauuauccuacggcaacacccucgaccucaacagccuagacauagacgaacccaccggccaaaccgccgacuggcucacaauaauagucuaccuaaccagcuucgucguuccaauaauccuaaaagcccucuacaugcuaacgacaagaggccgccaaaccagcaaagacaacaaaggaaugcggauccgauucaaagacgacagcagcuacgaagacgucaacggcauccgcaaacccaaacaccucuacgucucaaugcccaaugcacaauccuccaugaaagcagaagaaauaacccccggccgcuuccgaaccgccgucugcggacucuaccccgcgcaaauaaaagcccgaaauauggucuccccagugaugagcguagucggauuccuagcccucgccaaagauuggaccucgcgcauagaagaauggcucggcgcccccugcaaauucaccgccgaauccccaaucgccggaagccucuccggcaacccagucaaccgcgauuacauaagacaacgacaaggcgcccucgccggcauggaaccaaaagaguuccaagcccuccgccaacacgcuaaagacgcaggcugcacccucgucgaacacaucgagucacccuccuccaucugggucuucgccggcgccccggaccgaugcccacccacaugccuauucguaggaggcauggccgaacucggagcauucuucucaauacuucaagacaugcgaaacaccaucauggcaucaaaaaccgugggcaccgcagacgaaaaacuacgcaagaaaagcucauucuaucaauccuaccuccgccgaacccaguccauggguauccaacucgaccaacgcauaaucguaauguucaugguagccuggggcaaagaagccguagacaacuuccaccuaggcgacgacauggaccccgagcuccgaagccucgcucagauacucaucgaccaaaaagucaaagaaaucuccaaccaagaacccaugaaacucuaa

SEQ ID NO: 7953 - RNA, 1290 nt, Artificial Sequence
  derived and/or modified CDS sequence (opt11) from SEOV(Gongzhuling108)__KF745947.1__N
auggccaccauggaagaaauccaacgcgaaaucucagcccacgaaggccaacucgucauagccagacaaaaagucaaagacgccgaaaaacaauacgaaaaggacccagacgaccucaacaaaagcgcccuacacgaccgcgaauccgucgcagcaucuauacaauccaaaaucgacgaacucaaacgucagcucgcagaccgaauagccgccggcaaaaacaucggccaagaccgcgacccaaccggcgucgaaccaggagaccaccugaaagaacgcucggcccucuccuacggaaacacacuagaccucaacucacucgauaucgacgaaccaaccggccagaccgcagacuggcucaccauccucgucuaccucaccucauucgucgugcccauaauccuuaaagcacuauacaugcucacaacccgaggccgccaaaccuccaaagacaacaaaggcaugcgcauccgguucaaagacgacggcuccuacgaagacgucaacggcauccgcaaacccaaacaccucuacguccccaugccaaacgcccaauccucaaugaaagccgaagaaaucacccccggccgauuccgcaccgcagucugcggccucuaccccgcccaaauaaaaccucgcaacauggucuccccaguaauguccguaguaggcuuccucgcacucgccaaagacuggaccucccgaaucgaagaauggcucggcgcacccugcaaauucauggcagaaagccccaucgcaggcucccucagcggcaaccccguaaaccgugacuacauacgccaacgccaaggcgcacucgccggaauggaaccaaaagaguuccaggcgcuacgccagcacgcaaaagacgccggcugcacccuaguagaacacaucgaauccccauccucaaucagaguauucgcaggagcccccgcccgcugcccucccacaugccuguucgucggcggcauggcagaacuaggcgccuucuucuccauccuucaagacaugcgcaacacaaucauggccaguaaaacagucggcacagccgacgaaaaacuccgcaagaaauccucuuuuuaccaaucauaccuccgccgaucacaaucaaugggcauacagcucgaccaaagaauuaucguaauguucaugguagccucaggaaaagaagccgucgacaacuuccaccucggugacgacauggaccccgaacuacgcucccuaguacaaauccucauagaccaaaaagucaaagaaaucucaaaucaagaacccaugaaacucuaa

SEQ ID NO: 7954 - RNA, 1290 nt, Artificial Sequence
  derived and/or modified CDS sequence (opt11) from SEOV(Gongzhuling147)__KF745948.1__N
auggcaaccauggaagaaauacaacgagaaauauccgcccacgaaggacagcuaguaaucgcacgccaaaucgucaaagacgccgaaaaacaauacgaaaaagacccagccgaccuaaacaaaagagcccuccacgaccgagaaagcguagccgcauccauccaaucuaaaauagacgaacucaaacgccaccuugccgacagaauagccgccggcaaaaacaucggacaagaccgcgaccccaccggaguagaacccggagaccaccuuaaagaacgcuccgcacuaagcuacgggaacacccuagaccuaaacucccuagacaucgacgaacccaccggccaaacggccgacuggcucacaaucauagucuaccuuaccucauucgucgucccaaucauacucaaagcccuauacauccucaccacgagcggcagacaaaccuccaaagacaacaaaggcaugcgaauacgauucaaagacgacagcagcuacgaagacgucaacggaauaagaaugcccaaacaccucuacgucccaaugcccaacgcgcaaagcuccaugaaagcagaagacaucacccccggcagauuccgcaccgccgucugcgggcucuaccccgcacaaauaaaagcacggaacauggucucaccacucaugucagucgucggauuccuagcccuaccaaaagacuggaccucccgaauagacgaaugguuaggagcacccugcaaauucauggccgaaagccccauagcaggcagccucucaggcaacccggugaaccgagaccacaucagacaacgccaaggcgcccuagccgggauggacccaaaagaguuccaagcagucagacaacacgcaaaagacgcaggcugcacauuaguagaacacauagaaagcccaagcagcaucugggucuucgccggagccccagaccgcugcccaccaaccugccucuucgucggcggaauggccgaacucggcgcauucuucacaauccuacaggacaugcgaaacacaaucaugcccucaaaaaccguaggcacugccgacgaaaaacucagaaagaaauccuccuucuaccaaucauaccuccgcaggacacaauccaugggaauccaacuagaccaaagaaucauaguaauauucaugguagccugggccaaagaagcggucgacaacuuucaccucggcgacgacauggaccccgaacucagaucccuagcucaaauacucaucgaccaaaaaguaaaagaaaucuccaaccaaguccccaugaaacuauag

SEQ ID NO: 7955 - RNA, 1290 nt, Artificial Sequence
  derived and/or modified CDS sequence (opt11) from SEOV(Gongzhuling415)__KF745949.1__N
auggccacaauggaagaaauacaacgagaaaucagcgcccacgaaggccaauuggucaucgcccgacaaauggucaaagacgccgaaaaacaauacgaaaaagaccuagcagaccucaacaaaagagcccuccacgaccgcgaaagcguggccgccuccauacaaucaaaaauagacgagcucaaaagacaacucgcagaccgcaucgcagcaggaaaaaacaucgaacaagaccgcgacccaaccggaguagaacccggcgaccaccucaaagaacgcuccgcccucagcuauggcaacacccuggaccucaacucucuagacaucgacgaacccacaggccaaacggcagacuggcuuaccaucauaguuuaccucaccucauucgucguccccaucauccuaaaagcccucuacauacucaccacacgaggacggcaaacuagcaaagacaacaaaggcaugacaauacgauucaaagacgacucaucauacgaggacguaaacgguauccgcaugcccaaacaccucuacgucccaaugccuaacgcccaaucgagcaugaaagcagaagacaucacacccggacgcuuccgcaccgccguaugcggccucuaccccgcacaaaucaaagcgcgcaacauggucuccccccucaugagcgucgucggauuccuagccuuacccaaagacuggacaucacgcaucgacgaguggcucggcgcacccugcaaauucauggcagaaucaccuauagccggcagccuaucaggcaacccagucaacagagaccacauccgccaacgccaaggcgcacuagccggcauggacccaaaagaauuccaagcaguccgccaacacgcaaaagaugccggcugcacccucgucgaacacaucgaaagccccuccucaaucugggucuucgcaggcgcaccagacagaugccucccaaccugccucuucgucggcggcauggccgagcucggcgcauucuucaccauccuccaagauaugcgcaacaccaucauggccagcaaaaccgucggcaccgccgacgaaaaacucggcaaaaaaagcuccuucuaccaauccuaccuccgccgcacccaaaguaugggcauccaacucgaccaacgaaucaucguaauguucauggucgccugggccaaagaagccguugacaacauccaccugggcgacgacauggacccagaauugaggucgcuagcacaaauccucaucgaccaaaaagucaaagaaaucagcaaccaagucccaaugaaacucuaa

SEQ ID NO: 7956 - RNA, 1290 nt, Artificial Sequence
  derived and/or modified CDS sequence (opt11) from SEOV(Gongzhuling42)__KF745942.1__N
auggccaccauggaagaaauacaacgcgaaaucucggcucacgaaggccaacucgucaucgcccgacaaaaagucaaagacgcccaaaaacaauacgaaaaagaccccgacgaccuaaacaaaagagcccuccacgaccgagaaagcgucgccgccagcauccaacuuaaaauugacgaacucaaacgccaacucgcagaccgaaucgccgcaggcaaaaacaucggccaagaccgcgaccccaccggagucgaaccuggcgaccaccucaaagaacgcagcgcacugagcuacggaaacacccucgaccucaacucccuggacaucgacgaacccacgggccaaacagccgacuggcucacaaucauaguauaccugaccuccuucguaguccccauaauucuaaaggcacuauauauguuaaccacccgcggccgccaaaccuccaaagacaacaagggaaugcgaauacgcuucaaagacgacagcuccuacgaagacguaaaaggcaucagaaaaccuaagcaccuauacguaccaaugcccaacgcccaauccagcaugaaagccgaagaaauaacccccggaagaugccgcacagccgucugcggccuauacccagcccaaauaaaagcccgcaacauggucucccccguaaugagcgcagucggcauccucgcacuggccaaagacuggacuucccgcaucgaagaauggcucggaacaccaugcaaauucauggccgaaagcccgaucgccggcucacucuccggaaaccccgucaaccgagaccacauccgccagcgacaaggcgcacucgccggcauggaacccaaagaauuucaaggccuccgccaacacgccaaagacgccggaugcacccucguagaacacaucgaaucacccuccucaaucugggucuucgccggagcccccgaccgcugucccccuacgugccucuucguaggaggcauggccgaacugggcgccuucuucgccauccuccaagacaugcgcaacaccaucauggccagcaaaacggucggaaccgcagacgaaaaacuccgcaaaaagucguccuucuaccaguccuaccuacgccgcacacaauccaugggaauacaacuagaccagcgaaucaucguaauguucauggucgcaugggccaaagaagcggucgacaacuuccacuuaggcgacgacauggaccccgaacuccgcucccuagcccaaauacuaauggaccaaaaagucaaagaaauaagcaaccaagaacccaugaaacucuaa

SEQ ID NO: 7957 - RNA, 1290 nt, Artificial Sequence
  derived and/or modified CDS sequence (opt11) from SEOV(Gongzhuling45)__KF745943.1__N
auggccaccauggaagagauccaacgcgagaucuccgcccacgaaggccaacucguaaucgcacgacaaaugguaaaggacgcagaaaaacaauacgaaaaagauccagccgaccuaaauaaaagagcccuccacgaccgcgaauccgucgcagcaagcauacaaagcaaaauagacgagcucaagcgccaacuagccgacagaaucgccgccggcaaaaacaucggacaagaccgcgaccccacgggaguagaacccggcgaccaccucaaagaacgaucagcccucagcuaccgaaacacacucgaccuaaacucccucgacaucgacgaacccaccggacaaaccgccgacuggcucaccauaaucgucuaccucaccuccuucgucguccccauaauacuuaaagcccuauacauccuaacuacccgcggccggcaaacuagcaaagauaacaaaggcaugaggaucagauucaaggacgacuccucauacgaagacguaaacggcauacgcaugcccaagcaccucuaccuccccaugcccaacgcccaaucauccaugaaagcagaagacaucacccccggcagauuccgcaccgcagucugcggccucuacccagcccaaauaaaagcucgaaacauggucagcccacuaaugucagucguaggauuccucgcacuccccaaagacuggaccagcagaaucgacgaauggcucggggcccccugcaaauucauggccgaaucacccaucgccggcucacucagcggcaacccagucaaccgagaccacauccgacaacgccaaggagcacuagccggaauggaccccaaagaguuccaagccguccgccaacacgcaaaagacgccggcugcacacucguagaacacaucgaaucccccagcuccaucugggucuucgccggcgcccccgacagaugcccacccacaugccucuucgucggcggaauggcagaacuaggcgccuucuucacaauccuccaagacaugagaaacaccaucauggcuuccaaaaccgugggcaccgccgacgagaaacuucgaaagaaauccucauucuaccaaucauaccuacgcagaacacaaucaaugggcauacaacuagaccaacgcaucaucgucauguucauggucgcuugggccaaagaagcagucgacaacuuccaccucggugacgacauggaccccgaacucagaucccucgcccaaauacucauagaccacaaaguaaaagaaaucuccaaccaagucccaaugaaacuuuaa

SEQ ID NO: 7958 - RNA, 1290 nt, Artificial Sequence
  derived and/or modified CDS sequence (opt11) from SEOV(Gongzhuling58)__KF745944.1__N
auggccaccauggaagaaauccaacgcgaaaucucggcccacgaaggacagcuagucaucgcccgccaaauggucaaagacgccgaaaaacaauacgaaaaagaccccgccgaccugaacaaacgagcacuacacgaccgggaaagcgucgccgccagcauccaauccaaaaucgacgaacucaaacgacaacuagcugaccgcaucgcggccgggaaaaacauuggccaagaccgcgacccaaccggcguagaacccggcgaccaccuaaaagaacgcuccgcccucucauacggaaacacccucgaccugaacucccucgacaucgacgaacccaccggccaaaccgccgacuggcucaccaucaucguauaucucaccagcuucguaguaccaauaauacucaaagcccuauacauccuaaccacccgcggccgacaaacaagcaaagacaacaaaggaaugagaaucagguucaaagacgacucaucauacgaagacguaaacggcauccgaaugccaaaacaccucuacguacccaugcccaacgcccaaucaucaaugaaagccgaagacaucacacccggacgcuuccgaacagccgucugcggccuauaccccgcgcaaauaaaagcccgcaacauggucagcccccucaugagcguggucggauuccucgcccucccaaaagacuggaccucgcgcaucgacgaaugguuaggcgcacccugcaaauucauggccgaaucacccauagcaggcagccucagcggcaacccgguaaaccgcgaucacauacggcaacgccaaggcgcccuagcaggcauggacccuaaagaguuccaagccguccgacaacaugccaaagacgccggcugcacacucgucgaacacauagaaagcccauccaguauaugggucuucgcaggggcccccgacaggugcccacccacgugccucuucguaggcggaauggcagaacucggcgcauucuucaccauccuccaagacaugcgaaacaccauaauggccucaaaaaccgucggcacugccgacgaaaagcuccgaaagaaaagcucguucuaccaguccuaccuaagacgcacccaauccaugggcauacaacucgaccaacgaauaaucguaauguucaugguggccugggccaaagaagccgucgacaacuuccaccuaggcgacgacauggaccccgaacuccgcucacuggcacaaauacucauagaccaaaaagugaaagaaaucuccaaccagguacccaugaaacuauaa

SEQ ID NO: 7959 - RNA, 1290 nt, Artificial Sequence
  derived and/or modified CDS sequence (opt11) from SEOV(Gongzhuling85)__KF745945.1__N
auggccaccauggaagaaauccaaagagaaauauccgcccacgaaggccaacucgucaucgcacgccaaauggucaaagacgccgaaaaacaauaugaaaaagaccccgcagaccucaucaaacgagcccuccacgaccgcgaguccgucgccgccucaauccaauccaaaaucgacgaacuaaaacgucaacuagcagaccgaaucgccgccggcaaaaacaucggacaagaccgugaccccacaggccucgaaccaggcgaccaccuaaaagaacgauccgcacuauccuacggcaacacccucgaccucaacucccuagacaucgacgaacccaccggccaaaccgccgacuggcuaacugucaucguauaccucaccuccuucgucguccccaucauccuaaaagcccuauacauccucacuacccggggucgccaaacaucaaaagacaauaaaggcaugagaauccgcuucaaagacgucucaucauacgaggacguaaacggcauccgaaugcccaaacaccuauacguucccaugccaaacgcccagucguccaugaaagccgaagacaucacacccggucgcuuccgcacagcagucugcggccucuaccccgcacaaaucaaagcaagaaacauggucucaccacucauguccgucgucggcuuccucgcccuccccaaagacuggaccucacgcaucgacgaauggcucggcgccccaugcaaauucauggccgaaagcccaaucgccggcagccuauccggaaaccccgucaacagagaccacauccgacaacgccaaggcgcccucgccggaauggaccccaaggaguuccaagccguccgccaacacgcgaaggacgcaggaugcacccuaguagaacacauagaauccccaagcuccaucugggucuucgccggcgcccccgaccgcugucccccaacaugccuauucguccgaggaauggcagaacucggcgcuuucuucaccauccuccaagacaugcgcaauaccauaauggccuccaaaacagucggcacagccgacgaaaaacuaagaaagaaaagcuccuucuaccaauccuaccuccgccgcacccaauccaugggaauacagcucgaucaacgaauaauagucauguucauggucgccugggccaaagaagccgucgacaacuuccaccuaggcgacgacaugcaccccgagcuccgaucccucgcccaaauacucauagaccaaaaagucaaggaaaucuccaaccaaguccccaugaaacuauaa

SEQ ID NO: 7960 - RNA, 1290 nt, Artificial Sequence
  derived and/or modified CDS sequence (opt11) from SEOV(Gongzhuling97)__KF745946.1__N
auggcgaccauggaagaaauacagcgagaaaucagcgcccacgaaggccaacucguaaucgcccgacaaaugguaaaagacgcagaaaaacaauacgaaaaagaccccgcagaccucaacaaacgcgcacugcacgaccgcgagucaguagccgccuccauccaauccaaaauagacgaccucaaacgccaacucgcagaccgaauagccgcaggaaagaacauaggacaggacagagacccaacaggcgucgaacccggcgaccaccuuaaagagagguccgcccuaagcuacggcaacacacucgaccucaacucccucgacaucgacgaaccuaccggacaaaccgcagacuggcugaccaucaucguauaccugacauccuucgugguccccaucauccucaaagcccucuacaugcucaccaccagaggcagacaaacaagcaaagacaacaaaggcaugagaauccgauucaaagacgacucauccuacgaagacgucaacggcauccgaaugcccaaacaccucuacguccgcaugcccaacgcccaaucauccaugaaagcagaagacauaacacccggacgcuuccgaaccgccgucugcggccucuacccagcacaaaucaaagcccgcaacaugguuucaccccucaugucagucgucggcuuccucgcacuccccaaagacuggaccucccgcaucgacgaauggcucggagcacccugcaaauucauggcagaaucaccuaucgccggcucccucuccggaaaccccgucaaccgcgaucacauacgccaacgccaaggcgcccucgccggcauggaccccaaagaguuccaagccguccgccaacacgccaaagacgcaggcugcacccuaguagaacacaucgaaagcccauccuccaucugggucuucgccggcgcacccgaccguugucccccaacaugccucuucgucggaggaauggccgagcucggcgcauucuucacaauacuccaagacaugcguauaacaaucauggccucaaaaaccgucggcaccgcagacgaaaagcuacgcaagaaaagcuccuucuaccaauccuaccuccgccgcacccaaucaaugggaauacaacuagaccaacgccucaucgucauguucauggucgccugggccaaagaagcaguugacaacuuccaccuaggcgacgacauggacccagaacuccgcucccucgcccaaauccuaauagaccaaaaagucaaacaaaucuccaaccagguucccaugaaacucuaa

SEQ ID NO: 7961 - RNA, 1290 nt, Artificial Sequence
  derived and/or modified CDS sequence (opt11) from SEOV(Gou3)__AB027522.1__N
auggcaaccauggaagagauccaacgcgaaauauccgcccacgaaggacagcuaguaaucgcccgucaaaaagucaaagacgccgaaaaacaauacgaaaaagaccccgacgaccugaacaaacgagcccuccacgaccgagaauccguagcagccuccauacaaucaaaaauagaugagcucaaacgccaacucgccgaccgaauagccgcaggcaagaacaucggccaagaccgcgaccccaccggcgucgagcccggcgaccaccucaaagaacgauccgcccuauccuacggaaacacccucgaccuuaacagccucgacaucgacgagcccaccggacaaacagccgacuggcuaacaaucauagucuaccucaccagcuucgucgucccaaucauccuuaaagcccuauacaugcucacaacccgcggacgccaaacaucaaaagacaacaaaggaaugcgcauccgcuuuaaagacgacagcuccuacgaagacguaaacggcaucagaaaaccaaaacaccuguacguaagcaugcccaacgcucaaucuuccaugaaagcggaagaaaucacacccggcuccuuccguaccgcagucugcggacuguacccugcaacaaucaaagcacgcaacaugguauccccaguuaugucagucguggguuuccucgcccuagccaaagacuggacaucccgaaucgaagacuggcucggagcacccugcaaauucauggcagaaucacccaucgccggcagccuaucaggcaaccccguaaaucgcgacuauauacgacaaagacaaggcgcccuagcaggcauggaacccaaagaguuccaagcccuccgucagcacagcaaagacgccggaugcaccauggucgaacaaaucgaaagcccaagcuccaucuggguauucgcaggcgcccccgacagaugcccaccaaccugccucuucgucggcggcauggccgaacuaggcgccuucuucagcauccugcaagacaugcgcaacacaauaauggccuccaaaacggucggcacagccgacgaaaaacugcgcaagaaaagcuccuucuaccaaucauaccuacgacgaacgcaaucaaugggaauacaacucgaccaacgaaucaucgucauguucauggucgccuggggcaaagaagccguagacaacuuccaccuaggcgacgacauggaucccgaacuccgcucccucgcccaaauccucaucgaccaaaaagucaaagaaaucagcaaccaagaacccaugaaacuauaa

SEQ ID NO: 7962 - RNA, 1290 nt, Artificial Sequence
  derived and/or modified CDS sequence (opt11) from SEOV(Hb8610)__AF288643.1__N
auggcgaccauggaagaaauccaacgagaaauauccgcccacgaaggccaacucgucauagcccgacaaaaagucaaagacgccgaaaaacaauacgaaaaagaccccgacgaucucaacaaacgagcgcuccacgaccgcgagagcguagccgcaagcauccaaucaaaaaucgacgagcuaaagcgccaacuagccgacagaauagcagccgggaaauccaucggccaagaccgagaccccacgggcguagaacccggagaccaccuaaaagagcgaucagcccuguccuauggcaacacccuagaccucaacucccucgacauagacgagcccacaggccaaacggcagacuggcucacaaucaucgucuaccucaccagcuucguaguaccaauaauccuaaaagcucuauacaugcucaccacacgcggaagacaaacauccaaagauaacaaaggcaugagaauccgauucaaagacgacagcagcuacgaggacguaaacggcauacgcaaaccaaaacaccuauacgucagcaugccgaacgcacaauccagcaugaaagcagaagaaaucacgcccgggagauuccgaacagccguaugcggccucuaccccgcucaaaucaaagcacgcaacaugguaagccccgucaugagcgucgucggauuccuagcccuagccaaagacuggaccucacgcaucgaagaauggcuaggcgcccccugcaaauucauggccgaaucacccaucgccggcucacuaagcggcaaccccgucaaccgagacuacauccgccaacgccaaggagcccucgcaggaauggaaccaaaagaauuccaagcccuccgccagcacgccaaagacgccggcugcacccuaguagaacacauugaaagccccagcagcaucugggucuucgccggcgcccccgaccgaugcccaccaacaugccuguucgucggcggaauggcagaacucggcgcauucuuuuccauccuccaggacaugcgaaacaccaucauggcaagcaaaaccgucggcaccgcagacgaaaaacuccgcaaaaaaagcuccuucuaccaauccuaccugcgccgaacccagagcaugggcauccaacuggaccaacgaaucaucguaauguucauggucgccuggggcaaaaaagccgucgacaacuuccaccucggcgacgacauggaccccgaacuccgcucccucgcccaaauccuuaucgaccaaaaagucaaagaaaucuccaaccaagaacccaugaaacucuaa

SEQ ID NO: 7963 - RNA, 1290 nt, Artificial Sequence
  derived and/or modified CDS sequence (opt11) from SEOV(HuBJ16)__GQ279380.1__N
auggccacaauggaggaaauccaacgggagaucucagcccacgaaggacagcucgucaucgcccgacaaaaaguaaaaaacgcagaaaaacaauacgaaaaagacccagacgaccucaacaaacgagcccuacacgaccgcgaauccgucgcggcaucaauacaaagcaaaaucgacgaacuaaaacgccaacucgccgaccgcauagccgcaggcaaaaacauaggacaagaccgcgacccaaccggagucgaaccaggcgaccaccucaaagaacgauccgcccuaagcuacggcaacacacucgaccucaacagccuggacaucgacgagccaaccggacaaacugccgacuggcuaaccauaaucgucuaccuaaccuccuucgucgucccaaucauccucaaagcccucuacaugcuaaccacacgcggccgccaaaccucaaaagacaacaaaggcaugcgaauacgcuucaaagacgacagcuccuacgaagacgucaacggaauccgaaaaccaaaacaccucuacgucagcaugccaaacgcacaaagcuccaugaaagcagaagaaauaacccccggccgauuccgaaccgccgucugcggccucuaccccgcccaaaucaaagcccgcaacaugguaucccccgucaugucaguggucggcuuccucgcacucgcgaaagacuggacaagccgcaucgaggaauggcuaggggcccccugcaaauucauggccgaaucccccaucgccggcucccucagcggaacacccgucaaccgcgacuacauccgccaacggcaaggggcacuugccggcauggaacccaaagaauuccaagcccuacgacaacacgccaaagacgcaggcugcacccucgucgaacacaucgaaucccccuccucaaucugggucuucgcaggggcacccgaccgaugccccccaaccugccuauucguaggcggcauggccgaacucggcgccuucuucagcauacuccaagacaugcgcaacacaaucauggccagcaaaaccguaggaaccgccgacgaaaaacuacgaaaaaaaagcuccuucuaccaaagcuacuuacgcagaacacaauccaugggcauacaacucgaccaacguaucauaguaauguucauggucgccuggggaaaagaagccgucgacaacuuccaccucggggacgacauggaccccgaacucagaucacucgcacaaauccucaucgaccagaaaguaaaagaaaucagcaaccaagaaccaaugaaacucuaa

SEQ ID NO: 7964 - RNA, 1290 nt, Artificial Sequence
  derived and/or modified CDS sequence (opt11) from SEOV(HuBJ22)__GQ279379.1__N
auggccacuauggaggaaauacagcgcgaaaucagugcccacgagggacagcuaguaaucgcccgccaaaaagucaaagacgccgaaaaacaauacgaaaaagaccccgacgaccucaacaaacgcgcccuccacgaccgagaauccgucgcagccuccauccaaagcaagauagacgaacuaaagcgacaacuggccgacagaauagccgccggcaaaaacaucggccaagaccgcgaccccacaggcguagaacccggcgaccaccuaaaagagcgcagugcucucagcuacggcaacacccucgaccucaacagucuagacaucgacgaacccacaggccaaaccgcagacuggcuaaccauaaucguauaccuaaccucauucgucguccccaucauccucaaagcccuauacaugcucacaaccagaggcagacaaacaucaaaagacaacaaaggcaugcgcauacgguucaaagacgacuccagcuacgaagacgucaacggcauccgaaaacccaaacaccuauacgucucgaugccaaacgcccaaucaucaaugaaagcagaagaaaucacccccgggagauuccgcaccgcaguaugcggccucuaccccgcccaaaucaaagcacgcaacauggucucccccgucaugagcgucgucggcuuccuagcacucgcgaaagacuggaccucacgcauagaagaauggcugggagcccccugcaaauucauggccgaaucgcccauagccggaucccucuccggaacccccguaaaccgcgacuacauacgccaacgucaaggcgcccucgcaggcauggagcccaaagaguuccaagcccuacgacaacacgcaaaagacgccggcugcacccucguagaacacaucgaaucaccauccucaauaugggucuucgcuggugcaccagaccgcugcccacccacaugccuauucguaggcggcauggccgaacuaggagcauucuucagcauccuacaagacaugcgcaacaccauaauggcauccaaaaccguaggcacagccgacgaaaaacuccgaaagaaaagcuccuucuaccaaucauaccucagacgcacccaaagcaugggcauccaacuagaccaacgcaucauagucauguucauggucgccuggggcaaagaagccguagacaacuuccaccuuggagacgacauggaccccgaacuccgcucccuagcccaaauucuaaucgaccagaaaguaaaagaaauauccaaccaagaacccaugaaacuuuaa

SEQ ID NO: 7965 - RNA, 1290 nt, Artificial Sequence
  derived and/or modified CDS sequence (opt11) from SEOV(HuBJ3)__GQ279391.1__N
auggcaaccauggaagaaauccaacgcgaaauauccgcccacgaaggccaacucguaauagccagacaaaaagucaaagacgcagagaaacaauacgaaaaagacccagacgaccuaaacaaaagagcccuacacgaccgagaaagcgucgccgcaagcauacaaagcaaaaucgacgaacuaaaacgccaacucgccgaccguaucgccgccggcaagaacauaggacaagacagagaccccaccggcguagaaccgggagaccaccugaaagaacgcucagcacuaagcuacggcaacacccuagaccucaacucacuagacaucgacgaaccaaccggacaaacagccgacuggcuaaccauaaucguauaccucacaucauucgugguccccaucauccugaaagcccuguacaugcuuacgacaagaggacgccaaacaucgaagguaaacaaaggaaugcgcauccgcuucaaggacgacagcuccuacgaagacgugaacggcaucagaaaaccaaaacaccucuacguaucaaugccaaacgcccaaagcagcaugaaagcagaagagaucacccccggacgcuuccgaacagcaguaugcgggcuauacccagcccaaauaaaagcacgcaacauggucagcccagucaugagcguggucggauuccuagcacuagccaaagacuggaccucacgaaucgaggaauggcuaggcgcaccaugcagguucauggcagaaucuccaauagcaggcagccuaagcgggaacccagucaaccgagacuacauacgacaacgccaaggagcacucgccggcauggaacccaaagaguuccaagcccucaggcagcacgcaaaagacgccggaugcacgcuaguagaacacaucgaaagcccaagcagcauauggguauucgccggggcacccgaaggcugcccgccaaccugccucuucgucggcggaauggcagaacugggagcauucuucagcauacuccaagacaugagaaacaccaucauggcauccaaaaccguaggcacggcggacgaaaagcucagaaagaaaagcucauucuaccaaaguuaccuacgaagaacccaaucaaugggaauccaacuggaccaaagaauaauaguaauguucaugguagccuggggaaaagaagccgucgacaacuuccaccucggcgacgacauggaccccgaacuacgcagccucgcacagauacuaauagaccaaaaagucaaagaaauauccaaccaagagccaaugaaacuauga

SEQ ID NO: 7966 - RNA, 1290 nt, Artificial Sequence
  derived and/or modified CDS sequence (opt11) from SEOV(K24-e7)__AF288653.1__N
auggcaaccauggaggaaauacaacgcgagaucuccgcccacgaaggacaacucgucauagcccgacaaaaagucaaagacgccgaaaaacaauacgaaaaagaccccgacgauuucaacaaacgcgcccuacacgaccgcgaauccguagcagcaucgauccaauccaaaaucgacgaacucaaacgccaacucgccgaccgcauugccgcagguaaaaacaucgggcaagaccgcgacccaacaggcguggaaccaggcgaccaccucaaagaacgcuccgcacuauccuacgggaacacccuugaccucaacagccucgacauagacgaacccacaggccaaacagccgacuggcuaaccaucaucgucuaccuaacaucuuuugucguccccauaauccucaaagcccucuacaugcuaaccaccagaggccgccaaaccuccaaggacaacaaaggaaugcgaauccgauucaaagacgacagcuccuacgaagacgucaacggcauccgaaaaccuaaacaccucuacguauccaugccaaacgcccaaagcagcaugaaagccgaagaaauaacccccggccgcuuccguaccgcagucugcggacuuuaccccgcacaaaucaaagcccgcaacauggucuccccagucauguccgugguuggcuuccucgcccuugccaaggacuggaccucccgcauagaagaauggcuaggcgccccaugcaaauucauggccgaaucaccaauagccggcagccuaucaggcaaccccguaaaccgcgacuacauccgccaacgacaaggcgcacucgccggaauggaacccaaagaguuccaagcacuccgccaacacgccaaagacgccggcugcacccuugucgaacacaucgaaagcccauccagcaucugggucuucgcaggcgcccccgaccgaugcccuccaaccugccucuucgucggcggcauggcagaacucggcgccuucuucuccauacuccaagacaugcgcaacacaauaauggcaagcaaaaccgucggaaccgccgacgaaaaacugcgcaaaaagagcucauucuaccaauccuaccuccgacgcacacaauccaugggcauccaacuggaccaaaggauaaucgucauguucaugguagcauggggcaaagaagcagucgacaacuuccaccuaggcgacgacauggaccccgaacuccgcucccucgcacaaauacucaucgaccaaaaaguaaaagaaauaucaaaccaagaacccaugaaacucuaa

SEQ ID NO: 7967 - RNA, 1290 nt, Artificial Sequence
  derived and/or modified CDS sequence (opt11) from SEOV(K24-v2)__AF288655.1__N
auggcaaccauggaagaaauccaaagagaaaucuccgcccacgagggacagcucguaauagcccgacaaaagguaaaagacgcagaaaaacaauacgaaaaagaccccgacgacuucaacaagcgcgcccuacacgaccgggaaagcguagcagcaagcauacagagcaaaauugacgagcucaaacgccaacucgccgaccguaucgccgcaggcaaaaacauaggacaagaccgcgaccccaccggagucgaaccaggcgaccaccucaaagagcgcucagcccuaucauacggcaacacacuagaccugaacucccuagacauagacgaaccaaccggacaaaccgccgacuggcuaaccaucauagucuaccucaccagcuucguagucccaauaauacuaaaagcccuauacaugcucaccacaagaggccgccaaaccagcaaagacaacaaagggaugcgcaucagauucaaagacgacucuuccuacgaagacguaaacggaauccgcaaaccgaaacaccucuacgucuccaugcccaacgcccaaucaagcaugaaagccgaagaaauaacgcccggccgcuucagaaccgccgucugcggccucuaccccgcccagaucaaggccagaaacauggucuccccaguaaugucaguggucggcuuccuagcccuagcaaaagacuggaccucccgcauagaagaauggcuaggcgcacccugcaaauucauggcagaaucccccaucgcuggcagccuguccgggaaccccguaaaccgagacuacauccgacaaagacaaggagcccucgccggcauggagccaaaagaguuccaggcacuccgacaacacgccaaagacgccggaugcacacucguagaacacauagaaagccccuccucaaucuggguauucgccggagcacccgaccgaugcccaccaaccugccuauucgucggcggaauggcagagcucggcgcauucuucucaauccuccaagacaugcgcaacacaaucauggcaucaaagaccguaggaacagccgacgaaaagcuccgcaagaaaagcagcuucuaccaauccuaccugcgacacacccaauccaugggaauacaacucgaccaacguaucaucgucauguucaugguagccuggggcaaagaagcagucgacaacuuccaccucggcgacgacauggaccccgaacuacgcucccucgcccaaauccuaaucgaccaaaaagucaaagaaaucucaaaccaagaacccaugaaacucuaa

SEQ ID NO: 7968 - RNA, 1290 nt, Artificial Sequence
  derived and/or modified CDS sequence (opt11) from SEOV(OuhaiRf35)__FJ803208.1__N
auggccacaauggaagaaauccaacgagaaaucagcgcccacgaaggacagcuagucaucgcaagacaaaaagucaaagacgcggaaaaacaauacgaaaaagaccccgacgaccuaaacaaacgcgcgcuccacgaccgcgaaagcgucgccgccagcauacaauccaaaauagacgaacucaaacgccagcucgccgaccgcaucgccgccgguaaaaacaucggucaagaccgcgaccccacaggagucgaaccaggcgaccaccuaaaagaacgaucagcacuaagcuacggcaacacacuggaccuaaacucccucgacaucgacgaacccaccggccaaaccgccgacuggcuuaccaucaucgucuaccucaccucauucguaguccccaucauccucaaagcacucuacaugcuaaccacacgaggccggcaaaccucaaaagacaacaaaggcaugcggauaagauucaaagacgacuccucauaugaagacgucaacggaauccgcaaacccaaacaccucuacgucagcaugcccaacgcucaauccagcaugaaagccgaagaaaucacaccaggccgcuucagaaccgccgucugcgggcucuaccccgcccaaaucaaagcgcgaaacauggucuccccgguaauguccguaguaggcuuccucgcccuagccaaagacuggaccagccgaauagaagaguggcuaggagcaccaugcaaauucauggcagaaucucccaucgccggcagccucucugguaacccuguaaaccgcgacuacauccgccaacgccaaggagcccucgcaggcauggaacccaaagaguuccaagcccuccgacaacacgccaaagacgccggaugcacgcucgucgaacacaucgaaagccccagcuccaucugggucuuugcaggggcccgcgaccgaugcccaccaaccugccuauucgucggcggaauggcagaacuaggcgcauucuucagcauccuccaagacaugagaaacaccaucauggccagcaaaaccgucggcacagccgacgaaaaacuccgaaagaaaagcucauucuaccaauccuaccuacgccgcacccaauccaugggcauccaacuagaccaacgaaucaucguaauguucauggucgccuggggcaaagaagccgucgacaacuuccaccuuggcgacgacauggaccccgaacuacgcucccuagcccaaauacuaaucgaccaaaaaguaaaagaaaucagcaaccaagaacccaugaaacucuaa

SEQ ID NO: 7969 - RNA, 1290 nt, Artificial Sequence
  derived and/or modified CDS sequence (opt11) from SEOV(OuhaiRn146)__FJ803210.1__N
auggccaccauggaagaaauccaacgcgaaaucucagcacacgaaggccaacugguaaucgcccgccaaaaaguaaaagacgccgaaaaacaauaugaaaaagacccagacgaccucaacaaacgugcccuccacgacagagaaagcgucgccgccucgauccaauccaaaaucgacgaacuaaaacgccaacuagcagaccgcaucgccgccggcaaaaacaucggccaagaccgagaccccaccggaguagagcccggcgaccaccucaaagaacgcuccgcccucuccuacgggaacacacuagaccuaaacagccucgacaucgacgaacccaccggccaaacagccgacuggcucaccaucaucgucuaccugaccagcuucguaguccccaucauccuaaaagcccuauacaugcucacaacccgcggaagacagacaucuaaagacaacaaaggaaugcgcauacgauucaaagaugacuccucauacgaagacguaaacggcauccgcaaaccaaaacaccuauacgucucaaugcccaaugcacaaucaagcaugaaagccgaagaaauaacccccggcagauucagaaccgcagucugcggccucuaccccgcccaaaucaaagcccgcaacauggucuccccaguaauguccgucguuggcuuccuagcccucgcaaaagacuggaccagcaggaucgaagaauggcucggagcccccugcaaauucauggccgaaucacccaucgccggcucccuaagcgguaaccccguaaacagagacuacauccgacaaggccaaggcgcccucgcaggaauggaacccaaagaguuccaagcccuccgccaacacgccaaggacgccggcugcacccucgucgaacacaucgaaucccccagcagcaucugggucuucgccggagcucgagaccgcugcccacccacaugccuauucgugggaggcauggccgaacuaggcgccuucuucuccauccuccaggacaugcguaacaccaucauggccuccaagaccguaggcaccgccgacgaaaaacuccgcaagaaauccuccuucuaccaaagcuaccuccgacgcacacaaagcaugggaauccaacuagaccagcgcaucauagugauguucaugguugcauggggaaaagaagccgucgacaacuuccaccucggagaugacauggaccccgaacuacgcagccuagcacaaauacucauugaccaaaaagucaaagaaaucuccaaccaagaacccaugaaacucuga

SEQ ID NO: 7970 - RNA, 1290 nt, Artificial Sequence
  derived and/or modified CDS sequence (opt11) from SEOV(Pf26)__AY006465.1__N
auggccacaauggaagaaauacaacgcgaaaucucugcccacgaaggccagcuagucauagcccgccaaaaagucaaagacgccgaaaaacaauacgaaaaagaccccgacgaccucaacaaacgcgcccuacacgacagagaaucaguugccgccucaguccaauccaaaauagacgaacucaaacgccaacucgcugacagaaucgcagcaggcaaaaacauaggacaggaccgcgaccccaccggaguagaacccggagaccaccuaaaagaacgcagcgcccucuccuacggaaacacccucgaccuaaacucccuagacauagacgaacccacaggucaaaccgccgacuggcucaccauuaucguuuaccucaccagcuucguagucccaaucauuuuaaaagcccucuacaugcucaccacccgcggccggcagacaagcaaagacaacaaaggcaugcgcauacgcuucaaagacgacuccuccuacgaagacguaaacggaauaagaaagcccaaacaccuauacguaucaaugcccaacgcacaaucaucaaugaaagccgaagaaaucacccccggccgauuccgcaccgcagucugcggccucuaccccgcccaaaucaaaccucgaaacauggucucacccgucaucagcgucgucggcuuccucgcccucgccaaagacuggacaucccgaauagaggaauggcucggcgcccccuguaaauucauggccgaauccccaaucgcuggcagccucuccggcaaccccgucaaccgcgacuacauacgacagcgacaaggcgcccuagccggcauggaacccaaagaguuccaagcccuacgacaacacgcuaaagacgcaggcuguacccucgucgaacacaucgaaucccccuccuccaucugggucuucgccggcgcccccgaucggugcccacccacaugccucuucguuggcggcauggccgaacuaggagccuucuucuccauccuccaggacaugcgcaacacuaucauggccuccaaaaccgucggcaccgcagacgaaaaacuacgcaaaaagucauccuucuaccaaagcuaccuucgccgcacccaauccaugggcauccaacucgaccaaagaauaaucguaauguucaugguagcauggggcaaagaagcagucgacaacuuccaccucggcgacgacauggaccccgaacuacgcucacuagcccaaauucucaucgaccaaaaagucaaagaaaucucaaaccaggaacccaugaaacuauaa

SEQ ID NO: 7971 - RNA, 1290 nt, Artificial Sequence
  derived and/or modified CDS sequence (opt11) from SEOV(Rn-CP7)__GQ279382.1__N
auggcaaccauggaagaaauacaacgugagaucagcgcccacgaaggccagcuaguaaucgccagacaaaaagucaaagacgccgaaaagcaauacgaaaaggaccccgacgaccucaacaaacgcgcacuccacgacagagagagcgucgccgcaagcauccaauccaaaauagacgaacucaaacgccaacuagcagacagaaucgccgccggcaaaaacaucggccaagaccgcgacccaaccggcgucgaacccggagaccaccuaaaagaacgcucggcccucagcuacggcaacacccuagaccuaaacucacucgacaucgacgaaccaaccggccaaacagccgacuggcucacaauaaucgucuaccugacaucauucgucguaccaaucauacucaaagcacuauacaugcucacaacacgaggacgacaaaccagcaaagacaacaaaggaaugcgcauccgguucaaagacgacagcucauacgaagacgucaacggaauccgcaaaccaaaacaccucuacgucuccaugccaaacgcacaaucgucaaugaaagccgaagaaaucacccccggccgcuuccgcacggccguaugcgggcuauaccccgcccaaauuaaagcccgcuccaugguaagcccagucaugagcguagucggauuccucgcccuggccaaagacuggaccucacgcaucgaagaauggcuaggagcacccugcaaauucauggccgaaucccccaucgcaggcagccucagcggaaaccccgucaaccgcgacuacauacgccagagacaaggagcccuagcaggcauggaaccaaaagaguuccaagcccugcgccaacacgcgaaagacgccggaugcacacucgucgaacauaucgaaucaccaagcuccaucugggucuucgcuggcgcccccgaccgaugcccacccacaugccuauucguaggcggcauggccgaacucggcgccuucuucuccauccuacaagacaugcgcaacacaauaauggccucaaaaaccgucggcacagcagacgaaaaacuccgcaaaaagagcucguucuaccaaucauaccuccgacgcacccaaaguauggguauccaacuagaccaaagaauaaucguaauguucaugguagcauggggaaaagaagcaguagacaacuuucaccuaggcgaugacauggaccccgaacuaagaucacucgcccaaauacuaauagaccaaaaagucaaagaaauauccaaccaagaacccaugaaacuauaa

SEQ ID NO: 7972 - RNA, 1290 nt, Artificial Sequence
  derived and/or modified CDS sequence (opt11) from SEOV(Rn-DC8)__GQ279386.1__N
auggccaccauggaagaaauacaacgcgaaauaucagcccacgaaggccaacucgucaucgcccgccagaaaguaaaagacgccgaaaaacaauacgaaaaagaccccgacgaccucaacaaacgcgcgcuccacgaccgcgaauccguagccgccagcauccagagcaaaaucgacgaacucaaacgccaacucgcggacagaaucgccgccggcaaaaacauagggcaagacagagaccccaccggcguagaacccggcgaucaccucaaagaacgaagcgcccucucauacggcaacacccuagaccuaaacagccuagacauagacgaaccaacaggccaaaccgcagacuggcuaaccaucaucgucuaccucaccucauucgucguccccaucauacuaaaagcccuguacaugcucaccgcccgcggacgccaaaccuccaaagacaacaaaggaaugagaauacgcuucaaggacgacucaucguacgaagacgucaacggcauccgcaaaccaaaacaccucuacgucagcaugccaaacgcccaauccuccaugaaagcagaagaaaucacacccggcagauuccgcaccgcagucugcggccucuaccccgcccaaauaaaagcccgcagcaugguaucaccggucauguccgucgucggcuuccucgcacucgccaaagacuggaccagccgaauagaggaauggcucggcgccccaugcaaguucauggccgaaagcccuaucgcaggcagccucucaggaaacccagucaaccgcgacuacauccgacaaaggcaaggcgcccucgccggaauggaaccaaaagaguuccaagcccuccgccaacacgccaaagacgccggcugcacccuagucgaacacaucgaaagccccagcuccaucugggucuucgcaggagcgccagaccgaugcccaccaaccugccuauucgucgggggcauggccgaacuaggagccuucuucucaauccuccaagacaugcgcaacaccaucauggccagcaaaaccgucggaaccgccgacgaaaaacuacgaaagaaauccuccuucuaccaauccuaccuccgccgcacacaaucgauggggauccaacucgaccaacgaauaaucgucauguucauggucgcauggggaaaagaagcaguagacaacuuccaccucggcgacgacauggaccccgaacuacgcagccucgcacaaauccucauagaccaaaaagucaaagaaaucucaaaccaagaaccgaugaaacucuaa

SEQ ID NO: 7973 - RNA, 1290 nt, Artificial Sequence
  derived and/or modified CDS sequence (opt11) from SEOV(Rn-M11)__GQ279383.1__N
auggcgaccauggaagaaauccaacgcgagaucucagcccacgaaggucaacucgucaucgcaagacaaaaagucaaaaacgccgagaaacaauacgaaaaagaccccgacgaccucaacaaacgagcacuacacgaccgagaaucagucgccgcauccauccaauccaaaauagaugaacucaagcgccaacucgcagaccgcaucgccgccggcaaaaacaucggacaagaccgcgaccccaccggaguagaacccggcgaccaccucaaagaacgcuccgcccuaucuuacggcaacacccuggaccuaaacucauuagacaucgacgagcccacuggccaaaccgccgacuggcucaccaucaucguauaccucacaucauucgucgucccaaucauacucaaagcccuuuacaugcucacaacccgaggccgccaaaccagcaaagacaacaaaggcaugcgaauccgauucaaagacgacagcucauacgaggacgucaacggcauccgcaagcccaaacaccucuacguaucuaugcccaacgcccaauccuccaugaaagccgaagaaaucacccccggccgauuccgcaccgccgucugcgggcuauacccagcccaaaucaaagcccgaucuauggucagccccguuaugagcguagucggcuuccucgcccuagccaaagacuggaccucccguauagaagaauggcucggcgccccaugcaaauucauggccgaaucccccaucgccggaucccucuccggaaacccugucaaccgcgacuacauacgccaacgccgcggugcccuagccggcauggaacccaaagaauuucaagcacuccgccagcaugcaaaagacgcgggcugcacccucguagaacacaucgaaucacccagcuccaucugggucuucgccggcgcccccgacagaugcccaccaaccugccucuucgucggcggcauggccgaacuaggagccuucuucuccauccuccaggauaugcgcaacaccauaauggccagcaaaaccgucggcaccgccgacgagaaacucaggaagaaaagcucauucuaccaauccuaccuccgacggacccagucaaugggaauccaacucgaccaaagaaucauagucauguucaugguagcauggggcaaagaagcaguagacaacuuccaccucggcgacgacauggaccccgaacucagaucccucgcccaaauacucaucgaccaaaaagucaaagaaauaucaaaccaagaacccaugaaacucuaa

SEQ ID NO: 7974 - RNA, 1290 nt, Artificial Sequence
  derived and/or modified CDS sequence (opt11) from SEOV(RuianRf74)__FJ803213.1__N
auggccacuauggaagaaauccagcgggaaaucucagcccacgaaggccagcuagucaucgcccgccaaaaaguaaaagacgcagaaaaacaauacgaaaaagacccagaugaccucaacaaacgugcccuacacgaucgcgaauccgucgccgccucaauccaaucaaaaaucgacgaacucaaacgucaacuggcagaccguauagccgccggcaaaaacaucggacaagaccgcgacccaaccggagucgaaccaggcgaccaccuuaaagaacgauccgcccuaucauacggcaacacacucgaccuaaacagcuuagacaucgacgaacccacaggccaaaccgccgacuggcucaccaucaucguauaccucacauccuucgucguacccauaauacuuaaagcccuauacaugcuaacuacacgaggccgccaaaccuccaaagacaacaaaggaaugcgaauccgcuucaaagacgacucauccuacgaagacguaaacggaauacgcaaacccaaacaccuauacguauccaugcccaacgcccaauccuccaugaaagccgaagaaauaacccccggccgguucagaauggcagucugcggccucuaccccgcacaaaucaaagcacgcaacauggucucccccgucauguccgucgucggcuuccucgcccuugccaaagacuggaccucccgcaucgaagaauggcuuggagccccgugcaaauucauggcggaaucccccaucgcaggaucacucuccggcaaccccgucaaccgcgacuacauccgccaacgacaaggcgcacuagccggcauggaaccaaaagaguuccaagcccugcgucaacacgccaaagacgcaggcugcacccuggucgaacacaucgaaucccccuccucaaucugggucuucgccggagcccccgaccgcugcccaccaaccugccucuucguuggcggcauggcagaacucggcgcauucuucuccauccuccaagacaugcgaaacacaaucauggccuccaaaacagucggcaccgccgacgaaaaacuacgaaagaaaucaucuuucuaccagucauaccuccgccgcacccaaagcaugggcauccaacucgaccaacgcauaaucgucauguucauggucgccuggggcaaagaagccgucgacaacuuccaccuaggagacgacaucgaccccgaacuccgcucccucgcccaaauccucauagaccaaaaagucaaagaaaucuccaaccaagaacccaugaaacucuaa

SEQ ID NO: 7975 - RNA, 1290 nt, Artificial Sequence
  derived and/or modified CDS sequence (opt11) from SEOV(RuianRn23)__FJ803214.1__N
auggccacuauggaagaaauccaacgcgaaauaucagcacacgaaggccagcuaguaaucgcacgccaaaaagucaaagacgccgaaaaacaauacgaaaaagacccagacgaccuuaacaaaagagcccuccacgaccgcgagagcgucgcugccuccauccaauccaaaaucgacgaacucaaacgccaacucgcugaccgcaucgccgccggcaaaaacauuggacaagaccgcgaccccacaggugucgaacccggcgaccaccuaaaagaacgcucagcacuauccuacggcaacacccucgaccucaacucacucgacaucgacgaaccgacaggccaaaccgcagacuggcuaaccaucaucgucuaccuaacauccuucgucgugccaaucauacucaaagcccucuacaugcugaccaccagaggccgacaaacauccaaagacaacaaaggcaugcgaauccgauucaaagacgacuccagcuacgaagacgucaacggcauucgaaaaccaaaacaccucuacguauccaugccaaacgcgcaaagcuccaugaaagccgaagaaaucacccccggacgcuucagaacagcaguaugcggacucuaccccgcccaaaucaaagcccgcaacauggucagccccgucauguccgucgucggauuccuugcacucgcaaaagacuggaccucacgcauagaagaauggcuaggcgcccccugcaaauucauggccgaaucccccaucgcuggcucccuaucagggaaccccguaaaccgagacuacauacgacaacgccaaggagcccuagccggcauggaacccaaagaguuccaggcccuccgacaacacgccaaagacgccggcugcacgcuagucgaacacauagaaucacccuccagcaucugggucuucgccggcgcccccgacaggugcccaccaacaugccucuucgucggcggcauggccgaacucggggccuucuucuccauccuccaagacaugcgcaacaccauaaaagcaagcaaaacagucggcacagcagacgaaaaacuaagaaagaaauccucauucuaccaguccuaccugagacgaacccaauccaugggcauccaacuagaccaacgcaucaucgucauguuuauggucgcauggggaaaagaagcaguugacaacuuccaccuaggcgacgacauggaccccgaacuccgcucacuagcccaaauccucaucgaccaaaaagucaaagaaaucucaaaucaagaacccaugaaacucuaa

SEQ ID NO: 7976 - RNA, 1290 nt, Artificial Sequence
  derived and/or modified CDS sequence (opt11) from SEOV(RuianRn33)__FJ803215.1__N
auggcgaccauggaagaaauccaacgcgaaauauccgcacacgaaggacagcuaguaaucgccagacaaaaagucaaagacgcagaaaaacaauacgaaaaagacccagacgaccucaacaaacgagcccuccacgaccgagaaagcgucgcagcauccauacaaagcaaaaucgacgaacuaaaacgccaauuagcagaccgcaucgcagcuggcaaaaauaucggccaagaccgagacccaacgggagucgaacccggcgaccaccuaaaagaacgauccgcccuauccuacggaaacacccucgaccucaacagccuagacaucgacgaaccaaccggacaaaccgccgacuggcuaaccaucaucguguaccucaccuccuucgucguacccauaauccuaaaagcccucuacaugcucaccacccggggccggcagaccucaaaagacaacaaaggaaugcgcauccgauucaaagacgacuccuccuacgaagacgucaacgggauccgaaaacccaaacaccuauacguaagcaugcccaacgcccaaagcucaaugaaagccgaagaaauaacacccggccgcuuccgcaccgccgucugcggacuauaccccgcccaaaucaaagcacggaacauggucucccccguaauguccguagucggauuccucgcccucgcaaaagacuggaccucccgaaucgaagaauggcucggcgcacccugcaaauucauggccgaaucccccauagccggaucccucucaggaaacccagucaaccgcgacuacauccggcaacgccaaggagcccuggccggcauggaacccaaagaguuccaagcccuacgccaacacgccaaagacgccggcugcacccuagucgaacacauagaauccccauccucaauaugggucuucgccggcgcccccgaccgaugcccaccaaccugccuauucguuggaggcauggccgaacuaggagccuucuucagcauccuccaagacaugcgaaacacaauuauggcauccaagaccgucggaacagccgacgaaaagcugcgcaagaaauccagcuucuaccaaucauaccuccgccgcacacaauccauggggauccaacucgaccaaagaaucauaguaauguucauggucgcccgcggcaaagaagcuauguacaaccuacaccuccgagacgacaugaccccacaacuccuccuccuaguacaaauacuacucgaccaccaagucaaagaaaucuccaaccaagaacuaaugaaacuauag

SEQ ID NO: 7977 - RNA, 1290 nt, Artificial Sequence
  derived and/or modified CDS sequence (opt11) from SEOV(SC106)__GU361893.1__N
auggccacaauggaagaaauccaacgagaaaucagcgcccacgaaggccaacuugucaucgcccgccaaaaagucaaagacgccgaaaaacaauacgaaaaagacccagacgaccuuaacaaacgcgcccuccacgaccgcgaauccgucgccgcaagcauccaauccaaaauagacgaacucaaacgccaacuagccgacagaaucgcagccggcaaaaacaucggacaagaccgugaccccaccggagucgaaccuggggaccaccucaaagaacgcucagcccuaagcuacggcaacacucucgaccucaacucccuagacaucgacgagcccaccggccaaacagccgauuggcuaaccaucaucguuuaccuaaccagcuucgucgucccaaucauccucaaagcccuguacaugcuaacaacccgcggacgacaaaccuccaaagacaacaaaggcaugcgcauccgcuucaaagacgacuccuccuacgaagacgucaacggcaucagaaaacccaaacaccucuacguccccaugccaaacgcccaauccuccaugaaagccgaagaaaucacccccggccgcuuccgcaccgccgucugcggccuauacccagcccaaaucaaagcacgaaacauggucagccccguaauguccguagucggauuccuagcccucgcuaaagacuggaccagccgaaucgaggaauggcuaggagcacccugcaaauucauggcagaaucgccaaucgccggcucccucuccggcaaccccgucaaccgagacuacauacgacaaagacaaggcgcccucgcaggcauggaaccgaaagaguuccaagcucuccgccaacacgcuaaagacgccggcugcacccuaguugaacacauagaaagcccauccuccaucugggucuucgccggagccccugaccgcugucccccuaccugccucuucguaggcggcauggcagaacuaggagccuucuucucaauccuccaggacaugcgcaacaccauaauggcaagcaaaaccguaggaaccgcagacgaaaaacugcgaaagaaauccuccuucuaccaauccuaccuccgacgcacccaauccaugggcauacaacucgaccaacgcaucaucgucauguucaugguagccuggggcaaagaagcaguagacaacuuccaccucggcgacgacauggacccagaacuacgaagccucgcccaaauacucaucgaccaaaaagucaaagaaauaucaaaccaagaacccaugaaacucuaa

SEQ ID NO: 7978 - RNA, 1290 nt, Artificial Sequence
  derived and/or modified CDS sequence (opt11) from SEOV(SEO/Belgium/Rn895/2005)__JQ898106.1__N
auggccacaauggaagaaauccaacgcgaaaucuccgcccacgaaggacagcuagucaucgcaagacaaaaagucaaagacgccgaaaaacaauacgaaaaagaccccgacgaccuaaacaaacgggcccuccacgaccgcgaaagcgucgcugcaucaauacaauccaaaauagacgaacuaaagcgccaacucgcagacagaaucgccgccggcaaaaacaucggccaagaccgcgaccccacaggcguagaacccggcgaccaccucaaagaacgaucagcccuguccuacggcaacacccucgaccuaaacucccucgacaucgacgagccgaccggccaaaccgccgacuggcuaaccauaaucgucuaccuaacauccuucgucgucccaaucauacuuaaagcacucuacaugcuaacgacccgcggacgccaaaccuccaaagacaacaaaggcaugcgaaucagguucaaagacgacagcagcuacgaagacgucaacggcaucagaaaacccaaacaccucuacguauccaugcccaacgcacaaucaagcaugaaggccgaagaaaucacccccggccgcuuccgcacggcaguaugcggccuauaccccgcacaaaucaaagcgcgcaacaugguaagcccagucaugagcgucgucggauuccucgcccuagccaaagacuggaccagccgcaucgaagaguggcuaggagcgcccugcaaauucauggcagacucacccaucgcaggcagccucucuggaaaccccgucaaccgagacuacauccgccaacgccagggcgcccucgcaggcauggaacccaaagaguuccaagcccuccgccaacacucaaaagacgcaggaugcacccuaguagaacacaucgaaucaccauccucaaucuggguauucgccggagccccagacaggugcccaccaaccugccuauucgucggcggcauggccgaacucggcgccuucuucuccauacuccaagacaugcgaaacacaaucauggccagcaaaaccgucggcacggcagacgaaaaacuacgaaagaaauccucauucuaccaauccuaccuccgccgcacccaaagcaugggaauccaacuagaccaacgaauaauagucauguucauggucgcauggggaaaagaagcagucgacaacuuccaccucggagacgacauggaccccgaacuccgaucccucgcacaaauccucauagaccaaaaggucaaagaaauaucaaaccaagaacccaugaaacucuag

SEQ ID NO: 7979 - RNA, 1290 nt, Artificial Sequence
  derived and/or modified CDS sequence (opt11) from SEOV(Taonan420)__KF745951.1__N
auggcaaccauggaagaaauccaacgagaaauauccgcccacgaaggccagcuagucaucgcccgccaaaacgucaaagacgccgaaaaacaauacgaaaaagacccagacgaccucaauaaaagagcgcuccacgaccgcgaguccguagccgcaucaauacaaaguaaaaucgacgaacuuaaaagacaaccagccgaccgcaucgccgcaggcaaaaacaucggucaagaccgagaccccaccggcgucgaacccggcgaccaccuaaaagaaagauccgcccuauccuacggcaacacccuugaccuaaaccgccuagacaucgacgaaccaacaggccaaagagcagacuggcucaccauaauagucuaucuaacauccuucgucguccgaaucauccugaaagcccuauacauguucagcacacgcggccgccaaaccuccaaagacaacaaaggccuccgaauccgauucaaagacgacucauccuacgaagacuucaacggaauccgcaaacccaaacaccuauacguacccaugcccaacgcccagagcagcaugaaagcagaagaaaucacacccggccgcuucagaaccgcagucugcggucucuacccagcccaaaucaaagcccgcaacaugguaucccccgugaugagcguagucggcuuccucgcccucgccaaggacuggaccucccgcaucgaagaauggcuaggcgcccccugcaaguucauggccgaaucccccaucgcaggcucccuaucaggcaacccugucaaccgagacuacauacgacaacgccaaggcgcccuagccgcaauggaaccaaaagaguuccaagcccuccgccaacacgccaaagaccccggcugcacucuagucgaacacauagaaagucccuccagcaucugggucuccgccggcgcaccagacagaugcccaccaacaugccucuucgucggaggcauggccgaacucggagccuucuucagcauauuccaagacaugagaaacacaauaaugccauccaaaaccgucggcaccgcagacgaaaaacuccgcaagaaaucccucuucuaccaaucauaccuccgccgcacacagucaaugggaauacaacucgaccaacguauaaucgucauguucaugguagccugggggaaagaggccguggacaacuuccaccuacccgacgacauggaccccgagcuacgaagccuagcccagauccucauaguccagaaagucaaagaaauaucaaaccaagaaccaaugaaacucuag

SEQ ID NO: 7980 - RNA, 1290 nt, Artificial Sequence
  derived and/or modified CDS sequence (opt11) from SEOV(Taonan52)__KF745950.1__N
auggcaacaauggaagaaauacaacgagaaauaucggcccacgaaggacaacucgucaccgcaagacaaaaagucaaagacgcagaaaaacaauaugaaaaagacccagacgaccucaacaagagagcacuacacgaccgcgaguccguagccgcaagcauacaauccaaaauagaugaagucaagcgacagcucgcagacaggaucgcagccggcaaaaacaucggacaagaccgcgacccaacaggcgucgaaccaggagaccacccaaaagaacgcucagcccuauccuacggcaacacacuagaccucaacucccucgacaucgacgaacccaccggccaaacagcagacuggcuaacaauaaucguauaccugacaucguucgucguaccgaucauacucaaagcccuauacauguccacuacccggggcagacaaaccagcaaggacaaccgaggaaugagaauacgauuccaagaugacagcucauacgaagacgucaacggaauccgaaaacccaagcaccucuacguccccaugccgaacgcacaaucaagcaugaaagcggaagaggucacccccggccgauuccgcacggccguaugcggacucuaccccgcacaaauaaaagcacgcaacaugguacggccagucaugagcguaguaggauuccuagcccucgccaaagccuggaccagccgcauagaagaauggcuaggcgcccccugcaaauucauggcggaaucccccauagcaggaagccuaagcggcaacccagucuaccgcgacuacauacgccaacgccaaggcgcacucgccggcauggaaccgaaagaguuccaagcacuaagacaacacgccaaagacgccggcugcacccuaguagaacucaucgaaagcccguccucaauuucaguauucgccggagcccccgaccgaugcccgcgcacaugccuguucgugggaggaauggccgaacuaggcgccaacuucagcaugcuccaagacaugucaaacacaauaauggccagcaagaccguggguacagccgacgaaaaacuacgaaagaaaagcagcuucuaccaaucauaccuccgcagaacccaguccaugggcauccaacuagaccaacgaaucaucguaauguucauggucgccucaggaaaagaagcaguagacuacuuccaccuaggcgaugacauggaccccgaacuacgcagccucgcaccaauccucaucgaccagaaaguaaaagaaaucuccaaccaagaaccaaugaaacucuag

SEQ ID NO: 7981 - RNA, 1290 nt, Artificial Sequence
  derived and/or modified CDS sequence (opt11) from SEOV(WuhanMm24)__JQ665911.1__N
auggcgaccauggaagaaauccagagagaaaucucagcccacgaaggacagcuagucaucgcccgccaaaaagucaaagacgccgaaaaacaauacgaaaaggacccagacgaccuaaacaaacgcgcccuacacgaucgagagagcgcggcagccuccauacaauccaaaauagacgaacucaaacgccaacucgcagaccgcauagccgcaggcaaaaacauaggccaggaccgcgacccaaccggcgucgaaccaggcgaccaccucaaagaacgcucagcccucagcuacggcaacacccucgaccucaacagccuagacauagacgaacccaccggccaaaccgcagacuggcucaccaucaucgucuaccuaacgagcuucgucguacccauaauccugaaagcccuauacauguuaacaacucgcggacgccaaaccagcaaagacaauaaaggcaugcgaauacgcuucaaagacgacagcucauacgaagacgucaacggaauccggaaaccuaaacaccucuacgucuccaugccgaacgcccaguccuccaugaaagcagaagaaaucacccccgggcgauuccgcaccgccgucugcggacucuaccccgcccaaauaaaagcacgaaacauggucagcccaguaaugucaguggucggcuuccuggcacuggccaaagacuggaccagccgcaucgaagaauggcuuggcgcacccugcaaauucauggcagaaucacccaucgcaggcucccucuccggaaaccccgucaaccgagacuacauacgccaacgccaaggcgcacucgccggcauggaaccaaaagaauuucaagcacuacgacaacacuccaaagacgccggaugcacccucguagaacacaucgaaagcccauccagcaucuggguuuucgccggagccccagaccgcugcccaccaaccugccucuucguaggcggaauggccggccucggggccuucuucagcauccuacaagacaugcgcaacaccaucauggcaucaaaaaccgucgguacagccgacgaaaaacucaggaagaaauccucauucuaucaauccuaccuccgacgcacacagucaaugggcauccaacuagaccaacgcaucaucgucauguucauggucgcuuggggcaaagaagccguagacaacuuucaccucggcgacgacauggaccccgaacuacgcucacucgcccaaauccuaauagaccaaaaaguaaaagaaauaucaaaccaagaaccaaugaaacucuaa

SEQ ID NO: 7982 - RNA, 1290 nt, Artificial Sequence
  derived and/or modified CDS sequence (opt11) from SEOV(WuhanRf02)__JQ665912.1__N
auggcaaccauggaagaaauacaacgagaaaucuccgcccacgaaggccagcuagucaucgcccgccaaaaaguaaaagacgccgaaaaacaauacgaaaaagaccccgacgaccucaacaaacgcgcacuacacgaccgcgaauccgucgccgccagcauccaaucaaaaauagacgaacucaaacgacaacuagccgaccgaaucgcagccggcaaaaacaucggccaagaccgugaccccacaggaguagaacccggcgaccaccucgaagaacguucagcccucuccuacggcaacacacucgaccucaacucccuagacaucgacgaacccaccggacaaaccgcagacuggcuaaccaucaucgucuaccuuaccuccuucguagucccaaucauacucaaagcccuauacaugcuaaccacacggggccgccaaacaagcaaagacaacaaaggaaugcgcaucagguucaaagacgacagcuccuacgaagacgucaacggaauaaggaaacccaaacaccuauacgucucaaugccaaacgcacaaagcagcaugaaagcggaagaaaucacccccggccgcuuccgcacagcagucugcggacucuaccccgcacagaucaaagcacgcgacauggucucacccguaaugagcgucguaggauuccucgcccucgccaaagacuggaccucccgcaucgaggaauggcuaggagcaccaugcaaauucauggccgaaucccccaucgccggcucccuauccggcaaccccgucaaccgcgacuacaucagacaacgacaaggagcacucgcaggaauggaaccaaaagaguuccaagcacuacgacaacacucaaaagacgcaggaugcacccuagucgaacacauagaaucccccuccagcaucugggucuucgccggugcccgagaccgaugcccacccacgugccucuucgucggaggcauggccgaacucggcgcauucuucagcauacuucaagacaugcgaaacacaaucauggcaucaaaaacggucggcacggccgacgaaaaacucagaaagaaauccagcuucuaccaaucauaccuccgccgaacccaguccaugggaauccaacucgaucaacgcaucaucgucauguucauggucgccugggguaaagaagccgucgauaacuuccaccuaggcgacgacauggaccccgaacuacgcagcuuagcgcaaauccucauagaccagaaagucaaagaaaucucaaaccaagaacccaugaaacuauaa

SEQ ID NO: 7983 - RNA, 1290 nt, Artificial Sequence
  derived and/or modified CDS sequence (opt11) from SEOV(WuhanRf07)__JQ665913.1__N
auggccaccauggaagaaauccaacgcgaaaucuccgcacacgaaggacaacucgucaucgcacgacaaaaaguaaaagacgccgaaaaacaauacgaaaaagaccccgacgaccucaacaaacgcgcccuccacgacagagaaagcgucgccgcaagcauccaaagcaaaauagacgaacucaaaagacagcucgccgaccgaaucgccgcaggcaaaaacaucggccaagaccgagaccccaccggcgucgaacccggcgaccaccucaaagaacgaucagcccucuccuacggaaacacccuagaccuaaacucacuagacaucgacgagcccaccggacaaaccgccgacuggcuaacgaucaucgucuaccuaaccuccuucguagucccaaucauccuaaaagcccuauacaugcucaccacacguggccgacaaaccucaaaagacaacaaaggcaugcguauccgcuucaaagacgacuccuccuacgaggacgugaacggcauccgaaagccaaaacaccuguacguauccaugccgaacgcacaaucguccaugaaagcagaagaaaucacacccggcagauucagaaccgcagucugcggccuauacccagcccaaauaaaagccagaaacaugguauccccagucauguccguagucggcuuccuagcccucgcaaaggacuggaccucacgaaucgaagaauggcucggcgcccccugcaaauucauggccgaaagcccaaucgccggcucccucuccggcaaucccguaaaccgcgacuacauacgccaacgccaaggcgcacucgcagggauggaaccaaaagaguuccaagcacuccgccagcacagcaaagacgccggaugcacccuagucgaacacauagaaucucccuccucaaucugggucuucgcaggagccagagaccgaugcccaccaaccugccuauucgucggcggaauggcagaacugggagccuucuucuccauacuccaagacaugcggaacaccaucauggcauccaaaacgguagggacagcagacgaaaaacuacgaaagaaauccuccuucuaccaaagcuaccucagaagaacgcaaaguaugggaauccaacuagaccaacgaauaaucgucauguucauggucgcauggggcaaagaagcagucgacaacuuccaccuaggagacgacauggaccccgaacuccgcucacuagcccagauccuaaucgaccaaaaagucaaagaaaucagcaaccaggagcccaugaaauuauga

SEQ ID NO: 7984 - RNA, 1290 nt, Artificial Sequence
  derived and/or modified CDS sequence (opt11) from SEOV(ZJ5)__FJ753400.1__N
auggccacaauggaagaaauccagagagaaauauccgcccacgaaggccagcuagucaucgcccggcaaaaagucaaggacgcagaaaaacaauacgaaaaggaccccgacgaccucaacaaacgcgcccuccacgaccgagaauccgucgcagccucaauccaaagcaaaaucgacgaacuaaaacgacaacuagccgaccgaaucgcagccggcaagaacaucggccaagaccgcgaccccaccggcguagaaccgggcgaccaccucaaagaaagauccgcccuaagcuacggcaacacccucgaccucaacucccucgacaucgacgaacccacaggucaaaccgccgacuggcucaccauaaucguauaccucaccucauucguaguaccaaucauccucaaggcccuuuacaugcucacaacccgaggacgacaaaccagcaaagacaacaaaggaaugcgcauccgcuucaaagacgacucgucauacgaagacguaaacggaauccgaaaacccaaacaccuauacgucucaaugccaaacgcacaauccucaaugaaagcagaagaaaucacgcccggacgcuucagaacagccgucugcggacuauacccggcacaaaucaaagcccgaaacaugguaucccccgucaugucagucguaggauuccucgcacuugccaaagacuggacuucccgcaucgaagaauggcucggcgcacccugcaaauucauggccgaaucacccauagcaggcagccucuccggcaaccuaguuaaccgagacuacauccgccaacgccaaggcgcacucgccggcauggaacccaaagaauuccaggcacuacgacaacacagcaaagacgccggaugcacccucgucgaacacaucgaaucccccuccucaaucugggucuucgccggagcacccgaccgcugcccccccacaugccuauucgucggaggcauggcagaacucggagccuucuucuccauacuccaagacaugcgcaacaccaucauggcauccaaaaccgucggcacagccgacgaaaagcuacgaaaaaaauccucauucuaccaaucauaccuccgacgaacccaaucaaugggcauccaacuagaccaacgcaucaucgucauguucauagucgccuggggcaaagaagcaguagauaacuuccaccucggcgacgaccucgaccccgaacuccgcucacucgcacaaauccucaucgaccaaaaaguaaaagaaaucuccaaccaagaaccaaugaaacucuaa

SEQ ID NO: 7985 - RNA, 1290 nt, Artificial Sequence
  derived and/or modified CDS sequence (opt11) from SEOV(ZT10)__AY766368.1__N
auggcccugugcgaagaaauccaacgcgaaaucucagcccacgaagggcaacuagucauagcacgccaaaaaguaaaagacgcagaaaaacaauacgaaaaagaccccgacgacuucaacaaacgagcccugcacgaccgcgaaagcguagccgccagcauacaaucaaaaauagacgaacucaaacgccaacuagccgaccgaaucgcagccggcaaaaacaucggacaagaccgugaccccaccggaguggaacccggcgaccaccuaaaagaacgaagcgcccuaagcuacggaaauacccuagaccuaaacucacuagacaucgacgaacccaccggacaaacagccgacuggcugaccaucaucguauaccuaacaucauucgucgucccaaucauccucaaagcccuauacaugcuaacaaccagaggacgccagaccagcaaagacaacaaaggcaugcgcauccgcuucaaagacgacagcucauacgaagacgucaacggaaucagaaaacccaaacaccucuacgucucaaugccaaacgcacaaucaagcaugaaagccgaagaaaucacaccaggccgcuuucgcacagcagucugcggccucuaccccgcgcagaucaaagcccgcaacaugguauccccagucaugagcgucgucggcuuccuagcccuggccaaagacuggacaucccgcaucgaagaauggcugggagcacccugcaaauucauggcagaauccccaauagccggcagccucagcggcaaccccguaaaccgcgacuacauacgccaacgccaaggcgcgcucgcaggcauggaaccgaaagaguuccaagcccuccgccagcacgccaaagacgccggaugcacucucgucgaacacaucgaaucaccauccuccaucugggucuucgccggagcccccgacagaugcccaccaaccugccuauucgucggcggcauggcagaacucggcgccuucuucuccggacucgcggacaugagaaacacaauuauggccagcaaaacagaaggaaccgcagacgaaaaacuaaggaaaaaaagcucauucuaucaaucguaucucagacgccaacagagcaugggcauccaacucgaccaacgcauaauagucauguucauggucgcauggggaaaagaagcagucgacaacuuccaccucggagacgacauggacccagaacuccgcagccuagcacaaauccucaucgaccaaaaagugaaagaaauaucaaaccaggaaccaaugaaacuauaa

SEQ ID NO: 7986 - RNA, 1290 nt, Artificial Sequence
  derived and/or modified CDS sequence (opt11) from SEOV(ZT71)__AY750171.1__N
auggcaaccauggaagaaauccaaagagaaaucucagcacaugaaggccaacucguaauagcccgccaaaaagucaaagacgcagaaaaacaauacgaaaaggacccagacgacuucaacaaaagagcccuucacgaccgcgaauccgucgccgccagcauccaaucaaagauagacgaacuuaaacgccaacucgcggaccgcaucgcagccggcaaaaacaucggacaagaccgcgaccccacaggaguagaacccggagaccaccuaaaagaacgauccgccuuaagcuacggcaacacccuggaccucaacucccucgacauagacgaaccaacaggccaaaccgccgacugguuaacaauaauagucuaccuaaccuccuucgucguccccaucauccuaaaagcacucuacaugcuaaccacccgaggccgacaaaccuccaaagacaacaaaggaaugcgaaucagauucaaggacgacagcucauacgaagacguaaacggaauacggaaacccaaacaccuauacgucagcaugccgaacgcccaaucaagcaugaaagcagaagagauaacccccggccgcuuccgcaccgccgucugcggacuauaccccgcccaaaucaaagcacgaaacauggucucccccgucaugagcgucgucggauuccuagcccucgccaaagacuggacaucacgcaucgaagaguggcucggcgcccccugcaaauucauggcagaaucccccauagccggcagccugagcggcaacccagucaaccgcgacuacaucagacaacgccaaggcgcacuagcaggcauggaacccaaagaguuccaagcccuacgccagcacgcaaaagacgccggcugcacccucgucgaacacaucgaaagcccaagcagcauaugggucuucgccggggccccggaccgcugcccacccacaugccuguucgugggcggaauggccgaacuuggcgccuucuucagcauccuucaagacaugcgaaacacaauaauggccagcaaaaccgaaggcaccgccgacgaaaaacuacgcaagaaauccucauucuaccaaucauacuuaagacgacaacaaagcaugggcauccaacuagaccaacgcaucaucguaauguucauggucgccuggggaaaagaagccgucgacaacuuucaccugggagaugacauggaccccgaacuccgaucacucgcacaaauacuaauagaccaaaaagucaaagaaauuucaaaccaagaacccaugaagcucuag

SEQ ID NO: 7987 - RNA, 1290 nt, Artificial Sequence
  derived and/or modified CDS sequence (opt11) from SEOV(zy27)__AF406965.1__N
auggccaccauggaagaaauacaacgagaaauauccgcccacgaaggccagcuagucaucgcccgacaaaaagucaaagacgcagaaaagcaauacgaaaaagauccagacgacagcaauaaacgagcacuacacgaccgcgaaaguguugccgcaucaauccaaucaaaaauagacgaacucaagcgccaacucgcagaccgcaucgccgccggcaaaaauauuggacaagaccgagacccaaccggcguugaacccggcgaccaccuaaaagaacgcuccgcccccagcuacggcaauacccuagaccucaacucacucgacauagacgaacccacuggccaaacggcagacuggcugaccaucaucguauaccuaaccuccuucguaguaccgaucauccucaaagcccucuacaugcuaaccacccgcggccgccaaaccagcaaagacaacaaaggaaugcggaucagauucaaagacgacuccucauacgaagacguaaacgggauccgaaaaccaaaacaccucuacgucucuaugccaaacgcccaauccucaaugaaagccgaagaaaucacacccgaaagauuccgaaccgccguaugcggccuauaccccgcccaaaucaaagcacgaaacauggucucccccgucaugagcguagucggcuuccuagcccucgccaaagacuggaccucccgcaucgaagaauggcuaggcgccccaugcaaauucauggccgaaucccccauagccggcucacuaagcggaaaccccguaaaccgagaccacauacgccaacgccaaggcgcccucgcgggaauggaaccaaaagaguuccaagcccuccgccagcacgccaaagacgcagggugcacccuagucgaacacaucgaaagccccuccucaaucugggucuuugccggagcaccagacaggugucccccaacaugccuguucguaggcggcauggccgaacucggcgcauucuucagcauccuccaagacaugcgcaacacaauaauggccagcaagacagucggaacagccgacgaaaaacuacgcaaaaaguccuccuucuaucaaucauaccucagacgcacccaaagcaugggcauacaacuagaccaacguaucauaguaauguucauggucgccuggggaaaagaagccgucgacaacuuccaccucggcgacgacauggacccugaacuacgcucacuggcccagauccuaauagaccaaaaaguaaaagaaaucuccaaccaagaacccaugaaacucuaa

SEQ ID NO: 7988 - RNA, 1290 nt, Artificial Sequence
  derived and/or modified CDS sequence (opt11) from SEOV(DN2)__KX289954.1__N
auggcaaccauggaagaaauccaacgcgaaaucagcgcccacgaaggccagcuagugaucgcccgccaaaaagccaaagacgccgagaaacaauacgaaaaagaucccgaugaccucaacaaacgcgcgcuccacgaccgcggaagcgucgccgccuccauacaauccaaaaucgacgaacucaaacgccaacucgcagaccgcauugcagccgguaaaaacauaggacaagaccgcgaccccaccggagucgaaccaggagaccaccucaaggaacgcucggcccucucauacggcaacacccuagaccuaaacucacucgacaucgacgaaccaaccggacaaaccgcagacuggcucaccauaaucgucuaccuaacauccuucgucguccccaucauccucaaagcccuauacaugcuaaccacccgcggccgacaaacuagcaaagacaacaaaggaaugcggauccgauucaaagacgacagcucauacgaagacgucaacggcauccgcaaaccaaagcaccuguacguaagcaugcccaacgcccaaagcucaaugaaagcagaagaaaucaccccaggccgcuucagaacagccguaugcggccucuacccagcccaaauaaaagccagaaacaugguuagccccgugauguccgucguaggcuuccuagcccuagccaaagacuggaccucgcggaucgaagaauggcucggagaacccugcaaauucauggccgaauccccaauagcaggaagccuauccgguaacccaguaaaccgcgacuacauccgccaacgccaaggcgcccucgcaggcauggaaccuaaagaguuccaagcgcuucgccaacacagcaaagacgccggcugcacacucgucgaacacaucgaauccccaagcagcaucugggucuucgccggcgccccagacagaugucccccaaccugccucuucgucgguggcauggcagaacucggaguauucuucucaauccuccaagacaugcgaaacaccauaauggcaagcaaaaccgugggaaccgccgacgaaaaacucagaaagaaauccuccuucuaccaauccuaccuccgccgaacccaaucaauggggauccaacucgaccaacgaaucaucgucauguucauggucgcauggggcaaagaagcaguagacaacuuccaccucggcgacgacauggacccagaacuccgcagccucgcccaaauccucaucgaccaaaaagucaaagaaaucagcaaccaagaacccaugaaacucuaa

SEQ ID NO: 7989 - RNA, 1290 nt, Artificial Sequence
  derived and/or modified CDS sequence (opt11) from SEOV(IR162)__KX079476.1__N
auggccacaauggaagaaauacaaagagaaaucuccgcacacgaaggacagcuagucauagcccgccaaaaagucaaagacgcagaaaaacaauacgaaaaagauccagacgaccuaaauaagcgcgcccuccacgaccgugaauccgucgccgccucaauacaguccaaaaucgacgaacuuaaacgccaacucgcugaccgaaucgccgccggcaaaaacauaggacaggaccgcgaccccaccggcgucgagcccggagaccaccucaaagaacgcuccgcccucuccuacggaaauacccucgaccuaaacagccucgacaucgacgaacccaccggccaaaccgcagacuggcucacaaucaucgucuaccucaccucauucgucguccccaucauccuaaaagcccucuacaugcuuaccacccgcggccgccaaaccagcaaagacaacaaaggaaugagaaucagauucaaagacgacucaagcuacgaagacgucaacggcauacgcaaacccaaacaccucuacguauccaugcccaacgcacaaagcuccaugaaagcagaagaaaucacacccggcagauuccgcacagccguaugcggccuguaccccgcccaaaucaaagcccgcaacauggucucccccguaaugucaguaguaggcuuccuagcccucgcaaaagacuggaccucccgaaucgaagaauggcucgacacacccugcaaauucauggucgaaucccccaucgccggcucccucuccggaaaucccgucaaccgagacuacauccgccaacgccaaggcgcacuagcaggcauggaacccaaagaguuccaagcccuccgacaacacucaaaagacgccggaugcacccucguagaacacauagaaucccccagcagcaucuggguauucgcaggcgccccagaccgaugcccacccacaugccuauucgucggaggcauggccgaacucggcgccuucuucuccauccuccaagacaugcgaaacaccaucauggccagcaaaaccguaggcaccgccgacgaaaaacuucgcaagaaaagcagcuucuaccaguccuaccuacgccgcacccagagcaugggcauccaacucgaccaacgcaucaucgucauguucaugguagcauggggcaaagaagcagucgacaacuuccaccucggcgacgacauggaccccgaacuaagaucacuagcccagauccuaauagaccaaaaagucaaagaaauuuccaaccaggaaccaaugaaauuauaa

SEQ ID NO: 7990 - RNA, 1290 nt, Artificial Sequence
  derived and/or modified CDS sequence (opt11) from SEOV(Gou3)__AF184988.1__N
auggccacaauggaagaaauccaacgcgaaaucucagcgcacgaaggacaacucgucauagcacgccgcaaaguaaaagacgccgaaaaacaauacgaaaaagaccccgacgaucuuaacaaaagagcccugcacgaccgcgaaagcgucgcugccagcauccaauccaaaaucgacgaacucaaacgccaacucgcagaccgcaucgcagccggcaagaacaucggccaagaccgagaccccaccggagucgaaccgggcgaccaccucaaagaacgcuccgcccuaagcuacgggaacacccucgaccucaacucacucgacaucgacgaacccaccggccagaccgccgacuggcuaaccaucaucgucuaccucaccagcuucguagucccaaucauacuaaaagcacucuacaugcucacaacaagaggacgacaaaccagcaaggacaauaaaggcaugcguauacgcuucaaagacgacucaucauacgaagacguaaacggaauacgaaaaccgaaacaccucuacgucuccaugccaaacgcccaaagcuccaugaaagcagaagaaaucacgcccggacgcuuccgcacggccgugugcggccuauaccccgcccaaaucaaagcccgcaacaugguauccccagucaugagcguagucggcuuccucgcccucgccaaagacuggaccucacgcaucgaagacuggcuuggcgcaccaugcaaauucauggcagaaagccccauagccggcagccucuccggcaacccagucaaucgagacuacaucagacaacgacaaggcgcacucgccggcauggaacccaaagaguuccaagcacuccgccaacacuccaaggacgccggaugcacacucgucgaacacaucgaaagcccuagcuccaucuggguauucgccggagccccagaccgaugcccacccacaugccucuucgucggcggcauggcagaacucggcgccuucuucuucauccuacaagacaugcgaaacaccaucauggcauccaaaaccgucggaaccgccgacgaaaaacucagaaagaaauccagcuucuaccaauccuaccuucgccgcacccaaagcaugggcauacaacuagaccagcgaauaaucgucauguucauggucgccuggggcaaagaagcaguggacaacuuccaccuaggagacgacauggacccagaacugcgcucacucgcccaaauccucauagaccaaaaaguaaaagaaaucuccaaccaagaacccaugaaacuauaa

SEQ ID NO: 7991 - RNA, 1290 nt, Artificial Sequence
  derived and/or modified CDS sequence (opt11) from SEOV(Gou3-v9)__AF288651.1__N
auggccacaaaagaagaaauccaacgagaaaucagcgcccacgaaggccaacucguaaucgcccgacaaaaagucaaagacgccgaaaaacaauacgagaaagaccccgacguccuaaacaaacgagcccuucacgacagagaaagcgucgccgcaagcauccaauccaaaaucgacgaacugaaacgccaacuggcagaccgcaucgcagccggcaaaagcauaggccaagaccgagacccgacaggcguagaaccaggcgaccaccugaaagaacgcagcgcccuaagcuauggcaacacccuagaccuaaacucacuagacaucgacgaaccuaccggccaaaccgcagacuggcucacgaucaucgucuaccuaaccuccuucguaguccccaucauccuuaaagcacucuacaugcuaaccacacgaggccgccaaaccuccaaagacaaccgcggaaugcgaaucagguucaaagacgacuccucauacgaggacguaaacggcaucagaaaacccaaacaccucuacgucucgaugcccaacgcccaguccuccaugaaagccgaagaaaucacaccaggccgcuuccguaccgccguaugcgggcuguaccccgcccaaaucaaagcccgaaacauggugaguccagucauguccguagucggcuuccuagcccuagccaaagacuggaccucccgaaucgaagacuggcucggcgcacccugcaaauucauggccgaauccccaaucgcaggaucacucagcggcaaccccgucaaccgugacuacauacgacaacgacaaggcgcccuagcaggcauggagcccaaagaguuccaagcccucaggcagcacucaaaagacgccggaugcacacucgucgaacacaucgaaucaccuagcuccaucugggucuucgccggcgcccccgaccgcugcccaccaaccugccuguucguaggcggcauggcugaacuaggcgcauucuucuccauccuccaagacaugagaaacaccauuauggcaagcaaaaccgucggaaccgcagacgaaaaacuacguaagaaaucaucauucuaccaaucguaccuacgccgcacucaaucaaugggaauccaacucgaccaacgcaucaucgucauguuuaugguagcauggggcaaagaagccgucgacaacuuccaccuaggggacgacauggaccccgaacuccgcucccucgcccaaauccuaaucgaccaaaaaguaaaagaaaucuccaaccaagaacccaugaaacuauaa

SEQ ID NO: 7992 - RNA, 1290 nt, Artificial Sequence
  derived and/or modified CDS sequence (opt11) from SEOV(IR461)__AF329388.1__N
auggcaaccauggaagaaauccaacgggaaaucuccgcccaugaagggcaacucgucaucgcaagacaaaaagucaaagacgccgaaaaacaauacgaaaaagaccccgacgaccuaaacaaacgcgcccuccacgaccgagaauccguagccgcaucaauacaauccaaaaucgacgaacucaaacgacaacucgccgacagaauagcggccggcaaaaacauaggccaagaccgcgacccaacaggcgucgaaccaggagaccaccucaaagaacgcagcgcacucuccuacgggaacacacucgaccugaacucacuagacauagacgaaccaacgggccagaccgcagacuggcucaccauaaucguauaucuaaccagcuucgucgucccaaucauacuaaaggcccucuacaugcuaacaacacgcggccgccaaacauccaaagacaacaaaggaauccgcaucagauucaaagacgacagcagcuacgaaaacgucaacggcauacguaaacccaaacaccucuacgucucaaugccaaacgcacaauccagcaugaaagcagaagaaauaacccccggacgauuccgcaccgccgucugcggccuauaccccgcccaaaucaaagccggcaacauggucucccccgucaugucggucgucggcuuccuagcauuagccaaagacuggaccagccgcaucgaagaauggcucgacacacccugcaaguucauggucgagucccccaucgccggcucccucuccggcaaccccguaaaccgagacuacauccgccaaaggcaaggcgcccucgccggcauggaacccaaagaguuccaagcgcuccgccaacacagcaaggacgccggcugcacccucguugaacacaucgaaucaccauccuccaucuggguuuucgccggagccccagaccgaugcccaccaaccugccuauucguaggaggcauggccgaacuaggcgccuucuucuccauccuacaagacaugcgaaacacaauuauggcaucuaaaacggucggcaccgcagacgagaaacuccgcaagaaaagcuccuucuaccaauccuaccuacgacgcacccaauccaugggaauacaacuugaccaacgaaucaucgucauguucauggucgcguggggaaaagaagccgucgacaacuuccaccuaggcgacgacauggaccccgaacuccgcagccuagcgcaaauacucaucgaccaaaaagucaaagaaauauccaaccaagagcccaugaaacuuuga

SEQ ID NO: 7993 - RNA, 1290 nt, Artificial Sequence
  derived and/or modified CDS sequence (opt11) from SEOV(JUN5-14)__DQ217791.1__N
auggccaccauggaagaguuccaacgcgaaauaucggcccacgaaggccaacucgucauagccagacaaaaagucaaagacgccgaaaaacaauacgagaaagaccccgacgaccucaacaaacgcgcucuccacgacagagaauccgucgccgcaagcauccaauccaaaauagaugaacuuaagcgccaacucgccgaccgaauagcagccggcaaaaacaucggacaagaccgcgacccaacaggcguagaaccaggagaccaccucaaagaacgaagcgcccucagcuacggaaacacccucgaccucaacucccuagacaucgacgaacccaccggacaaacggccgacuggcugaccaucaucguauaccucaccucauucgucguccccauaauccuaaaagcccuauacaugcuaaccacccgaggccgacaaaccagcaaagacaacaaaggcaugcgaaucagguucaaagacgacagcuccuacgaggacgucaauggcauccgaaaacccaaacaccuauacguaucaaugcccaacgcccaaucgagcaugaaagcagaagaaaucacaccaggcagauuccgaaccgccguaugcggccucuacccagcccaaaucaaagcccggaacauggucagcccggucaugagcgucgucggauuccucgcacuggccaaagacuggaccucaagaaucgaagaauggcucggcgcaccaugcaaguucauggccgaaucacccaucgcaggcucacucagcggaaacccagucaaccgcgacuacaucagacaacgccaaggagcccuagccggcauggagcccaaagaguuccaagcccuccgccaacacgcaaaagacgcaggcugcacacucgucgaacacauagagaguccaagcagcaucugggucuucgccggagcccccgacagaugcccaccaaccugccuauucguaggcggcauggccgaacucggcgccuucuucuccauccugcaagacaugcgcaacaccaucauggccagcaaaaccguaggcaccgcagacgaaaaacuccgaaagaaaagcagcuucuaccaaagcuaccuucgccgcacacaguccaugggcauccaacuagaccaacgcaucauagucauguucaugguagcaugggguaaggaagcaguagacaacuuccaccuaggcgacgacauggaccccgaacuccgcucgcucgcacaaauccuaauagaccaaaaaguaaaagaaaucuccaaccaagaaccgaugaaacucuaa

SEQ ID NO: 7994 - RNA, 1290 nt, Artificial Sequence
  derived and/or modified CDS sequence (opt11) from SEOV(L99)__AF488708.1__N
auggcaacaauggaagaaauccaacgcgaaaucagcgcacacgaaggccaacuggucauagcccggcaaaaaguaaaagacgcagaaaaacaauacgaaaaagaccccgacgaccucaacaaaaggacccuacacgaccgcgaaagcgucgccgccagcauacaauccaaaaucgacgaacucaaacgacaacucgccgacaggaucgcugccggaaagaacaucggucaagaccgagaccccaccggcgucgaaccaggugaccaccucaaagaacgcagcgcccucagcuacggcaacacccuggaccucaacucacuagacauagacgaacccacaggccaaacagccgacuggcucaccaucauaguauaccuaaccucauucgucguaccgaucauucuaaaagcccucuacaugcuaacaacccgaggacgccaaaccagcaaagacaacaaaggcaugcgcaucagauucaaagacgacucaagcuacgaggacguaaacggcauacggaaacccaaacaccuauacgugucaaugcccaacgcccagucaagcaugaaagccgaagaaaucacccccggacgcuuucggacagccgucugcggccucuacccagcacaaaucaaagcacgaaacauggucagcccagucaugagcguaguaggcuuccucgcacuagcaaaagacuggacauccagaauagaagaauggcuaggagccccaugcaaauucauggccgaaucgcccaucgccggaucccucagcgguaaccccgucaaccgcgacuacauccgacagcgacaaggagcccuagcaggcauggaaccaaaagaguuccaggcccuaagacaacacgccaaagacgccggcugcacccucguggaacacaucgaaagccccuccuccauuugggucuucgcaggcgcccccgaccgaugcccaccuaccugccuuuucgucggcggaauggcagaacucggcgcauucuucagcauacuccaagacaugcggaacaccaucauggccagcaaaacagucggcacagcagacgaaaagcucagaaagaaauccagcuucuaccaauccuaccuacgacgaacacaaagcaugggcauacaacucgaccaacgaauaaucguaauguucauggucgccuggggcaaagaagcagucgacaacuuccaccuaggcgaugacauggaccccgaacuccgcucccucgcccaaauacucaucgaccaaaaagugaaagaaaucuccaaccaagaaccaaugaaacucuaa

SEQ ID NO: 7995 - RNA, 1290 nt, Artificial Sequence
  derived and/or modified CDS sequence (opt11) from SEOV(R22)__AF488707.1__N
auggcaacgauggaagaaauacaacgcgaaauaagcgcccacgaaggccagcuagucaucgcccgccaaaaaguaaaagacgcagagaaacaauacgaaaaagaccccgacgaccuaaacaaacgugcacuccacgaccgagaaucuguagcagccucaauccaauccaagaucgacgaacucaaaagacaacucgcagaccgaaucgccgcagguaaaaacaucggacaagaccgcgacccaaccggagucgaaccaggagaccaccucaaagaacgcucagcacuauccuacggaaacacccucgaccuaaacagccucgacauagacgagccaaccggccaaaccgccgauuggcuaaccauaaucguauaccucaccuccuucguaguccccauuauacuaaaagcacuauacaugcuaacuacccgaggccgacaaacauccaaagacaacaaaggaaugcgcauucgcuucaaagacgacucuagcuacgaagacgucaacggcauccgcaaacccaaacaccucuacgucagcaugcccaacgcacaauccucaaugaaagccgaagaaaucacacccggccgauucagaaccgcugucugcggccuauaccccgcccaaauaaaagcccgcaacaugguaagccccgucauguccguggucggauuccuagcgcucgcaaaagacuggaccagccgaauagaggaauggcuaggcgcucccugcaaauucauggccgaaucccccaucgccggaucccucuccggcaacccagucaaccgcgacuacaucagacaacgacaaggcgcccuagccgggauggaacccaaagaguuccaagcacucagacaacacgccaaagacgcaggaugcacgcucgucgagcacaucgaauccccaagcagcauauggguauucgcaggagcaccagaccgcugcccaccaaccugccucuucgucggccgcauggcugaacuaggcgccuucuucuccauccuccaagacaugaaaaacaccauaauggcaucaaaaaccgucggcaccgccgacgaaaaacuccguaagaaauccuccuucuaccagagcuaccuacgccgcacacaauccaugggcauacaacuagaccaacgcaucaucgucauguucauggucgcauggggaaaagaagcgguagacaacuuccaccucggagacgacauggaccccgaacucagaucccuagcccaaauacucauagaccaaaaaguaaaagaaaucuccaaccaagaacccaugaaacucuaa

SEQ ID NO: 7996 - RNA, 1290 nt, Artificial Sequence
  derived and/or modified CDS sequence (opt11) from SEOV(TURCKHEIM/Hu/FRA/2016/2016.00044)__KX064270.1__N
auggccacaauggaggaaauccaacgcgaaaucucagcccacgaaggccaacucgucaucgcacggcaaaaaguaaaagacgccgaaaaacaauacgaaaaagacccagacgaccuaaacaaaagagcacuacacgaccgcgaaagcgucgcagcauccauccaaucaaaaauagacgaacucaaacgacaacucgccgaccgcauagcugcaggaaaaaacaucggacaagaccgagaccccacaggcgucgaaccaggcgaccaccugaaagaacgcuccgcccucagcuacggaaacacucucgaccucaacucacucgacaucgacgaacccacaggacagaccgccgacuggcucaccaucaucgucuaccuaaccagcuucguaguccccauaauccucaaagcacucuacaugcucaccacaagaggccgccaaacauccaaagacaacaaaggaaugagaauccgauucaaagacgacuccucauacgaagacguaaacggcauccggaaaccaaaacaccucuacgucucgaugcccaacgcccaauccucaaugaaagcagaagaaauaacgccaggcagauuccgcaccgcagugugcgggcucuaccccgcacaaauaaaagcccgcaacauggucuccccagucaugagcguaguagguuuccucgcgcucgcaaaagacuggacauccagaaucgaagaauggcuggacgcaccaugcaaauucauugcagaauccccaaucgcaggcucccucagcggaaacccagucaaccgagacuacauccgccaacgacagggagcacucgcgggaauggaaccaaaagaauuccaagcacuccgccaacacuccaaagacgcaggcugcacgcuaguagaacacaucgaaucccccuccucgaucugggucuucgcaggagcccccgaccgcuguccaccaacgugccuauucguaggcggaauggcagaacugggcgccuucuucagcauacuacaagacaugcgaaacacgaucauggccagcaaaaccguaggaaccgccgacgaaaaacuacgaaaaaaaaguucauucuaccaaucuuaccuacgacgcacccaaagcaugggcauccaacuugaccaacgaauaaucgucauguuuauggucgccuggggcaaagaagccgucgacaacuuccaccucggcgacgacauggaccccgaacuacgcucccuagcccaaauccucaucgaccaaaaaguaaaagaaaucuccaaccaagaacccaugaaacucuaa

SEQ ID NO: 7997 - RNA, 1290 nt, Artificial Sequence
  derived and/or modified CDS sequence (opt11) from SEOV(Z37)__AF187082.1__N
auggccacaauggaagaaauacaaagagaaaucagcgcccacgaaggccaacucguaaucgccagacagaaaguaaaagacgccgaaaaacaguacgaaaaagacccagacgacuucaacaaacgagcccuccacgaccgcgaaagcgucgcggcaagcauccaaucgaaaaucgacgaacuaaaacgccaacucgcagacagaauagcagccggcaaaaacaucggacaagaccgcgacccaacaggcgucgaaccaggcgaccaccuuaaagaacgauccgcccucaguuauggcaauacccuggaccuaaacucccuagacaucgacgaaccgaccggacagacagccgacuggcucacaaucaucgucuaccucaccuccuucgucguccccaucauacucaaagcacuauacaugcucaccaccaggggcagacaaacaagcaaagacaacaaaggcaugagaauacgcuucaaagacgacucaucauacgaagacguaaacggcauucgcaaaccgaaacaucuuuacgucagcaugcccaacgcacaauccagcaugaaagccgaagaaaucacccccggacgauuccgcaccgccgugugcggccuauaccccgcgcaaauaaaagcccgcaacauggugucucccgucaugucagucguaggcuuccucgcacucgcaaaagacuggaccagucgcauagaagaauggcuaggcgccccaugcaaauucauggccgaaucccccaucgccggaagccuauccggaaacccaguaaaccgagacuacauccgccaacgccaaggcgcccucgcaggcauggaaccaaaagaguuccaagcccuacgccaacacgcgaaagacgccggcugcacccuggucgaacacaucgaaagcccauccagcauaugggucuucgccggcgcacccgacagaugcccacccacaugccucuucgugggaggaauggcagaacucggcgccuucuucagcauccuccaagacaugcgcaacacaaucauggccagcaaaaccguuggaacagcagacgaaaaacuacgcaagaaaagcuccuucuaccaaucguaccuacgaagaacacaaagcaugggaauacaacucgaccaacgcaucaucggcauguucaugguagccuggggcaaagaagccgucgacaacuuccacuuaggcgacgacauggaccccgaacuccgcucccucgcccaaauauuaaucgaccaaaaagucaaagaaaucuccaaccaagaaccaaugaaacuauaa

SEQ ID NO: 7998 - RNA, 1290 nt, Artificial Sequence
  derived and/or modified CDS sequence (opt11) from SEOV(Tchoupitoulas (TCH))__AF329389.1__N
auggccaccauggaagaaauccagagggaaaucuccgcccacgaagggcaacucgucaucgcccgacaaaaaguaaaagacgccgaaaagcaauacgaaaaagacccggacgacuucuacaagagggcccuacacgaucgcgaauccgucgccgcgagcauccaaucaaaaauagacgaacucaaacgccaacucgcagaccgcaucgcagccggcaaaaacauaggacaagaccgagaccccaccggagucgaaccaggcgaccaccuaaaagaacgaagcgcccucuccuacggcaauacccucgaccucaacucacucgacauagacgaaccaacaggccaaaccgccgacuggcuaaccauaaucgucuaccucaccucauucguagucccgaucauacucaaagcccuauacaugcucaccacccgcggccgacaaaccagcaaagacaacaaaggcaugcgaauacgcuucaaagacgacuccucauacgaagacgucaacggcauccgaaaacccaaacaccucuacgucucaaugcccaacgcgcaaucuagcaugaaagccgaagaaauaacacccggccgcuucagaaccgcagucugcggccuauauccugcccaaauuaaagcccgcaacauggucagcccagucaugagcgucgucggauuccucgcccucgccaaagacuggaccucacgcaucgaagaauggcuaggagcaccaugcaaauucauggccgaaucccccaucgcaggcucccuguccggcaaccccgucaaccgcgacuacauacgccaacgccaaggcgcccucgcaggcauggaaccaaaagaguuccaagcacuccgccaacacucaaaagacgccggaugcacccucguggaacacauagaauccccgucauccaucugggucuucgccggugccccagaccggugcccacccacuugccuauucgucggcggaauggcagaacucggcgcauucuucagcauacuccaggacaugcgcaacaccaucauggccagcaaaaccgucggcacagccgacgaaaaacuccgcaagaaaagcuccuucuaccaauccuaccuacgacgcacccaaagcaugggaauacagcucgaccagcgaaucauagucauguucauggucgccuggggcaaagaagccgucgacaacuuucaccucggagacgacauggaccccgaacuccgcucgcucgcacaaauccuaauagaccaaaaagucaaagaaaucuccaaccaggaaccaaugaaacucuaa

SEQ ID NO: 7999 - RNA, 1290 nt, Artificial Sequence
  derived and/or modified CDS sequence (opt11) from SEOV__M34881.1__N
auggcaacuauggaagaaauccaaagagaaauaagcgcccacgaaggacaacucguaaucgcccgacagaaaguaaaggacgcagaaaaacaauacgaaaaagaucccgacgaccuaaacaaaagagcacuccacgaccgggaaagcgucgcagccucgauacaaagcaaaaucgacgaacucaaacgccaacuagccgacagacuccaacaagggcgcaccucaggccaagaccgagaccccacaggcgucgaaccaggcgaccaccuaaaagaaagauccgcccucucguacggcaacacccuagaccucaacucacuugacauagacgaacccacaggacaaaccgccgacuggcuaaccaucaucgucuaccucaccuccuucgucguccccaucauacucaaagcccuauauaugcuaacaacccgcggccgccaaaccuccaaagacaacaaaggcaugaggaucagauucaaagacgacagcuccuacgaagacgucaacggcauccgcaaaccaaaacaucucuacgucuccaugcccaacgcacagucgagcaugaaagccgaagaaaucacgcccggacgauuccgaaccgcagucugcggccuauaccccgcacaaaucaaagcacgcaacaugguaagccccgucaugucaguagucggcuuccuagcccuggccaaagacuggaccucacgcauagaagaauggcuaggcgcccccugcaaauucauggcagaaucccucaucgccggcagccuaucaggcaacccgguuaaccgcgacuacauccgccaacgacaaggagcacuagccggaauggaaccaaaagaguuccaagcacuacggcaacacuccaaagacgccggcugcacccucgucgaacacaucgaaucccccuccuccaucugggucuucgcaggcgcuccugaccgaugcccaccaacgugccuguucgucgguggaauggccgaacugggagccuucuucuccauccuccaagacaugcgcaacaccauaauggccagcaaaaccguaggaaccgccgacgaaaaacuacgcaagaaaucuagcuucuaccaauccuaccugcgccgcacacaaagcaugggaauccaacuagaccaacgcaucaucgucauguucauggucgccuggggcaaagaagcagucgacaacuuccaccucggagacgacauggaccccgaacuccgcucacuagcgcaaauccucaucgaccaaaaagucaaagaaaucucaaaccaagaacccaugaaacucuaa

SEQ ID NO: 8000 - RNA, 1287 nt, Artificial Sequence
  derived and/or modified CDS sequence (opt11) from SNV(H10)__NC_005216.1__N
augagcacccucaaagagguacaagacaacaucacccugcacgaacaacaacucgucaccgcccgccaaaaacucaaagacgcagagcgcgccguagaacucgacccugacgacgucaacaaauccacccuccaaucccgacgcgccgccgucagcgcacucgaaaccaaacuaggcgaacucaaacgcgaacuagcagaccucaucgcagcucaaaaacucgccucaaaacccgucgaccccaccggcaucgaacccgacgaccaucucaaagaaaaauccucacucagauacggcaacguccucgacgucaacuccaucgaccucgaagaaccauccggccaaacagccgacuggaaaucuaucggccucuacauccucucuuuugcccuuccaaucauccucaaagcccucuacaugcuaagcacgcgaggccgacaaaccaucaaagaaaauaaaggcacccgcauccgcuucaaggacgacucuuccuaugaagaaguaaacggcauccgcaaacccagacaccuguacguauccaugcccacagcccaauccacaaugaaagccgacgaaaucacccccggacgauuccgcaccaucgccugcggccucuucccagcccaagucaaagcccgaaacauaaucuccccaguaaugggaguaaucgguuucuccuucuucgucaaagacuggauggaacgcauagaugacuuccucgccgccagguguccauuccuccccgaacaaaaagacccacgcgacgccgcacuagccacaaaccgcgcauacuucaucacacgacaacuccagguagacgaaucaaaggucucugacaucgaggaccugaucgcagacgccagagcagaauccgccacaaucuuugcugacaucgccacgccccacuccgucugggucuucgcaugcgcccccgaccgcugcccacccaccgcccucuacguagccggcaugccagaacugggagccuucuucgccauccuccaagacaugcgcaacaccauaauggccuccaaauccguaggcaccucagaagagaaacucaaaaagaaauccgcauucuaccaguccuaccuacgccguacucaaucaaugggaauccaacucgaccagaaaaucaucauccucuacaugucacacuggggccgcgaagcagucaaccacuuccaccuuggcgacgacauggaccccgaacuucgagaacucgcgcaaacccucgucgacauaaaaguacgagaaaucagcaaccaagaaccacuaaaacucuag

SEQ ID NO: 8001 - RNA, 1287 nt, Artificial Sequence
  derived and/or modified CDS sequence (opt11) from SNV(2)__JQ690282.1__N
augagcacacucaaagaaguccaagacaacaucacacuccacgaacaacaacucguaaccgcacgacaaaaacucaaagaugccgaacgcgccgucgaacuugaccccgacgacguaaacaaaucaacccuacaaagcagacgagcagcagucuccgcccucgaaaccaaacucggcgaacuaaaacgugaacuagcagaccucaucgccgcacaaaaacuagccuccaaaccagucgacccaaccggcaucgaacccgacgaccaccucaaagaaaaauccucucuacgcuacggaaacguacucgacguuaacuccauagaccuagaagaacccucagggcaaaccgccgacuggaaauccaucggacucuacauccucucuuucgcccuaccaaucauccuaaaagcacuauacaugcucagcacccgcggccgacaaaccaucaaagaaaacaaaggaacacgaauccgcuucaaagacgacucauccuacgaagaaguaaacggcaucagaaaaccccgacaccuauacguguccaugcccaccgcccaaagcaccaugaaagccgacgagauaacacccggcagauuccgaaccaucgccugcggccucuuccccgcccaaguaaaagcccgaaacauuaucucacccgucaugggcgucauaggauucagcuucuucgucaaagacuggauggaacgcauagacgacuuucucgcagccagaugcccauuccucccagaacaaaaagacccgcgagacgccgcacucgccaccaaccgagccuacuucaucacacgacaaaugcaggucgacgaaagcaaggucuccgacaucgaagaccuaauagccgacgccagagccgaauccgcgacaaucuuugccgacaucgccacaccccacuccguaugggucuucgccugcgcacccgaccgcugcccgcccaccgcccucuacgucgccgggaugccugaacuaggugcguucuucgccauccuucaagacaugcgcaacaccaucauggccuccaaaucaguaggcaccuccgaagaaaaacucaaaaagaaaucugccuucuaccaaucauaccuaagacgaacccaaagcaugggcauucaacucgaccagaaaauaaucauacucuacaugucacacuggggccgagaagccgucaaccacuuucaccucggagacgacauggacccagaacuccgcgaacucgcacaaacacucguagacauaaaaguacgggaaauauccaaccaagaaccccuaaaacucuag

SEQ ID NO: 8002 - RNA, 1287 nt, Artificial Sequence
  derived and/or modified CDS sequence (opt11) from SNV(3)__JQ690278.1__N
augucaacccuaaaagaaguccaagacaacauaacucuccaugaacaacaacucgucaccgcaagacaaaaacucaaagacgccgaacgcgcugucgaacucgaccccgacgacgucaacaaaucaacacuacaaucucgccgcgccgccguauccgcccucgaaaccaaacucggcgaacucaaacgcgaacucgccgaccucaucgcagcccaaaaacuagcauccaaaccagucgacccuaccggcauagaaccagacgaccaccucaaagaaaaauccucccuccgcuacggcaacguccucgacgucaacuccaucgaccuagaagaaccauccggacaaaccgcagacuggaaaucgauaggccuauacauauuauccuucgcccuacccaucauacucaaagcccuauacaugcucuccacacgcggccgccaaaccaucaaagaaaacaaaggcacccgaauccgauucaaagacgacuccucauacgaggaaguaaacggcauccgaaaaccucgccaccucuacgucagcaugcccacagcccaauccacaaugaaagccgacgaaauaaccccaggccgcuuccgcacaauagccugcggccucuuuccagcucaagucaaagcacgcaacaucaucucacccgucaugggugucaucggcuucuccuucuucguaaaagacuggauggaacgcauagacgacuuccuagccgcccgcugucccuuccuacccgaacaaaaagacccccgcgacgcugcccucgcaacaaacagagcauacuucaucacccgacaacuccaagucgacgaauccaaagucuccgacauagaagaccuaauagccgacgcccgcgcagaaagcgccaccaucuucgccgacaucgccaccccacacagcgucugggucuucgccugcgcccccgaccgauguccacccaccgcccuauacguagccgguaugcccgaacugggcgccuucuucgccauacuccaagacaugcgcaacacaaucauggccuccaaauccgucggcacaucagaagaaaagcucaaaaagaaauccgccuucuaccaaucauaccucagacgcacccaaagcaugggaauccaacccgaccagaaaaucaucauccuauacaugagccacuggggacgagaagcaguaaaccacuuccaccuaggggacgacauggaccccgaacuccgagaacuagcccaaacacucguagacaucaaaguccgcgagaucuccaaccaagaaccacucaaacuauaa

SEQ ID NO: 8003 - RNA, 1287 nt, Artificial Sequence
  derived and/or modified CDS sequence (opt11) from SNV(CC107/POR)__KT885046.1__N
augucaacccucaaagaaguccaagacaacauaacccuccacgaacaacaacucgucaccacucgccaaaaacuaaaagacgccgagcgagcagucgaacucgaccccgacgacguaaacaaaagcacgcuccaaucccggcgcgcagccgucucagcccuugaaacaaagcucggugaacuaaaacgagaacuagcagaccucaucgcagcccaaaaacuagccuccaaaccaguggacccaaccggaauagaacccgacgaccaccucaaagaaaaauccucccuccgcuacggcaacguacucgaugucaacuccaucgaccuagaagaaccauccggccaaaccgccgacuggaaaagcaucggccucuacauccucuccuucgcacuaccaauaauccucaaagcccucuacaugcucuccacacgaggacgccaaacaaucaaagaaaacaaaggcacccgcauccgcuucaaagacgacuccagcuacgaagaaguaaacggcauacgaaaaccccgccaccucuacgucuccaugccaacagcccaauccacaaugaaagccgacgaaauuaccccaggacgcuuccgcacaaucgcaugcggccucuuccccgcccaagucaaagcccgaaacaucauaucgcccgucaugggaguaaucggcuucagcuuuuucgucaaagacuggauggaacggaucgacgaguuccucgccgcccgcugccccuuccuccccgaacaaaaagacccccgagacgccgcccuugccacuaaccgcgcuuacuucaucacacgccaaaugcaaguagacgaauccaaaguaagcgacaucgaagaccucaucgcagacgcacgagccgaaucagccacaaucuucgcagacauagccaccccacacuccguauggguauucgccugcgcccccgaccgcugcccacccacagcccucuacguagccggaaugcccgaacugggcgcauucuucgccauccuacaagacaugcgaaacaccaucauggccucaaaauccguaggcaccucagaagaaaaacucaaaaagaaauccgccuucuaccaaucauaccuccgccguacccaaagcaugggcauacaacucgaccagaaaauaaucauccucuacaugagccacuggggacgcgaagcagucaaccacuuccaccuuggcgacgacauggacccagaacuucgugagcucgcccaaacccucguagacauaaaaguacgugaaaucuccaaucaagaaccucucaaacucuaa

SEQ ID NO: 8004 - RNA, 1287 nt, Artificial Sequence
  derived and/or modified CDS sequence (opt11) from HPS(Convict Creek 107)__L33683.1__N
auguccacacucaaagaaguccaagacaacaucacccuucacgagcaacaacucgucaccacucgacaaaaacuuaaagacgccgaacgcgccgucgaacucgaccccgacgacguaaacaaaagcacacuccaaucccgacgcgcagccgucagcgcccucgaaaccaaacucggcgaacucaaacgcgaacucgcggaucucauagcggcccaaaaacucgccagcaaacccgucgacccaaccggcaucgaaccagacgaccaucucaaggaaaaaucaucccuccgauacggcaacguacucgacgucaacucaaucgaccucgaggagcccuccggacaaaccgccgacuggaagucuaucggacucuacauacucuccuucgcacuacccaucauccucaaagcccuauacaugcuauccacccgcgggcggcaaacaaucaaagaaaacaaaggcacccgaauccgcuucaaagacgacuccuccuacgaagaagucaauggaauccgaaaaccccgacaucucuacgucagcaugccaaccgcccaaucaaccaugaaagcagacgaaauaacacccggacgauuccgaaccauagccugcggccuauuccccgcccaagucaaagcccgaaacaucaucucccccgucaugggcgucaucggauucuccuucuucguaaaagacuggauggaacgcaucgacgaguuccucgccgcccgcugcccauuccuaccugaacaaaaagacccacgagacgccgcccucgccaccaaccgagccuacuucauaacccgccaaaugcaagucgacgaauccaaagucagcgacaucgaagaccugauagccgacgccagagcugaaucagccaccaucuucgccgacaucgccaccccacacucaguaugggucuucgccugcgcacccgaccgcugcccacccacagcacucuacgucgcaggaaugcccgaacucggcgccuucuucggcauacuucaagacaugcgaaacacaauaauggccagcaaauccguaggaaccuccgaagaaaaacucaagaagaaaucagccuucuaccaauccuaccuccgacgaacccaaaguaugggaauccaacucgaccagaaaaucaucauccucuacaugucccacuggggacgagaagccgucaaccacuuccaccucggcgacgauauggaccccgaacuccgagaacuagcccaaacccucguagacaucaaaguccgugaaauauccaaccaagaaccacuaaaacucuaa

SEQ ID NO: 8005 - RNA, 1287 nt, Artificial Sequence
  derived and/or modified CDS sequence (opt11) from HPS(Convict Creek 74)__L33816.1__N
augaguacgcucaaagaaguacaagacaacaucacccuacacgaacaacaacucgucaccuccagacaaaaacucaaagacgcugaacgcgccgucgaacuagaccccgacgacgucaacaagucaacgcuccaaucccgccgagccgccgucagcgcacucgaaaccaaauuaggcgaacuuaaacgagaacuagcagaccauaucgccgcccaaaaacuagcaucaaaacccguagaccccacagggauagaacccgacgaccaccucaaggaaaaauccuccuuacgauacggcaacguccucgacgucaacuccauagaccucgaagaacccaacggccaaaccgcagacuggaaauccauaggacucuauauccucucauucgcccuacccaucauccuuaaagcacucuacaugcucuccacacgcggccgccaaaccaucaaagaaaacaaaggcacacgcauacgcuucaaagacgacagcagcuacgaagaagucaacggcauccgaaaaccccgacaccucuauguauccaugccaacagcccaauccacaaugaaagccgacgaaauaacacccggccgcuuccgcaccauagccugcggucucuuccccgcccaagucaaagcaagaaacauaaucagccccgucaugggcgucaucggcuucuccuucuucgucaaagacuggauggaacgcaucgacgaguuccucgccgcucgcugcccuuuccuacccgaacaaaaagacccccgagacgccgcccucgccaccaaccgcgccuacuucaucacccgacaacuccaagucgacgaaucaaaaguauccgacaucgaggaccucaucgcugacgcccgcgccgaauccgccaccauauucgcagacaucgcaacaccccacuccgucugggucuucgccugcgcccccgaccgaugcccacccaccgcccucuacguugccggcaugcccgaacucggcgccuucuucggcauccuccaagacaugcgaaacaccauaauggccuccaaauccgucggcaccuccgaagaaaaacucaagaagaaauccgcauucuaccaauccuaccuccgccgcacccaauccaugggaauccaacuagaccagaaaaucaucauccuuuacaugucccacuggggccgcgaagcuguaaaccacuuccaccucggcgacgacauggaccccgaacugcgagaacucgcacaaacccucgucgacaucaaaguccgagaaaucuccaaccaagaaccccucaaacuuuaa

SEQ ID NO: 8006 - RNA, 1287 nt, Artificial Sequence
  derived and/or modified CDS sequence (opt11) from HPS(H-NY1)__U47135.1__N
auguccacccucaaagaaguccaagacaacaucacccuccacgaacaacaacucgucaccgcacgccaaaaacucaaagacgccgaaaaagccgucgaagucgacccagaugacgucaacaaaagcacccuccaaggaagacgagccgccgucuccgcccucgaaaccaaacuaggcgaacucaaacggcaacucgcagaccucaucgccgcccaaaaacucgccucaaaaccaauugacccaaccgguauagaacccgacgaccaccucaaagaaaaauccucucuacgauacggcaacguccucgacgucaacucaaucgaccucgaagaaccuuccggacaaaccgcagacuggaaagccaucggaauguacauccucuccuucgccaucccgauaauccucaaagcgcuauacaugcuaucaacccgcggccgacaaaccguaaaagaaaacaaaggcacccgcauacgauucaaagacgacuccucauacgaagaagucaacggcauccgcaagccccgccaccucuacgucuccaugcccacagcccaaagcaccaugaaagcagacgaaaucacacccggacgguucagaaccaucgccugcggccucuucccugcacaaguaaaagcccgcaacaucaucucacccguaaugggugucaucggcuucaacuucuucguaaaagacuggauggaccgcaucgacgauuuccucgccgaacgcugucccuuccuccccgaaccccgcgaccccaaagacgccgcccucggcaccaaccgcgcauacuucaucacccgccaagcacaggucgacgaaucaaaagucguagacaucgaagaauuaauagucgacgcccgugccgaaucagccacccucuucaccgacaucgccacaccccacucagucugggucuucgccugcgcccccgaccgcugcccacccaccgcccucuacgucgccggaaugcccgaacuuggcgccuucuucgcuauucuccaagacaugcggaacacaaucauggccagcaaauccguuggcaccgccgaagaaaaacucaaaaagaaauccgcauucuaccaaucuuaccuccgccgcacccaaagcaugggcauacaacuagaccagaaaaucauaauacuauacaugauccacuggggcaaagaagccgucaaccacuuccaccuuggcgacgacauggaccccgaacuccgcgagcuagcccaagcccucgucgacgccaaagucaaagaaaucucgaaccaagaaccccucaaacuauaa

SEQ ID NO: 8007 - RNA, 1290 nt, Artificial Sequence
  derived and/or modified CDS sequence (opt11) from THAIV(Nakhon Ratchasima/Bi0017/2004)__AM397664.1__N
auggcaacaauggaagaacuacaacgcgagaucaaugcucacgaaggacagcuagucguagccagacaaaaagucaaagacgcagaaaaacaauacgaaaaagacccggacgaccucaaccgccgagcacuacacgaccgcgaauccgucgccgcgagcauccaauccaaaauagacgaacucaaacgacaacucgcggaccgcauagccagcggccgcacaaucggucaagaccgagaccccacaggcguagaaccaggcgaccaccuacgagaacgcucuaugcugagcuacggcaacguccuagaccuaaacaaccucgacaucgaagaaccaaccggccaaacggcagacuggcucaccaucaucguauaccuaaccuccuucgucaucccaauaauacuuaaagcccuguacaugcucacaaccagaggacgacaaacaaccaaagacaacaaaggaaugcgaauccgauucaaagacgacagcucauacgaggacguaaacgggauucgaaaaccaaaacaccucuacaucuccaugcccaacgcccaauccuccaugaaggcagaagagaucacacccggacgauuccgaaccgcuguaugcggacucuaccccgcacaagugaaagcacgcaacauggugagcccagucaugagcguaaucggauucauggcacucgcaaaagacuggacagaccgcauacaagacuggcugggcgcacccugcaaauuccuaccagaccuaagcacacaaucgcuacacgccuccccacccaccaacgcagacuacauagcccaacgacaaggacuacucgccggcauggaaacgaaagaaucaaaaggcauccgcgaccacgcacgcgacgccggaugcacacucguagaccaccucgacagccccagcucaauauggguauucgcuggagccccagacagaugcccgccgacgugccuguucauagccggaauggcagaacuaggagcauucuucagcauccuccaagacaugcgcaacacaauaauggcaagcaaaacaguaggcacauccgaggaaaaacucaaaaagaaaucaucauucuaccaauccuacuugagaaggacccaaagcaugggcauacaauuagaccaacgaaucaucguaauguucaugguagccuggggcaaagaagcgguagacaacuuucaccuaggcgacgacauggacccagaacuccgcaaccuagcacaacuacuuauagaccaaaaaguaaaagaaauaucgaaccaagaaccccugaaacucuaa

SEQ ID NO: 8008 - RNA, 1290 nt, Artificial Sequence
  derived and/or modified CDS sequence (opt11) from TULV(Tula/Moravia/5302Ma/94)__NC_005227.2__N
augucccaacucaaagaaauacaagaagaaaucacccgccacgaacaacaaauagucaucgcacgccaaaaacuaaaagacgcagaaaagacagucgaagcagaccccgacgacgucaacaaauccacccuccaaucccgccgggccgcagucucagcccuggaagacaaacucgccgacuucaaacgacagcucgccgaccuagucuccucccagaaaaugggcgaaaaacccgucgaccccacaggacucgaaccagacgaccaccucaaagaacgcuccucccuccgcuacggcaacgugcuagacgucaacgcaauagacaucgacgaacccagcggccaaaccgcagacugguuuuccauaggccaauacauaaccggcuucgcgcucgccaucauccucaaagcauuauacaugcucuccacacgcggacgacaaaccaucaaagaaaacaaaggcacccgcauccgauucaaagacgacuccucauacgaagaaaucaacggaauccgccgacccaaacaccucuacgucagcaugccaaccgcucaauccacaaugaaagcggacgaacucaccccaggccguuuccgcacaaucgugugcggacuauuccccgcccaaaucaugcaccgcaacaucaucagccccguaaugggcgucaucggcuucuccuucuucgucaaagacuggcccgagaaaaucgaagaauuucuaaucaaaccuugccccuuccucaagaaaucaggccccuccaaagaagaagacuuccuagucagcaacgacgcauaccuccuaggacgagaaaaagcccuccgcgaaucacaccucgccgaaauagacgaccuaaucgaccucgccgcauccggagaccccacuccacccgacucuaucaaaagcccccaagcacccuggguguucgcuugccgccccgaccgaugcccacccacaugcaucuacaucgccggcauggccgaacuaggcgccuucuucuccauccuccaagacaugcgcaacaccauaauggccagcaaaacugucggcaccgccgaagaaaaacucaaaaagaaaagcucauucuaccaaucauaccuacgccgaacccaaagcaugggcauccaacuagaccagagaaucauccuucucuucaugaccgaauggggcucagacaucgucaaucacuuccaccugggcgacgacauggaccccgaacuccgcacgcuagcccaaucccuaaucgaccaaaaagucaaagaaaucuccaaccaagaaccccuaaaaauauaa

SEQ ID NO: 8009 - RNA, 1293 nt, Artificial Sequence
  derived and/or modified CDS sequence (opt11) from TULV(D17-98)__AF289820.1__N
augucccaacucaaagaaauccaagaagaaauaacccgccacgaacaacaaauagucaucgcacgccaaaaacucaaagacgccgagaaaaccgucgaagccgaccccgacgacgucaacaaaaguacccuacagucccgccgcgccgcaguaagcgcucucgaagauaagcucgcagacuucaaacgacaacuggcagaccucgucuccucccagaaaaugggcgaaaaacccgucgaccccaccggucucgaacccgacgaccaccucaaagaacgcuccucacuccgauacggcaacguccucgaugucaacgccauagacaucgacgaacccucaggccaaaccgccgauugguucucaaucggccaauacaucauaggcuucgcacuagccaucguccucaaagcccucuauaugcucuccacccgcggacgccaaaccaucaaagaaaacaaaggaacccgcauacgauucaaagacgacucauccuacgaagaaaucaacggcauccgccgccccaaacaccuauacgucucaaugcccaccgcccaauccaccaugaaagccgacgaacugacccccggacgcuuccgcaccaucgucugcggacucuucccagcccaaaucaugcaccgcaacaucaucucacccguuaugggcgucaucggcuucuccuucuucguaaaagacuggcccgacaaaauugaagaguuccuaaucaaacccugcccauuccucaagaaacaaggaggccccaacaaagacgaagaguuccucgucuccuacgacgccuaccuccucggccgcgaaaaagcccuccgagaaucccaccuagccgaaaucgacgaccucaucgaccuagcugccuccggagacccaacgccacccgacuccaucaaauccccacaaggacccugggucuucgccugcgcgcccgaccgaugcccaccaaccugcaucuacgucgcaggcauggccgaacuuggcgccuuuuucuccauacuccaagacaugcgaaacaccaucauggcaucaaaaacagucggcaccgccgaagaaaaacuuaaaaagaaaucaucauucuaccaauccuaccuucgccgcacacaauccaugggaauccaacuagaccaacgcaucauccuucuauucaugauggaauggggcuccgacaucgucaaccacuuccaccucggcgacgacauggaccccgaacuccguacccucgcccaaucgcucaucgaccaaaaagucaaagaaaucuccaaccaagaaccccucaaaaucuaa

SEQ ID NO: 8010 - RNA, 1293 nt, Artificial Sequence
  derived and/or modified CDS sequence (opt11) from TULV(D5-98)__AF289819.1__N
augagccaacucaaagaaauccaagaagaaaucacacgccacgaacaacaaaucguaauagcacgccaaaaacuaaaagacgccgagaaaacagucgaagccgaccccgacgacgucaacaaaagcacccuacaaagccgccgcgcagccgucucugcacucgaagacaaacuagccgacuucaaacgccaacuugcugaccucgucuccucccaaaagaugggcgaaaaacccgucgacccaaccggccucgaacccgacgaccaccucaaagaaagauccucgcuccgcuacggaaacguccuagacguuaacgccauagacaucgacgaacccagcggccaaacggccgacugguucucaauaggccaauacaucaucggcuucgcucucgccaucgucuuaaaagcccuauacaugcucuccacacgaggccgccaaaccauaaaagaaaacaaaggcacacgaauccgcuucaaagacgacagcagcuacgaagaaaucaacggcauccgccgcccaaaacaccucuacgucucaaugcccacagcccaauccacaaugaaagcagacgaacugacccccggccgcuuccgaacaauagucugcggacuauucccagcacaaaucaugcaccgcaacauaaucuccccagucaugggagucaucggcuucucauucuucgucaaagauuggcccgacaaaaucgaagaauuucucauaaaacccugcccauuccuaaagaaacaaggcggucccaacaaagacgaagaguuccucguaagcuacgacgccuaccuacucggccgagaaaaagcccuccgcgaaucccaccuggccgaaauagacgaccucaucgaccucgcagccuccggagaccccacacccccagacucaaucaaaagcccacaagccccaugggucuucgcgugcgcacccgaccgcugcccaccaaccugcaucuacgucgccggaauggccgaacucggcgccuucuucuccauacuacaagauaugcgcaacaccaucauggcauccaaaaccgugggaacagccgaagaaaaacucaaaaagaaauccagcuucuaucaauccuaccuccgcaggacacaaaguaugggcauccaacucgaccagcgaaucauccuacucuucaugauggaauggggcuccgacaucgucaaccacuuccaccucggcgacgacauggaccccgaacugcgcacacucgcucaaucacucaucgaccaaaaagucaaagaaaucuccaaccaagaaccccuaaaaauauaa

SEQ ID NO: 8011 - RNA, 1293 nt, Artificial Sequence
  derived and/or modified CDS sequence (opt11) from TULV(D63-98)__AF289821.1__N
augucccaacucaaggaaauccaagaagaaaucacccgucacgaacaacagaucgucaucgcccgccaaaaacugaaagacgccgaaaaaacagucgaagccgaccccgacgacgucaacaaauccacucuacagucccgccgcgcagccguauccgcacucgaagacaaacuagccgauuucaaacgacaacucgccgaccucguaagcucacagaaaaugggcgaaaaacccgucgaccccaccggccuagaaccagaugaccaccucaaagaacgcuccagccuccgcuacggaaacguacuagacgucaacgccauagacauagacgaacccuccggccaaacagccgacugguucucaaucggccaauacauaauagguuucgcccucgccauuguccuuaaagcccuauacaugcucucaacccguggccgacaaacaaucaaagaaaacaaaggaacccgcauccgcuucaaagacgacucauccuacgaagaaauaaacggcauccgccgccccaaacaccuauacguuagcaugccaaccgcccaaagcaccaugaaagccgacgaacuaaccccaggccgauucagaaccaucguaugcggccuauuuccagcccaaaucaugcaccgcaacaucaucucgcccgucaugggcgucauaggauucuccuucuucguaaaagacuggcccgacaaaaaagaagaguuucuaauaaaaccaugccccuuccugaaaaaacaaggcggacccaacaaagacgaagaauuccucgucuccaacgacgcauaccuccucggacgcgaaaaagcccuccgugaaucccaccucgccgaaauagacgaccucaucgaccucgccgccucaggagacccuacgccucccgacuccaucaaauccccacaaggacccuggguauucgccugcgccccagaccgcugcccccccaccugcaucuacgucgccggcauggcagaacucggcgcauucuucagcauccuccaggacaugcgcaacaccauuauggcuagcaaaaccgucggcacagccgaagaaaaacuaaaaaaaaaauccuccuucuaucaaucguaccuccgccgcacacaauccaugggaauccaacuugaccagcgcaucauccuccuauucaugauggaguggggauccgacaucgucaaccacuuccaccucggcgacgacauggaccccgaacuccguacccucgcccaaucccuaauagaccaaaaagugaaagaaauaucaaaccaagaaccacuaaaaaucuag

SEQ ID NO: 8012 - RNA, 1290 nt, Artificial Sequence
  derived and/or modified CDS sequence (opt11) from TULV(MG23/Omsk)__AF442621.1__N
augucaacccugaaagaaauacaagaagaaaucacacgucacgaacaacaaaucguaaucgccagacaaaaacucaaagacgcagagaaaaccguagaagccgaccccgacgacgucaacaaaaacacccuccaaucacgccgagcggccguaagcacccuagaagacaaacucgccgaauuuaaacgccaacuagcagaccucguauccucccaaaagaugggcgaaaaaccaguagaucccacaggccucgaacccgacgaccaccuaaaagaacgcuccucccuacgcuacggaaacguccuugacgugaacgccacagacaucgacgagccuucaggccaaaccgccgacugguucuccaucggccaauacaucaugggcuuugcccucgcaaucguacucaaggcccucuacaugcucuccacccgcggacgccaaaccaucaaagaaaacaaagguacccgcaucaaguucaaagacgacagcuccaucgaagaaaucaacggcauaagacgacccaaacaccuauacguauccaugcccaccgcccaauccaccaugaaagccgacgagcuaacccccggccgcuuccgaacaaucguaugcggccuguuccccgcccaaauaaugcaccgcaacaucaucuccccugucaugggaguaauuggcuucuccuucuucguaaaagacuggcccgacaaaauagaagaguuccuaaucaaacccugccccuuccucaagaaacaaggaagcaccaaagaagaagaguuccucgucuccaacgacgcguacaugcuaggacgcgaaaaagcacuccgcgaaucccaccucgccgaaauagacgaacucaucgaucucgccgacucgggagaccccacaccacccgacuccauaaaaucuccccaagcccccuggguauucgccugcgcacccgacagaugcccacccacaugcaucuacauagccgggauggccgaacucggcgcuuucuucucgauccuccaagacaugagaaauaccauaauggcaagcaaaaccgucgggacagccgaagaaaaacuuaaaaagaaaagcucauucuaccaauccuaccuccgacgcacccaauccaugggaauccaacucgaccaacgcaucauucuacucuucaugauggaauggggcucagacauagucaaccacuuccaccucggagacgacauggaccccgaacuccgcacucuagcccaaucccucaucgaccaaaaagucaaagaaaucuccaaccaagaaccgcucaaaaucuaa

SEQ ID NO: 8013 - RNA, 1290 nt, Artificial Sequence
  derived and/or modified CDS sequence (opt11) from TULV(c109-s)__AF164094.1__N
augucccaacuaaaagaaauccaagaagaaaucacacgccacgaacagcaaaucgucaucgcccgacaaaaacuaaaagacgcugaaaaaaccgucgaagcggaccccgacgacguaaacaaauccacccuccaaucccgacgcgccgcagucucagcccuugaagacaaacucgccgacuucaaacgccaacucgccgaccucgucucgucacaaaaaaugggugaaaaacccgucgaccccacaggccucgaacccgacgaccaccuuaaagaacgaucaucccuucgcuacggcaacguacucgacgucaacgcaauagacauagacgaacccuccggacaaacagccgacugguucuccaucggccaauacaucacaggcuucgcccuagcaaucauccuaaaagcccucuacaugcucucaaccagaggacgccaaacaauaaaagaaaacaaaggcacccggauccgcuucaaagacgauucauccuacgaagaaaucaacggcauacgacgacccaaacaccucuacguauccaugccaacugcccaauccaccaugaaagcugacgaacuaacaccaggccgauuccgcaccaucgucugcggccuauucccagcccaaaucaugcaccguaacaucaucuccccagucaugggagucauaggauucuccuucuucgucaaagacuggcccgaaaagauugaagaauuccuaaucaaacccugccccuuccuaaaaaaauccggcccuuccaaagaagaagacuuccuagucuccaacgacgcauaccugcucggccgcgagaaagcccuacgcgaaucacaucucgcggaaauagacgaccucaucgaccuugccgccucaggcgaccccacuccccccgacucaaucaagucaccccaagccccaugggucuucgcaugcgcccccgaccgcugcccacccaccugcaucuacaucgcaggaauggccgaacuaggcgccuucuucuccauacuacaagacaugcgaaauaccaucauggccuccaaaacagucggcacauccgaagaaaaacucaaaaaaaaauccagcuucuaccaauccuaccuacgccgaacccaauccaugggcauccaacuagaccaaagaaucauacuacucuucaugaccgaauggggcuccgacaucgucaaccacuuccaccuaggggacgacauggacccagagcuccgaacgcuugcacagucccucaucgaucaaaaagucaaagaaaucuccaaccaagaaccccuaaaaaucuaa

SEQ ID NO: 8014 - RNA, 1290 nt, Artificial Sequence
  derived and/or modified CDS sequence (opt11) from TULV(CHEVRU/Hu/FRA/2015/15.00453)__KT946591.1__N
augucacaacucaaagaaauccaagaagaaauaacccgccacgaacaacaaauagucauagcccgccaaaaacucaaagacgccgaaaagaccguugaagccgaccccgacgacgucaacaaauccacccuccagucacgacaagcagcagucuccgcccucgaagauaaacucgccgacuucaaacgcaaacuagccgaccucgucuccagccagaaaaugggcgaaaaacccgucgacccaaccggccuagaacccgacgaccaccuaaaagaacgcuccucucuccgauacggcaacguccucgaugucaacgccauagacauagacgaacccucaggacaaacagcagacugguucuccaucggccaauacgucaugggauucgcccuggccaucauccuaaaagcacuauacaugcucucgacucgcggccgccaaacaaucaaagaaaacaaaggcacucgcauccgcuucaaagacgacagcucauacgaagaaaucaacggaauccgccgccccaaacaccuauacgucagcaugccaaccgcccaaucaaccaugaaagcagacgaacucaccccaggcagauuccgcaccaucgucugcggccuauucccagcccaaaucaugcaccgcaacaucaucagccccgucaugggcgucaucggcuucucuuucuucguaaaagacuggcccgagaaaaucgaagaauuucucaucaaaccaugcccauuccucaagaaauccggccccuccaaagaagaagacuuccucguaagcaacgacgccuaccuccucggccgcgaaaaagcccuccgagacucacaccuagccgaaaucgacgaccuaaucgaccucgcagaaucaggcgacccuacaccacccgacucaaucaaaagcccccaagcccccuggguauucgccugcgccccagacagaugcccaccaaccugcaucuacaucgccggcauggccgaacuaggcgccuucuucuccauccuccaagacaugcgcaacaccauaauggcaagcaaaacagucggcacagccgaagaaaaacugaaaaagaaauccuccuucuaccaaucauaccuccgacgcacccaaucgaugggaauacaacuagaccaacgcaucauacuacucuucaugauagaauggggcuccgacaucguaaaccacuuccaccucggcgacgacauggaccccgaacuccgcacccuggcucaaucccuaaucgaccaaaaagucaaagaaaucuccaaccaagaaccccucaaaaucuag

SEQ ID NO: 8015 - RNA, 1290 nt, Artificial Sequence
  derived and/or modified CDS sequence (opt11) from TULV(g20-s)__AF164093.1__N
augucccaacucaaagaaauacaagaagaaaucacccgccacgaacaacaaaucgugaucgcacgccaaaaacucaaagacgcggagaaaaccguugaagcagaccccgacgacgucaacaaaagcacccuacaaucccgccaagccgccguaagcgcccuugaagacaaacuagcagacuuuaaacgaaaacucgcagaccucgucagcucacaaaagaugggagaaaaacccgucgaccccaccggacucgaacccgacgaccaccucaaagaacgaucaucacuccgcuacggcaacguucuagacgucaacgccaucgacaucgacgaacccuccggacaaaccgccgacugguucuccaucggccaauacgucauggguuucgcccucgccaucauccuaaaagcccuguacaugcuguccacacgaggccgccaaacaaucaaagaaaacaagggcacacgcauucgauucaaagaugacuccuccuacgaagaaauaaacggcauacgacgacccaaacaucuauacguauccaugccaacugcacaauccaccaugaaagcugacgaacucacccccggccguuuccgcaccaucguaugcggacucuucccagcucaaaucaugcaccgcaacaucauaucacccgucaugggcgucaucggcuuuagcuucuucguuaaagacuggccagaaaagauagaagaguuccucaucaaaccaugcccauuccuaaagaaaucaggccccucaaaagaagaagacuuccucgucuccaacgacgccuaccuucucggccgagaaaaagcccuccgcgacagccaccuugccgaaaucgacgaccuaauagaccucgccgaaucaggagacccaacaccacccgacuccaucaaaagcccccaagcccccugggucuucgccugcgcccccgauagaugcccuccuaccugcauauacaucgcaggcauggccgaacucggcgccuucuucuccauccuccaagacaugcgcaacaccaucauggcuuccaaaaccgucggcaccgcagaagaaaaacucaaaaagaaaagcucauucuaccaauccuaccucagacgcacccaaucaaugggcauccaacucgaccaacgaaucauccuccuauucaugaccgaauggggcuccgacaucgucaaccacuuccaccucggagacgacauggaccccgaacuccgcacccuggcccaaucccugauagaccaaaaaguaaaagaaaucagcaaccaagaaccccuaaaaauauga

SEQ ID NO: 8016 - RNA, 1293 nt, Artificial Sequence
  derived and/or modified CDS sequence (opt11) from TULV(Sennickerode Sen05/174)__EU439948.1__N
augucccaacucaaagaaauccaagaagaaaucacccgccacgaacaacaaaucguaauagcacgccaaaaacuaaaagacgccgaaaagaccgucgaagcagacccagacgacguuaacaaauccacccuccaaagccgacgcgccgcagucuccgcccuggaagacaaacucgccgacuucaaacgccaacuggccgaccucgucuccucccagaaaaugggcgaaaaaccaguagaccccaccggccucgaacccgacgaccaccucaaagaacgcuccucgcuccgcuacggcaacguacucgacguaaacgccaucgacauagacgaaccauccggucaaaccgccgacugguucucaaucggacaauacaucaucggcuucgcccuagccauaguacucaaagcacucuacaugcuauccacgcgcggcagacaaacaauaaaagaaaacaaagguacacgaauccgauucaaagacgacuccucuuucgaagaaauaaauggaauccgcagacccaaacaccucuacgucucaaugcccacagcacaaucaaccaugaaagcagacgaacucaccccagggcgcuucagaacaaucgucugcggacucuucccagcacaaaucaugcacagaaacaucaucuccccaguaaugggcguaaucggauucagcuucuucgucaaagacuggcccgacaaaaucgaagaauuucuaaucaaacccugcccauuccucaagaaacaaggcggcccaaacaaagacgaagacuuccuaguaucaaacgacgccuacuuccuuggccgcgaaaaagcacuacgcgaaagccaccucaacgaaaucgacgaccuaaucgaacuagccgccucgggcgaccccaccccacccgacagcaucaaaucaccccaagcccccugggucuucgccugcgcacccgaccgcugcccacccacuugcaucuacguagcaggcauggccgaacucggagccuucuucuccauccuccaagacaugcgcaacacaaucauggccuccaaaaccguaggaaccgccgaagaaaaacuaaagaagaaauccucauucuaccaaagcuaucuccgccgcacccaaucaaugggcauacaacuugaccaacgcaucauccuccuauucaugauggaauggggcuccgacaucguaaaccacuuccaccucggcgacgacauggacccagaacuucgcacacuugcccaaucccugaucgaccaaaaaguaaaagaaaucagcaaccaagaaccacucaaaaucuaa

SEQ ID NO: 8017 - RNA, 1293 nt, Artificial Sequence
  derived and/or modified CDS sequence (opt11) from TULV(Sennickerode Sen05/175)__EU439949.1__N
augucgcaacucaaagaaauacaagaagaaaucacccgccacgaacaacaaauaguuaucgcccgccaaaaauuaaaagacgccgagaaaaccgucgaagccgaccccgacgacgucaacaaauccacccuacaaucacgccgcgcagcagucuccgcacucgaagacaaacucgcugacuucaaacgccaacuagcugaccucgucucaucccagaaaaugggcgaaaaaccagucgaccccaccggccuagaaccagacgaccaccucaaagaacgaagcucccuacgcuacggcaacguccuagacguaaacgcaauugacaucgacgaacccuccggacaaacagcagacugguucucgaucggccaauacaucauaggcuucgcacuagcaaucguccucaaagcccucuacaugcucagcacccgcggccgccaaaccaucaaagaaaacaaaggcacccgaauccgcuucaaagacgacuccuccuucgaagaaaucaacggcauccgccgccccaaacaccucuacgucagcaugccaacagcacaauccaccaugaaagccgaugaacuaaccccaggacgcuuccguaccaucguaugcggacuauucccagcccaaaucaugcacagaaacaucaucucucccguaaugggggucaucggauucuccuucuucgucaaagacuggcccgacaaaaucgaagaguuccucaucaaacccugccccuuccuaaagaaacaaggcggccccaacaaagacgaagacuuccucgucuccaacgacgcguacuuccucggccgagaaaaagcccuccgagaaucacaccuaaacgaaaucgacgaccugaucgaacuagcagcauccggcgaccccaccccacccgacucaauuaaaucaccccaagcacccugggucuucgcaugcgcccccgaccgcugcccacccacaugcauauacguagccggcauggccgaacucggagccuucuucuccauccuccaagacaugcgaaaauccaucauggccuccaaaaccgucggcaccgcggaagaaaaacuaaagaagaaaagcucauucuaccaaagcuaccuacgccggacccaaagcaugggcauccaacucgaccaacgaaucauccuccuauucaugauggaauggggcuccgacaucgucaaccacuuccaccucggagacgacauggaccccgagcuccgaacccucgcacaaucgcucaucgaccaaaaaguaaaagaaauauccaaccaagaaccccucaaaaucuaa

SEQ ID NO: 8018 - RNA, 1293 nt, Artificial Sequence
  derived and/or modified CDS sequence (opt11) from TULV(TUL/Karatal/Ma322/2003)__AM945877.1__N
augucccaacucaaagagauccaagaagaaaucaccagacacgaacaacaaauagucaucgcccgacaaaaacuaaaagacgccgaaaaaacugucgaagccgacccagacgacguaaacaaaaacacacuacaaucaagacgcgccgcagucuccgcccucgaagacaaacucgccgaauucaaacgccaacuagccgaccuaguaucaucccaaaaaaugggcgaaaagcccguagaccccacaggccucgaacccgacgaccaccuaaaggaacgcuccucacuccgauacggcaacguccucgacgucaacgccauugacaucgacgaacccuccggacaaaccgcagacugguucuccaucggccaauacgucauggguuucgcccuagccaucgucuuaaaagcccuauacaugcucagcacccgcggccgccaaacuaucaaagaaaacaaaggcacccgaaucagauucaaggacgacuccagcuucgaagaaaucaacggcauccgccgccccaaacaccuuuacguauccaugcccaccgcccaaagcacaaugaaagccgacgaacuaacacccggacgcuuccgcaccaucgucugcgggcuauucccagcccaaaucaugcacagaaacaucaucucccccgucaugggcgucaucggcuucuccuucuucgucaaagacuggcccgaaaaaaucgaagaauuccuuaucaaaccaugcccauuccucaaaaagcaaggaucaucaggcaaagaagaggaauuccuagucuccaacgacgccuaccuaaucggccgcgagaaaacccuucaagaaucccaccucacugaaaucgacgaccucauagaccuagcagacuccggcgaccccacaccccccgacuccaucaaaagcccccaagcccccugggucuucgcaugcgcacccgaccgaugcccacccacaugcaucuacauagcuggcauggcagaacuaggagccuucuucuccauacuccaagacaugcgcaacacuaucauggccagcaaaaccgucgguacagccgaagaaaaacugaaaaaaaaauccuccuucuaccaaagcuaccuccgccgaacccaaucaaugggcauccaacucgaccaaagaaucauccuacuauucaugauggaauggggcucagacaucguaaaccacuuccaccucggcgacgacauggaccccgaacuccgaacccucgcccaaucacucaucgaccaaaaaguaaaagaaaucucgaaccaagaaccacucaaaauauag

SEQ ID NO: 8019 - RNA, 1293 nt, Artificial Sequence
  derived and/or modified CDS sequence (opt11) from TULV(Tula/Kosice144/Ma/95)__Y13979.1__N
augucacaacucaaagaaauccaagaagaaaucaccagacacgaacaacagaucgucauagcccgccaaaaacucaaagaugcagagaaaaccguagaagccgaucccgacgacguaaacaaaucuacccuccaaagccgccgcgccgccgucuccgcccucgaagacaaacuagccgacuucaaacgucaacucgccgaccucgucagcucccagaaaaugggcgaaaaaccaguagaccccacaggccuugaacccgacgaccaccuaaaagaacguuccucccuccgcuacggcaacguccuugacguaaacgccaucgacaucgacgaaccauccggccaaaccgccgacugguucuccauaggacaauacaucaucggcuucgcccucgccaucguacuaaaagcccuuuacaugcucucaacccggggccgccaaacaaucaaagaaaauaaaggcacucgcauccgauucaaagacgacagcuccuucgaagaaaucaacggcauccgccgacccaaacaccucuacgucucaaugccgaccgcccaaucgaccaugaaagccgacgaacucaccccaggccgauuccgcaccaucgucugcggccucuuccccgcacaaaucaugcaccgaaacaucaucuccccaguaauggguguaaucggcuucagcuucuucguaaaagacuggcccgagaaaauagaagaguuccucaucaaacccugccccuuccuaaagaaacaaggcgccccaggcaaagaagaagacuuccucgucagcaacgacgccuaccuacucggacgcgaaaaagcccuccgagaaucacaccucgccgaaauagacgaccucaucgaccucgccgcaucaggcgaccccaccccucccgacuccaucaaaucaccccaagccccaugggucuucgccugcgcccccgaccgcugcccacccacaugcaucuauaucgccggcauggcggaacuuggagcauucuucucaauccuccaagacaugcgcaacaccaucauggccagcaaaacagucggcaccgcggaagaaaagcucaagaagaaauccucauucuaccaaucauaccuccgccgaacccaaucaaugggaauccaacuagaccagcgaaucauacuccuauucaugacagaauggggauccgacaucguaaaccacuuccaccucggcgaugacauggaccccgaacuacgcacacuggcccaaucccucaucgaccaaaaagucaaagaaauaucgaaccaagaaccccucaaaaucuaa

SEQ ID NO: 8020 - RNA, 1293 nt, Artificial Sequence
  derived and/or modified CDS sequence (opt11) from TULV(Tula/Kosice667/Ma/95)__Y13980.1__N
augucccaacucaaagaaauccaagaagaaaucacccgccacgaacaacaaauagucaucgcccgccaaaaacucaaagacgccgaaaagacgguagaagccgaccccgacgacgucaacaaauccacccuccaaucccgacgcgccgcaguuucagcccuugaagacaaacucgcagacuucaaaagacaacuagccgaccucguauccagccagaaaaugggcgaaaaacccgucgaccccaccggccucgaacccgacgaccaccuuaaagaacgcuccucacuccgcuacggcaacguacuagacguuaacgccauugacaucgacgaacccucaggccaaacagccgacugguucucaaucggccaauacauaaucggcuucgcccucgccauaguccuaaaagcccucuacaugcucuccacccgaggacgacaaaccaucaaagaaaacaaaggcacccgcauccgguucaaagacgacucauccuucgaagaaaucaacggcauccgacgccccaaacaucucuacgucuccaugcccaccgcacaaucuaccaugaaagccgacgaacuaacacccggccgcuuccgcaccaucguaugcgguuuauuccccgcccaaaucaugcaccgaaacauaaucucacccgucaugggcgugaucggcuucuccuucuucguaaaagacuggcccgagaaaaucgaagaguuccuaaucaaacccugccccuuccucaagaaacaaggcgcccccggcaaagaagaagacuuccucgucuccaacgacgcauaccuccugggccgggaaaaagcccuacgcgaaucccaccuagccgaaauugacgaccucauagaccuagcugccuccggcgacccaaccccucccgacucaaucaaaucuccccaagcccccuggguauucgccugcgcccccgaucgcugcccaccaaccugcaucuacaucgccggaauggccgaacucggagccuucuucuccauacuacaagacaugcgcgacacaaucauggccuccaaaacagucggcaccgcagaagaaaaacucaagaagaaauccucauucuaccaauccuaccuaagacgcacccaaucaaugggcauacaacucgaccaacgcaucauccuccuauucaugaccgaauggggcuccgauaucguaaaccacuuccaccucggcgacgacauggaccccgaacuccgaacccuugcacaaucacucauagaccaaaaagucaaagaaaucucaaaccaagaaccccucaaaaucuag

SEQ ID NO: 8021 - RNA, 1290 nt, Artificial Sequence
  derived and/or modified CDS sequence (opt11) from TULV(Tula/Koziky/5247Ma/94)__AJ223600.1__N
augucccaacucaaagaaauacaagaagaaaucacccgccacgaacaacaaauaguaaucgcccgccaaaaacuaaaagacgccgagaaaaccgucgaagcagaccccgacgacguaaacaaauccacacuacaaucccgccgcgccgccgucuccgcccuagaagacaaacucgccgacuucaaacgccaacuagccgaccuugucuccucccagaaaaugggcgaaaaacccgucgaccccaccggccucgaaccagacgaccaccugaaagagcgcucgucccuccgcuacggcaacguacucgacguaaacgccaucgacauagacgaaccaagcggacaaacagccgacugguucagcaucggacaauacauaacaggcuucgcccucgccaucauacuaaaagcccuauacaugcucucaacccgaggccgccaaacaaucaaagaaaacaaaggcacccgaauccgcuucaaagacgacuccucauacgaagaaaucaacggcauccgacgacccaagcaccucuacgucucuaugcccacagcccaauccaccaugaaagccgaugaacucacacccggccgauuccgcaccauagucugcggccucuuccccgcccaaaucaugcaccgcaacaucaucucccccguaaugggcguaaucgguuucucuuucuucguaaaggacuggccagagaaaaucgaagaguuccucauuaaaccaugccccuuccucaaaaagaacggacccuccaaagaagaagacuuccuagucagcaacgacgccuacuuacucggccgcgaaaaagcccuucgcgaaucccaccucgccgaaaucgacgaccugaucgaccucgccgccuccgaagaccccacacccccagacucaauaaaaucaccacaagcacccugggucuuugccugccgacccgaccgaugcccaccgaccugcaucuacaucgccggaauggcagaacucggcgccuucuucuccauccuccaagacaugcgcaacaccauaauggccuccaaaacaguaggcaccgccgaagaaaaacuaaagaagaaauccuccuucuaccaauccuaccuacgaagaacccaguccaugggaauccaacucgaccagcgcaucauccuccuauucaugaccgaauggggcucagacaucgucaaccauuuucaccugggcgacgacaugucccccgaacuucgcacccucgcacaaucccucaucgaccaaaaagucaaagagaucuccaaccaagaaccccucaaaauauag

SEQ ID NO: 8022 - RNA, 1290 nt, Artificial Sequence
  derived and/or modified CDS sequence (opt11) from TULV(Tula/Moravia/5302v/95)__Z69991.1__N
augucccaacucaaagaaauacaagaagaaaucacccgccacgaacagcaaaucgucauagcaagacaaaaacucaaagacgucgagaaaacagucgaagcagacccagacgacgucaacaaaucaacacuccaaucccgccgagcggccgucagcgcacuugaagacaaacuggcagacuucaaacgccagcucgccgaccuagucucgagccagaaaaugggcgaaaaacccgucgaccccaccggacucgaaccugacgaccaccugaaagaacgcuccucacuacgcuacggcaacguccuggacgucaaugccaucgacaucgacgaacccagcggccaaacagccgacugguucucaaucggccaauacaucaccggauucgcccuagccaucauccucaaagcccucuacaugcucuccacacgaggacggcaaaccauaaaagaaaacaaaggcacacgcaucagauucaaagacgacucaagcuacgaagaaauaaacggcaucagacgaccaaaacaccucuacgucuccaugccaaccgcacaauccacaaugaaagccgacgaacucacuccaggucgauuccgcacaaucgucugcggacuauucccagcacaaaucauguaccgaaacaucaucagcccaguaaugggagucaucggcuuuucauuuuucgucaaagacuggccagagaaaaucgaagaauuuuugauaaaaccaugccccuuccucaagaaaucaggccccuccaaagaagaagacuuccucguaagcaacgacgcauacuuacuaggccgcgaaaaagcccuccgagaaucccaccuugccgaaaucgacgaccucaucgaccucgccgcaagcggagaccccaccccgcccgacuccaucaaaagcccccaagcccccugggucuucgcaugccgcccagaccgaugcccacccacgugcaucuacaucgccggcauggcagaacugggagccuucuucuccauccuccaagacaugcgcaacacaauaauggccuccaaaaccgucggcaccgcagaagaaaaacuuaaaaagaaaagcucauucuaccaaucauaccuaaggcgcacccaaagcaugggaauacaacucgaccaacgcaucauacuccucuucaugaccgaauggggcuccgacaucgucaaccacuuccaccuaggagacgacauggaccccgaacuccgcacccucgcccaaagccugaucgaccaaaaagucaaagaaauaucaaaccaagaaccccuuaaaaucuaa

SEQ ID NO: 8023 - RNA, 1293 nt, Artificial Sequence
  derived and/or modified CDS sequence (opt11) from TULV__AF017659.1__N
augagccaacucaaagaaauacaagaagaaauaacccgccacgaacaacaaauaguuaucgcacgccaaaaacucaaagacgcagaaaagaccgucgaagcagaccccgacgacgucaacaaauccacacuccaaagccgacgagccgcagucuccgcacuugaagacaaacuagccgacuucaaacgccaacucgccgaccucguaucaucccaaaagaugggcgaaaaacccguagacccaacaggccucgaacccgacgaccaccuaaaagaacgcuccucccuaagauacgguaacguccucgacgucaacgcaaucgacaucgacgaacccucaggccaaaccgccgacugguuuuccaucggucaauacauuaucggcuucgcccucgcaaucguccuaaaagcccuauacaugcucuccacacgcggccgccaaaccaucaaagaaaauaaaggcacacgcauacgcuucaaagacgacucauccuucgaagaaaucaacggcaucagacggcccaaacaccucuacgucagcaugcccaccgcacaaucaaccaugaaagccgacgaacucacacccggccgauuccgcacaaucguaugcggccuguucccggcccagaucaugcaccguaacaucaucucaccgguaaugggggucauaggcuucagcuucuucgucaaagacuggcccgagaaaauagaagaguuccuuauaaaaccaugccccuuccucaagaaacaaggagcccccggaaaagaagaagauuuccuggucagcaacgacgccuaucuccucggccgcgaaaaagcccuccgagaaucccaccucgccgaaaucgacgaccucaucgaccucgccgccucaggcgacccaacaccaccagacagcauaaaauccccacaagcccccugggucuucgccugcgcucccgaccgaugcccuccaaccugcaucuacgucgccggcauggcagaacuaggcgcauucuucuccauacuccaagacaugcgcaacaccauaauggccucuaaaaccguaggcaccgccgaagaaaaacucaaaaagaaaucauccuucuaccaaucauaccuccgccgaacccaauccaugggcauccaacucgaccaacgcaucauccuccucuucaugaccgaauggggcucugacaucgugaaccacuuccaccucggcgacgacauggaccccgaacuccgaacccuagcccagucccucaucgaccaaaaagucaaagaaaucuccaaccaagaaccacuaaagauauag

SEQ ID NO: 8024 - RNA, 1293 nt, Artificial Sequence
  derived and/or modified CDS sequence (opt11) from TULV(Lodz-1)__AF063892.1__N
augaccgaacucaaagaaauacaagaggaaaucacccgccacgaacaacaaaucgucaucgccagacaaaaacucaaagacgcagagaaaaccgucgaagccgaccccgacgacguaaacaaauccacccuccaaucacgccgcgccgccguauccgcccucgaagacaaacucgccgacuucaaacgccaacucgcugaccucgucuccucccagaaaaugggcgaaaaaccagucgacccaaccggacucgaacccgaugaccaccucaaagaacgcuccucucuccguuacggcaacguccucgacgucaacgccauagacaucgaugaacccuccggccaaaccgccgacugguucuccaucggacaauacaucaugggcuucgcacuggccaucguccucaaagcccuuuacauguuauccacacgcggacgccaaaccauaaaagagaacaaaggaacccgcauccgcuucaaagacgacuccagcuacgaagaaauaaacggcauccgccgccccaaacaccucuacgucuccaugcccaccgcccaauccacuaugaaggccgacgaacucaccccaggccgcuuccggaccaucguaugcggacucuuccccgcccagaucaugcaccgcaacaucaucucccccgucaugggcguaaucggcuucagcuuuuucgucaaagacuggcccgacaaaaucgaagaguuccuaaucaaacccugccccuuccuaaagaaacaaggcggcccaaauaaagacgaagaguuccucguaagcaacgacgccuaccuacucgggcgugaaaaagcccucagagaaucacaccucgcggaaaucgacgaccuaaucgaccucgcggccuccggcgacccaacacccccugacucaaucaaauccccacaagcacccugggucuucgccugcgccccagaccgcugcccaccaaccugcaucuacgucgccggaauggccgaacuaggagcauucuucuccauccuccaagacaugcgcaacaccaucauggccagcaaaaccgucggcaccgcagaagaaaaacuaaagaagaaaagcucauucuaccaauccuaccuacgccgaacccaaagcaugggaauccaacucgaccagcgcauaauauuacuauucaugauggaauggggauccgacaucguaaaccacuuucaccucggcgacgacauggaccccgaacuucgaacccucgcacagucacucauagaccaaaaaguaaaagaaauaucaaaccaagaaccccucaaaauauaa

SEQ ID NO: 8025 - RNA, 1293 nt, Artificial Sequence
  derived and/or modified CDS sequence (opt11) from TULV(Lodz-2)__AF063897.1__N
augacugaacuuaaagaaauacaagaagaaaucacccgccacgaacaacaaauagucaucgcgcgccaaaaacucaaagacgccgagaaaaccgucgaagcagaccccgacgacguaaacaaaagcaccuuacaaucacgcugggccgcagucuccgcccuagaagacaaacucgccgacuucaaacgccagcuagccgaccuagucagcucccagaaaaugggcgaaaagccaguagacccaaccggccucgaacccgacgaccaccuuaaggaacgcuccucacuccgauacggcaacguccucgacgucaacgccaucgacauagacgaaccaucuggccaaacagccgacugguucuccauaggccaauacaucaugggcuucgcacucgcaauaguacucaaagcccucuacaugcuauccacacgcggccgccaaacgaucaaagaaaacaaaggaacgcgcauccgauucaaagacgacagcuccuacgaagaaaucaacggcauccgacgacccaaacaccucuacgucuccaugcccacagcacaauccaccaugaaagcagacgaacucacccccggcagauuccgaacaaucgucugcggacucuuccccgcccaaaucaugcaccgcaacauaaucucccccgucaugggcgucaucggauucagcuucuucgucaaagacuggcccgacaaaaucgaagaguuccucaucaaaccaugccccuuccuaaagaaacaaggcgggcccaacaaagacgaagaguuccuagucaguaacgacgccuaccuucuuggacgagaaaaagcacuacgcgaaucucaccuggcagaaauagacgaccuaauugaccucgccgccucaggcgacccuacaccgcccgacuccaucaaauccccacaagccccaugggucuucgccugcgcgccggaccgcugcccacccacaugcaucuacgucgccggaauggcagaacucggcgcauucuucuccauacuccaagacaugcgcaacaccauaauggccucaaaaaccguaggcaccgccgaagaaaaacucaaaaagaaauccagcuucuaccaauccuaccuccgccgcacacaauccaugggcauccaacuagaccaacgcaucauccuccucuucaugauggaauggggcucagacaucgucaaccacuuccaccuaggagacgacauggaccccgaacuacgaacacucgcccaaucccuaauagaccaaaaaguaaaagaaauaucaaaccaagaaccccucaaaauauaa

SEQ ID NO: 8026 - RNA, 1449 nt, Artificial Sequence
  derived and/or modified CDS sequence (opt11) from CCHFV(IbAr10200)__NC_005302.1/U88410.1__N
auggaaaacaaaaucgaagugaacaacaaagacgaaaugaaccgcugguucgaagaguucaagaaaggaaacggacuuguagacaccuucacaaacuccuacagcuucugcgaaucaguaccaaaccuagaccgauucgucuuccaaauggccagcgccacagacgacgcgcaaaaagacucaauauacgccucggcccuagucgaagccaccaaauucugcgcgcccaucuacgaaugcgccuggguauccucaacagggaucgugaagaaaggccuagaaugguucgagaaaaacgccggaaccauaaaaagcugggacgaauccuacacagaauuaaaaguagacguacccaaaaucgaacaacuaaccggcuaccaacaagccgcccugaaauggcgaaaagacauaggcuuccgaguaaacgcaaacacagcagcgcucuccaacaaaguccuagcagaauacaaaguccccggcgaaaucguaaugucggucaaggaaaugcuauccgacaugauccgacgcagaaaccuaauccucaaccgcggaggcgacgaaaacccacgcggaccagucucccacgaacaugucgacuggugucgcgaguucgucaaaggcaaauacaucauggccuucaauccgccguggggcgacaucaacaaaagcggcagaagcggaaucgcccucgucgccaccggacucgccaagcuagcagaaacggaaggcaaaggcaucuucgacgaagccaagaaaacaguagaagcccuaaacggcuaccuagacaaacacaaggacgaaguagaccgcgcgagcgcagacuccaugauaacaaaccuccucaaacacauagccaaagcacaagaacucuacaaaaacagcagcgcccuccgagcacaaucagcccaaaucgacaccgcauucuccagcuacuacuggcuauacaaggcaggcguuacccccgaaaccuucccaaccgucagccaauuccucuucgaacucggcaaacaaccccggggcacgaaaaagaugaagaaagcgcuccucuccacaccaaugaaauggggaaagaaacuauacgaacuauucgccgacgacucguuccaacaaaaccguaucuacaugcaccccgcaguccucaccgccgggcgcaucuccgaaaugggaguaugcuucggcacaauccccgucgcaaaccccgacgacgccgcacaaggaucaggacacaccaaaagcauacucaaccucagaaccaacaccgaaaccaacaacccaugcgccaaaacaaucguaaaacuuuucgaaguccagaaaaccggcuucaacauccaagacauggacaucgucgcuuccgaacaccuccuacaccagagccucgucgggaaacaaagcccguuccaaaacgcguacaacguaaaaggcaacgcaacaucagccaacauaaucuaa

SEQ ID NO: 8027 - RNA, 1449 nt, Artificial Sequence
  derived and/or modified CDS sequence (opt11) from CCHFV(Turkey-Kelkit06)__GQ337053.1__N
auggaaaacaaaauagaaguaaacuccaaagacgaaaugaacaaaugguucgaagaguucaagaaaggcaacggacucauggacacauucacaaacucguacucauucugcgaaaacguaccaaaccuagacaaauucgucuuccaaauggcaagcgcaaccgacgacgcccagaaagacucaaucuacgccucagccuuagucgaagcaaccaaauucugcgcacccaucuacgaaugcgccugggucagcucaaccggcauagucaagaaaggccucgaaugguucgaaaaagacagcgggaccaucaaaagcugggacgaaaacuacgccgaacugaaaguggacguccccaaaauagaacaacucgcuaacuaccaacaagccgcacuaaaauggcgcaaagacaucgguuuccgcgugaacgccaacacagccgcccucucaaacaaaguccuggcagaauacaaagucccgggcgagauaguaauguccgucaaagaaaugcucuccgacaugauccgacgcagaaaccuaauccugaaccgcggaggagacgaaaacccccgaggacccgugagcagagagcacgucgaauggugccgcgaguucguaaaaggcaaguacaucauggcauucaaucccccuuggggcgacaucaacaaaucgggcagaagcgggaucgcccucgucgccaccggccucgccaaacucgccgaaacagaaggcaaggggguuuucgacgaagccaagaaaacagucgaagcccugaacggguaccucgacaaacacagagacgaaguagacaaagccagcgccgacucaaugaucaccaaccuccccaaacacauugccaaagcgcaagaacucuacaaaaacagcagugcccuccgcgcccaaggcgcccaaauagacacaccauucagcagcuucuacuggcuguacaaagcgggugucacaccggaaacauuccccaccaucucacaguuccucuuugaacuaggcgagcaaccacgcggcaccaagaaaaugaagaaagcacuccucagcacaccaaugaaauggggcaagaaacucuacgaacuauucgccgacgacuccuuccaacaaaaccggaucuacaugcacccagccguacucacagcaggacgcauaagcgaaaugggggucugcuucgggacaauaccuguggcaaaccccgacgacgccgcccaaggcucaggccacaccaaaagcauccuaaaccucaggacauccaccgaaaccaauaacccaugcgcaaaaacaaucgucaaacuauucgaaauccaagaaacaggcuucaauauucaagacauggacauaguggccagcgaacaccuacuucaccaaagcauaguuggcaaacaauccccuuuccagaacgcguacaacgucaaaggaaacgcaacguccgcaaacaucauauga

SEQ ID NO: 8028 - RNA, 1449 nt, Artificial Sequence
  derived and/or modified CDS sequence (opt11) from CCHFV(Baghdad 12)__AJ538196.1__N
auggaaaacaaaauagaggucaacuccaaagacgaaaugaauaaaugguucgaagaguucaagaaaggcaacggccuagucgacacauacaccaacucguacagcuucugcgaaucagugccgaaccucgaccgcuucgucuuccaaauggcaggagccacagacgaugcccaaaaagacagcaucuacgccuccgcccucgucgaagccaccaaauucugcgcaccgauuuacgaaugcgccugggccagcucaaccggcaucguaaagaaaggccuagaaugguucgagaaaaacaccggcaccauaaaauccugggaugaaucauacacggaacuaaaaguggaaguccccaaaaucgaacaacuguucaacuaccaacaagcggcacucaaauggcggaaagacaucggcuuccgagucaacgccaacacagccgcccuauccaacaaaguccuggccgaauacaaagucccaggcgaaauagugauguccgucaaagaaaugcuuuccgacaugauaagacgacgcaaccuaauacuaaaccgcggcggugacgaaaacccacgaggaccagucagccgagaacacgucgaauggugccgcgaguucgucaaaggcaaauacauaauggcauucaacccacccuggggcgacauaaacaaaucaggccgaucagguaucgcacucgucgcaacaggacuagcaaaacucgcagaaaccgaagggaaaggcgucuucgacgaagccaagaaaaccgucgaagcacuaaacggguaccuagacaaacacaaagacgaagucgacaaagccucagcagacaacauggucaccaaccuacucaaacacguagccaaagcccaggaacucuacaaaaacuccagcgcucuacgagcccaaggggcccaaaucgacaccguauucagcagcuacuacuggcucuacaaagccggcguaacccccgaaaccuuccccaccguaucccaauuccuauucgagcucggcaaacaccccagaggcaccaaaaagaugaagaaagcccuacucagcaccccaaugaaauggggcaagaaacucuacgaacucuucgcagacgacagcuuccaacaaaaccgaauauacaugcaccccgcgguacucaccgcgggccgaaucagcgaaaugggcgucugcuucggaaccauccccguagcaaaccccgacgacgcagcgcucggcucaggccacaccaagagcauccucaaccuccgcaccaacaccgagaccaacaacccaugcgcccgcacgaucguaaaacucuucgaaauacagaaaaccggcuucaacauccaacacauggacauagucgccagcgaacaccuccugcaccaaucccuaguaggaaaacagagcccguuccaaaacgcauacaacgucaaaggcaacgcaacauccgccaacauaaucuaa

SEQ ID NO: 8029 - RNA, 1449 nt, Artificial Sequence
  derived and/or modified CDS sequence (opt11) from CCHFV(SR3)__AJ538198.1__N
auggaaaacaaaauagaagucaacuccaaagacgaaaugaacaaaugguucgaagaguucaagaaaggcaacggacucgucgacacauucacaaacuccuacuccuucugcgaaucuguccccaaccuagaccgcuucguauuccaaauggcuagcgcaaccgacgacgcccaaaaagacuccauauacgccuccgcccucgucgaagccaccaaauucugugcgccaauauacgaaugcgccugggcaagcuccacagggauugucaagaaaggccuagaaugguucgagaaaaacgccggaacuaucaaaucgugggacgaaucauacaccgaacugaaagucgaagugcccaaaaucgaacaacucucuaacuaccagcaagccgcccuaaaauggcgcaaagacauaggcuuccggguaaacgccaacaccgccgcccucuccaacaaagugcucgccgaauacaagguacccggcgagaucgucaugucagucaaagaaaugcuauccgacaugaucagacgaagaaaccucauccugaacagaggcggagacgaaaacccccgagggccaguaagccgagaacacguugaauggugccgcgaguucguaaaaggaaaauacaucauggccuucaauccgcccuggggagacaucaacaaaucgggccgcagcggcaucgcccucguggcuaccggacucgccaaacucgccgaaaccgagggcaaaggagucuucgacgaagccaagaaaacaguagaagcccucaacggguaccuggacaaacacaaagacgaagucgacaaagcuagcgcagacuccaugauaaccaaccuacucaaacacaucgccaaagcccaagaacuauacaaaaacagcucggcccuacgcgcccagggcgcccaaaucgacacagucuucuccuccuacuacuggcucuacaaagccggcgucaccccagacaccuucccggccguaagccaauuccuauucgaacuaggcaaacaacccagaggcacaaagaaaaugaagaaagcccuccucagcacacccaugaaaugggguaagaaacucuacgaacuauucgccgacgacucguuccagcaaaacagaauauacaugcaccccgcaguacucacggccggccgaauauccgaaaugggcgucugcuucggcacaauccccgucgcaaaccccgacgacgcagcccuaggcucaggccacaccaaaagcauccuaaaccuccgcaccaacaccgaaacgaacaaccccugcgcaaaaaccaucguaaaacucuucgagauacagaaaaccggcuucaacauacaagacauggacaucgucgccucagaacaccuccuccaccaaagccuaguaggcaaacaauccccguuccagaacgccuacaacguaaaaggcaacgccacaagcgcaaacaucaucuaa

SEQ ID NO: 8030 - RNA, 1449 nt, Artificial Sequence
  derived and/or modified CDS sequence (opt11) from CCHFV(Gaib)__KX013446.1__N
auggaaaacaaaauagaaguaaacaacaaagacgaaaugaacaaaugguucgaagaguucaagaaaggcaacggccucguggacacauucaccaacucauauagcuucugcgaaucagucccaaaccuagacagguucguauuccagauggcaucagcaaccgacgacgcccaaaaagacucgauauacgccucagcccuaguagaagcaacaaaauucugcgcaccaauauacgaaugcgcauggguaagcuccaccggaauaguaaagaaaggacuagagugguucgagaaaaacgccggaacaaucaaaucaugggacgaaagcuacaccgaacuaaaaguggaaguaccaaaaaucgagcaacuggcaaacuaccaacaagccgcccugaaauggcgaaaagacaucggauuccggguaaacgccaacacagccgcacuaagccacaaaguacuagccgaauacaaaguccccggcgaaaucgucaugagcguaaaagagaugcuauccgacaugauccggcgcagaaaccucauccucaaccgcggcggagacgaaaacccacgaggcccugucagcagagaacacguagaauggugcagagaguucguaaaaggaaaauacaucauggccuucaacccgcccuggggagacaucaacaaauccgggcgcucaggcaucgcacucguagccaccggacucgccaaacuagcggaaaccgaagggaaaggagucuucgacgaagcaaagaaaacaguagaagcccucaacggcuacuuagacaaacacaaagacgaagucgacaaagccuccgccgacaacaugauuaccaaccuacugaaacacauugccaaagcacaagaacuauacaaaaacucaucggcacucagagcacaaggagcccaaaucgacacugccuucagcuccuacuacuggcucuacaaagccggcgucaccccagaaacauuccccacagucagccaauuccucuucgaacucgguaaacaaccccgcggcacaaagaaaaugaagaaagccuuacucuccaccccaaugaaauggggcaagaaacucuacgaacuauucgccgacgacuccuuccaacaaaaccggaucuacaugcacccagcaguccugacggcaggccguaucagcgaaaugggcgugugcuucgggacaaucccagucgccaaccccgacgacgccgcccaaggcagcggccauacaaaaagcauacucaaccuacggaccaacaccgaaaccaacaaccccugcgccaaaacaaucguaaaauuguucgaaauccagaaaaccggcuucaacauccaagacauggacaucguagcaagcgaacaccuccugcaccaaagccuggucggaaaacaaagccccuuccagaacgcauacaacguaaaaggcaacgcgaccuccgcaaacaucaucuaa

SEQ ID NO: 8031 - RNA, 1449 nt, Artificial Sequence
  derived and/or modified CDS sequence (opt11) from CCHFV(Hodzha)__KX013449.1__N
auggaaaacaaaauagaagucaacaacaaagacgaaaugaacaaaugguucgaagaguucaagaaaggcaacgggcuggucgacacauucacaaacagcuacuccuucugcgaauccguccccaaccucgacagauucgucuuccaaauggccucagccaccgacgacgcccaaaaagacuccaucuacgcuuccgcccuaguagaagcaacaaaauucugcgcucccauauacgaaugcgccuggguaagcuccaccggcaucguaaagaaaggccucgaaugguucgagaaaaacgccggcaccaucaaauccugggacgaaucauacaccgaacucaaagucgaaguccccaaaaucgaacagcuggccaacuaccaacaagccgcccugaaauggcgcaaagacaucggcuucugcguaaacgccaacacagcagcccuaucccaaaaaguccucucagaauacaaaguccccggcgaaaucguaaugucagucaaagaaaugcucuccgacaugauccgccgccgaaaucucauccuaaaucgcggcggggacgaaaacccaagaggccccguaucccgcgaacacgucgaauggugccgagaguucguaaaaggaaaauacauaauggccuucaacccacccuggggagacaucaacaagagcggccgauccggcaucgcccuaguagcaacaggccuagccaaacuugcggaaaccgaagggaaaggcgucuucgacgaagcaaagaaaaccgucgaagcccuaaacggcuaccuagacaaacacaaagacgagguggacaaagccagcgcggacaacaugaccaccaaccuccuaaaacacaucgcgaaagcacaagaacucuacaaaaacagcuccgcucuacgcgcacaaggggcccagaucgacaccgccuucucaagcuacuacuggcuauacaaagcaggcgucacccccgaaaccuuccccaccgucagccaauuccucuucgaacucggaaaacaaccccgcggcaccaaaaagaugaagaaagcccuacucagcacgcccaugaaauggggcaagaaacucuacgaacucuucgccgacgacagcuuccaacaaaaccgaauauacaugcaccccgccguccucaccacaggacgaaucuccgaaaugggcgucugcuucggaaccguccccgucgcugacccugacgacgccgcccaaggauccggacacaccaaaagcauacuaaaccuucggaccaacacagaaacgaacaacccaugcgccaaaaccaucguaaaacucuucgaaauccagaaaaccggcuucaacauccaagacauggacaucgucgccagcgaacaccuucuccaccaaagccucguaggaaaacaaucccccuuccaaaaugcauacaacguaaaaggaaacgccaccuccgcgaacauuauauaa

SEQ ID NO: 8032 - RNA, 1449 nt, Artificial Sequence
  derived and/or modified CDS sequence (opt11) from CCHFV(IbAn7620)__KX013452.1__N
auggagaacaaaauagaaguaaacaacaaagacgaaaugaaccgaugguucgaggaauucaaaaaagaaaacggacucgucgacaccuucacgaacucccacuccuucugcgaauccguccccaaccucgacaaauucgucuuccaaauggccuccgccaccgacgacgcgcagaaagacucgaucuacgccgccgcacuagucgaagccacaaaauucugcgcaccaauauacgaaugcgccuggguaucauccacuggcauagucaaaaaaggccucgaaugguucgaaaaaaacgcaggcacaauaaagagcugggacgagagcuacaccgaacugaaagucgaaguacccaaaaucgaacaacucucaaacuaccaacaagcagcccucaaauggagaaaggacauaggguucagagucaacgccaacaccgcuacacuaucacacaaaguccucgccgaauacaaggucccaggcgaaaucgucauguccguaaaagagaugcucucagacaugauccgccgccgaaaccucauccuaaacagaggcggagacgaaaaccccagaggccccguaucccgcgaacacgucgaauggugccgcgaauucgucaaaggaaaauacaucauggccuuuaacccgcccuggggagacaucaacaaaucaggacgcagcggcauagcccuuguagcaaccggacuagccaaacucgcagaagccgaagguaaaggcguauucgacgaagcaaaaaaaaccguagaagcacucaacggcuaccucgacaaacacaaagacgaaguagacaaaucaucggcagacuccaugaucacaaaccugcucaaacacaucgccaaagcccaagaacuguacaaaaacuccucggcccuccgcgcccaaggagcccaaaucgacaccgcauucuccucauacuacuggcucuacaaagccggagucaccccggaaaccuucccaacagucucccaauuccucuucgaacuaggcaaacaaccccgcggaaccaaaaaaaugaaaaaagcacuucuaucaacccccaugaaauggggcaaaaaacuuuacgaacucuucgcagacgauuccuuccagcagaaccgcaucuacaugcaccccgccguccucaccgccggccgaauauccgaaaugggaguaugcuucggcaccauccccguagccaacccugacgacgcggcccuaggcucaggacauaccaaauccauacuaaaccuacgcacaucaacagaagccaacaacccgugcgccaaaaccaucgucaaacucuucgaaauacaaaaaaaaggcuucguaauaaaagacauggacaucgucgccuccgaacaccuacuacaccagagccucguuggcaaacagucccccuuccaaaacgcauacaaugucaaaggcaacgccacauccgcuaacauaaucuga

SEQ ID NO: 8033 - RNA, 1449 nt, Artificial Sequence
  derived and/or modified CDS sequence (opt11) from CCHFV(K128_76)__KX013455.1__N
auggaaaacaaaaucgaagucaacaacaaagacgaaaugaacaagugguuugaagaguucaagaaaggcaacgggcucgucgacaccuucaccaacuccuacucauucugcgaaucaguccccucccuagaucgcuucgucuuccaaauggccagcgccaccgacgacgcccaaaaagacuccaucuacgccucagccuuaguagaagccacaaaauucugcgcccccauauacgaaugcgcauggguaagcucaacaggcaucguaaagaaaggacuagaaugguucgagaaaaacgccggaacaauaaaaagcugggacgaauccuacacggagcugaaaguggaaguacccaaaauagaacaacuggccaacuaccagcaagcagcccucaaauggcgaaaagacauuggcuuccgcguaaacgccaacacugccgcacucucacacaaaguccucgccgaguacaaagucccaggcgaaaucguaaugucaguaaaagaaaugcucucagacaugaucaggagaagaaaccugauccuaaaccgcggcggagacgaaaacccacgaggacccgucagcagagagcacgucgaguggugccgcgaguucgugaaaggcaaauacaucauggccuucaauccacccuggggagacaucaacaaauccggccgaucaggaaucgcccucguagcgacaggccuagccaaacuagccgaaaccgaaggcaaaggcgucuucgacgaagccaagaaaacagucgaagcacuaaacggauaccucgauaaacacaaggacgaagucgacaaggccagcgcagacaacaugauaaccaaccuccucaaacacaucgcaaaagcccaagaacuauacaagaacuccucagcgcucagagcacaaggagcccaaauagacacagccuucuccuccuacuacuggcucuacaaagccgggguaacacccgaaaccuuccccacagucagccaauuccucuucgaacuaggaaaacaaccccgaggaaccaagaaaaugaagaaagcacuccucuccaccccgaugaaauggggcaagaaacuauacgaacuuuucgcggacgacucuuuccaacagaacagaauauacaugcaccccgccgugcuaacagccggccgcaucucagaaaugggcguaugcuucggaaccauaccagucgccaaccccgacgacgccgcccaagguuccggccacaccaaauccauccucaaccuacgaacaaacacagagacaaacaacccaugcgcaaaaacaauaguaaaauuguucgaaauccaaaagacagguuucaacauacaggacauggacauagucgccuccgaacaccuacuccaccaaagccuaguaggaaaacaaagccccuuccaaaacgcguacaacguaaagggaaacgccaccagcgccaacaucaucuaa

SEQ ID NO: 8034 - RNA, 1449 nt, Artificial Sequence
  derived and/or modified CDS sequence (opt11) from CCHFV(K168_125)__KX013461.1__N
auggagaacaaaauagaagugaacaacaaagacgagaugaacaaaugguucgaagaauucaaaaaagggaacggacucguagacacauucaccaacucguacuccuucugcgaaucagucccgaaccucgacagauucguauuccaaauggcaagcgcaaccgacgacgcacaaaaagacucaaucuaugcaagcgcccuagucgaagcaacaaaauuuugcgccccaauauacgaaugcgccuggguauccuccaccgggaucgucaaaaaaggccuagaaugguucgagaaaaacgcuggaaccaucaaaucaugggacgagucauacacggaacucaaagucgaagucccaaaaaucgaacaacucgccaacuaccaacaggccgcccugaaauggcggaaagacauaggcuuccgcgucaacgcaaacacagccgcccucucacacaaaguccuggccgaguacaaaguccccggcgacaucgucauguccgucaaagagaugcucuccgacaugauccggcgccguaaccucauccuaaaccgaggcggagacgaaaacccacgaggccccguuagccgagaacacgucgaauggugcagagaauucguaaaaggcaaauacauaauggccuucaacccccccuggggcgacaucaacaaauccggacgaagcggaaucgcccucgucgccacuggacucgccaaacucgccgaaaccgaaggaaaaggcgucuucgacgaagccaaaaagacagucgaagcccucaacggauaccucgacaaacacaaggacgaaguugacaaagcgagcgcagacaacaugauuaccaaccuccucaaacacaucgccaaagcacaagaacucuacaaaaacuccuccgcccuccgcgcacaaggugcccaaaucgacaccgcauucucauccuacuacuggcuauacaaagcgggugucaccucagaaacguuccccaccgucucccaauuccucuucgagcucggaaaacaaccuaggggcaccaaaaaaaugaagaaagcacuacuuuccacccccaugaaauggggcaaaaaacucuacgaacuauucgccgacgacuccuuccaacaaaaccgcaucuacaugcacccagccgugcuuacggccggccgaauaagugaaaugggagucugcuucggaacaauacccgucgccaaccccgacgacgcagcccaaggaucaggacacacaaaaagcauccuaaaccuaagaacaaacaccgagaccaauaaccccugcgccaaaaccauagucaaacuauucgaaauccaaaaaaccggauucaacauccaagacauggacaucguagccucagaacaccuccuccaucaaagccucgucggaaaacagagcccauuccagaaugcguacaacgugaagggcaacgcaacgucagccaacaucaucuaa

SEQ ID NO: 8035 - RNA, 1449 nt, Artificial Sequence
  derived and/or modified CDS sequence (opt11) from CCHFV(K168_40)__KX013458.1__N
auggaaaacaaaaucgaagucaacaacaaagacgaaaugaacaaaugguucgaagaguucaaaaaaggaaacggacucguagacacauucaccaacucauacucauucugcgaauccguaccaaaccuagaccgauucgucuuccaaauggcaagcgccaccgacgacgcacaaaaagacucaaucuacgccucagcccucgucgaggccaccaaauucugcgcgcccauauacgaaugcgccugggucagcuccaccggcaucguaaaaaaaggccucgaaugguucgaaaaaaacgccggcacaaucaaauccugggacgaaagcuacacagaacugaagguagaaguacccaaaaucgaacaacucgccaacuaccaacaagcugcacugaaauggcgcaaagacauaggcuucagagugaacgccaacaccgccgcccuuucccacaaaguccuagcagaauacaagguaccaggcgauaucgucaugucagucaaagaaaugcuauccgacaugaucagacgccgcaaucuaauccuaaaccgcggcggggacgaaaacccccgaggcccaguaagccgagaacacguagaguggugccgagaauuugucaaaggaaacuacauaauggcauucaacccaccauggggcgacaucaacaaaucaggcagaagcggcauagcccuuguagccaccggccuagcaaaacucgcagaaaccgaaggcaaaggcguauucgacgaagccaaaaaaacagucgaagcccuuaacggcuaccuagacaagcacaaagacgaagucgacaaagcgagugcagacaauaugaucaccaaccuccugaaacauaucgccaaagcccaagaacucuacaaaaacagcucagcccuacgggcccaaggcgcccaaaucgacacagccuucuccaguuauuauuggcuauacaaagccggcguaaccagcgaaaccuucccaaccgucagccaauuccuauucgaacucggcaaacaaccccgaggcacaaaaaaaaugaaaaaagcacuacuaucaacacccaugaaauggggaaaaaagcucuacgaacuauucgcagacgacuccuuccaacaaaaccgaaucuacaugcacccugccguacucaccgccggccgaaucuccgaaaugggagucugcuucggcaccauccccgucgcaaauccagacgacgccgcacaaggaagcggccacaccaaaucaauccucaaucuccguaccaauacggaaaccaauaacccgugcgcaaaaaccaucgucaaacuauucgaaauacaaaaaaccggcuucaacauccaagacauggacaucguagcauccgaacacuuacuccaccaaucccucguaggcaaacaaagcccauuccaaaacgccuacaacgucaaaggcaacgccacaagcgcaaacauaaucuaa

SEQ ID NO: 8036 - RNA, 1449 nt, Artificial Sequence
  derived and/or modified CDS sequence (opt11) from CCHFV(K323_27)__KX013473.1__N
auggaaaacaaaaucgaagucaacuccaaagacgaaaugaacaaaugguucgaagaguucaagaaaggcaacggccucauggacacauucacaaacuccuacuccuucugcgaaaacguacccaaccuagacaaauucgucuuccaaauggcaagcgccaccgacgacgcccaaaaagacuccaucuacgcaucagcccucgucgaagccacgaaauuuugcgcgcccaucuacgaaugcgccuggguaucauccaccgguaucgucaagaaaggccuagaaugguucgagaaaaacucaggcaccaucaaaucaugggacgaaaacuacgcagaacucaaagucgacguccccaaaaucgaacaacuagccaacuaccaacaagccgcccucaaauggcgcaaagacaucggauuccgagucaacgccaacacagccgcgcucucaaacaaaguccuagcagaauacaaaguccccggcgagauagucauguccguaaaagaaaugcucuccgacaugauccgccgacgaaaccucauccucaaccgaggcggcgacgaaaacccacgaggaccugucagccgagaacacguagaauggugccgcgaguucguaaagggaaaauacaucauggccuucaaucccccauggggagacaucaacaaaagcggccgauccggcaucgcacucguagccaccggccuggcgaaacuagcagaaacagaaggcaaaggcgucuucgacgaagcaaagaagacgguagaagcccucaacggcuaccucgauaaacacagagacgaagucgacaaagcaagcgcagacuccaugaucacaaaccuacugaaacacauagccaaagcccaggaacuauacaaaaacagcuccgcccuccgagcccaaggcgcccagauagacacaccauucagcagcuucuacuggcucuacaaagccggcguaacaccagaaaccuucccaaccaucagccaauuccuauucgaacucggcaaacaaccaaggggcaccaaaaagaugaagaaagcacuccuaagcacacccaugaaauggggaaagaaacuauaugaacuguucgccgacgacuccuuccaacaaaaccgcaucuacaugcacccagccguacucaccgccggacgaaucagcgaaaugggcgugugcuucggcacgauccccguggcaaaccccgacgacgccgcccagggcucaggccacaccaaaagcauucuaaaccuccgcacauccacggaaaccaacaacccaugcgcaaaaaccaucgucaaacucuucgaaauacaaaagaccggcuucaacauccaagacauggacaucguagccuccgaacaccuccugcaccagucccuaguaggcaaacagagcccauuccaaaacgccuucaacgucaaaggcaaugccacguccgcgaacauaaucuaa

SEQ ID NO: 8037 - RNA, 1449 nt, Artificial Sequence
  derived and/or modified CDS sequence (opt11) from CCHFV(Min)__KX013482.1__N
auggaaaauaaaauugaagucaacucaaaagacgagaugaacaaaugguuugaagaauucaagaaaggcaacggccucauggacacguucacgaacuccuacuccuucugcgaaaacgucccaaaccucgacaaauucguauuccaaauggccagcgcaacggacgacgcacaaaaagacucaaucuacgccucagcacucguagaagccacaaaauucugcgccccaaucuacgaaugcgcauggguauccagcacaggcaucgucaaaaaaggccuagaaugguucgaaaaaaacagcggcaccaucaaaucaugggacgaaaacuacgccgaacucaaagucgacguacccaaaaucgaacaacuagccaacuaccagcaagccgcccucaaauggcggaaggacauaggcuuccgcgucaacgccaacacagcagcccuauccaacaaaguccucgccgaauacaaaguaccaggagagaucgucaugucagucaaagaaaugcuauccgacaugauccggcggcgcaaccucauacuaaaccgcggcggcgacgaaaacccccgcggccccgucucacgcgaacacgucgaauggugccgcgaauucgucaaaggaaaauacauaauggcauucaacccgccauggggcgacauuaacaaacucggccgaagcgggaucgcacuaguugccaccggacucgccaagcuagccgaaacagaaggcaaaggcgucuucgacgaggccaaaaaaacagucgaagcacuaaacggcuaccucgacaaacaccgcgacgaggucgacaaagcauccgccgacuccaugaucacaaaucuccuaaaacacaucgcuaaagcccaagaacuauacaaaaauuccucagcacuacgagcacagggcgcccagaucgacacccccuucuccuccuucuacuggcucuacaaagccggcgucaccccagaaaccuucccaaccauaagccaauuccucuucgaacuaggcaaacaacccagaggcacaaaaaaaaugaaaaaagcccuccuauccacccccaugaaauggggcaaaaaacuguacgaacuauucgccgacgacucauuccaacagaaccgcaucuacaugcaccccgcaguccucacagccggccgcauaucagaaaugggcguaugcuucggcacaauccccguagcaaacccagacgacgccgcccaaggcagcggccacaccaaaucaauccucaaccucagaaccucaaccgagaccaacaaccccugcgcaaaaaccauaguaaaacucuucgaaauccaaaaaacaggcuucaacauacaagacauggacaucguggcuuccgaacaccuccuccaccaaagccuaguaggcaaacaauccccauuccaaaacgcauacaacgucaaaggcaacgcaaccuccgcuaacaucauauaa

SEQ ID NO: 8038 - RNA, 1449 nt, Artificial Sequence
  derived and/or modified CDS sequence (opt11) from CCHFV(Saf)__KX013488.1__N
auggaaaacaaaaucgaagucaacuccaaagacgaaaugaacaagugguucgaagaguucaagaaaggaaacggccucauggacaccuucacaaacucauacucauucugcgaaaacgucccaaaccucgacaaauucgucuuccaaauggccuccgccacagacgacgcgcaaaaagacuccaucuacgccucugcccuagucgaggccacaaaauucugcgcuccaaucuacgaaugcgcauggguaagcuccaccggcaucgugaagaaaggccuagaaugguuugagaaaaacagcggaaccaucaaaucaugggacgaaaacuacgcggaauuaaaaguagacguccccaaaauugaacaacucgcaaacuaccaacaagcggcccucaaauggcgcaaagacaucggcuuccgcguaaacgccaacacagccgcccucucaaacaaaguccucgccgaauacaaaguacccggcgaaaucgucaugucagucaaagaaaugcuauccgacaugaucagacgcagaaaccuaauccugaaccgcggcggagacgaaaaccccaggggaccuguauccagagaacacgucgaauggugccgcgaguucguaaaaggcaaauauauaauggcauucaacccgcccuggggcgacaucaacaaaagcggccgauccggaaucgcccucguggccacaggccuagcaaaacuagccgaaacagaaggaaaagggguauucgacgaagccaagaaaacagucgaagcguuaaacggcuaccuagacaaacaccgcgacgaagucgacaaagcaagcgcagacagcaugaucaccaaccuacuaaaacacauagcgaaagcccaggagcuauacaaaaacuccuccgcccuccgcgcccaaggagcccagaucgacaccccauucagcucauuuuacuggcucuacaaagccggcguaacccccgaaacauuucccaccauaagccaauuccuuuucgaacucggaaaacaaccacgcggcaccaagaaaaugaagaaagcgcuccucagcacacccaugaaauggggaaagaaacucuacgaacucuucgccgacgauucauuccaacaaaaccgaaucuacaugcacccggccguccucacagccggaagaaucucagaaaugggggucugcuucggaacaauacccguagcagacccagacgacgccgcacaaggcucgggccacacaaaaagcauacuuaaccucagaaccagcacagaaaccaacaacccaugcgcacgcacgaucgucaaacuauucgaaauccagaaaacgggcuuuaacauccaagacauggacaucguagccuccgaacaccuacuccaccaaagccuggucggcaaacaaagcccauuccaaaacgcguauaacgucaaaggcaacgccaccagcgcaaacaucaucuag

SEQ ID NO: 8039 - RNA, 1449 nt, Artificial Sequence
  derived and/or modified CDS sequence (opt11) from CCHFV(UCCR4459)__KY484031.1__N
auggaaaacaaaaucgaagucaacaacaaagacgaaaugaacaaaugguucgaagaguucaaaaagggcaacggacucgucgacaccuucaccaacuccuauucauucugcgaaagcgucccgaaccucgaccgauucgucuuccaaauggccucagccaccgacgacgcacaaaaagacucgaucuacgccucagccuuaguagaagccaccaaauucugcgccccaauauacgaaugcgccugggucagcuccacaggcaucguaaagaaaggccucgaaugguucgagaaaaacgcgggcacaaucaaaagcugggacgaaagcuacaccgaacucaaaguagaagucccaaaaaucgaacaacuagcaggcuaccaacaagccgcccugaaauggagaaaagacauaggcuuccgagugaacgccaacaccgccgcccucucacacaaaguccucgccgaauacaaaguacccggcgaaauagucaugucagucaaagaaaugcucuccgacaugaucagacgaagaaaccucauccuaaaccgcggaggagacgaaaauccccguggaccaguaucccgagaacacguagaguggugucgcgaguucguaaaaggaaaauacauaauggcauucaacccgcccuggggcgacaucaacaaacuuggccgcagcggaauagcccucgucgccaccgggcucgccaaacucgccgaaaccgaaggaaagggaguauucgacgaagccaaaaagaccguggaagcacuaaacggcuaccucgauaaacacaaagacgaagucgauaaagcauccgcagauaacaugaucaccaaccuccucaaacacauagccaaggcccaagaacucuacaaaaacagcuccgcccuccgagcccaaggggcacaaaucgacaccgccuucucgucauacuacuggcucuacaaagcuggagugacccccgaaacauuccccaccguaucccaauuccuauucgaacucggaaaacaaccccgaggcacaaagaaaaugaagaaagcacuccuaagcacgcccaugaaauggggcaagaaacucuacgaacucuucgcagacgacuccuuucaacaaaaucgaaucuacaugcacccagccguccuaacagcaggccgaauaucagaaaugggcguaugcuucggaaccaucccaguagcaaacccagacgacgccgcacaaggauccggccacaccaaauccauccucaaucuacgaaccaacacagaaaccaacaacccaugcgccaaaacaaucguaaaacuauucgaaauccaaaagacgggcuucaacauacaagacauggacaucguagcaagcgaacaccuccuccaccaaagccucgucgggaaacaaucacccuuccaaaacgccuacaacguaaaaggaaacgccacaucagccaacaucaucuaa

SEQ ID NO: 8040 - RNA, 1449 nt, Artificial Sequence
  derived and/or modified CDS sequence (opt11) from CCHFV(YL16070)__KY354080.1__N
auggaaaacaaaaucgaagucaacaacaaagacgaaaugaacaagugguucgaagaguucaagaaaggcaacgggcucgucgacacauucaccaauuccuacuccuucugcgaaucggucccaaaccuggacagauucgucuuccaaauggccagcgccacggacgacgcccaaaaagacucaaucuaugccuccgcccuagucgaagccacgaaauucugcgcccccaucuacgaaugcgcguggguaucaagcacuggcauagugaagaaaggccuagaaugguucgagaaaaacgccgggacaauaaaauccugggacgaaucauacacagaacuaaaagucgaaguaccaaagaucgaacaacuggccgacuaucaacaagcagcccugaaauggcgcaaggacauaggcuuccgcgugaacgcaaacaccacagcccucucucacaaaguccucgccgaauacaaaguaccaggcgaaaucgucauguccgucaaagaaaugcuauccgacaugauccgccgcagaaaccugauccucaacagaggcggagacgaaaacccacgcggcccagucagcagggagcacgucgaguggugccgcgaguucguaaaaggcaaauacaucauggccuucaauccucccuggggugauauaaauaaaagcgggcgaagcgggauagcgcucguggccacaggccuagccaaacucgccgaaacagaaggcaaaggggucuucgacgaagcuaagaaaacagucgaagcccugaacggcuaccuaaacaaacacaaggacgaagucgacaaagccagcgcagacucaaugaucaccaaccuacuaaaacacaucgcaaaagcacaagaacucuacaaaaacaguucagcccuacgcgcccaaggcgcccaaaucgacacagccuucuccagcuacuacuggcucuacaaagcaggaguaaccccagaaaccuucccgaccguaucacaauuccucuucgagcuaggcaaacaaccacgaggcacaaagaaaaugaagaaagcccuacuaagcacaccccuaaaauggggcaaacgacuauaugaacucuucgcagacgacuccuuucaacaaaaccgcauauacaugcaccccgccguccucaccgccggacgaaucagugagaugggcgucuguuucggaaccauaccaguagccaaccccgacgacgccgcccaaggcucaggccacaccaaaagcauacuaaaccucagaaccaacaccgaaaccaacaacccaugcgcaaaaaccaucguaaaacucuucgagauucagaaaaccggcuucaacauccaagacauggacauaguggccuccgaacaccuacuacaccaaucccuagucggcaaacaaagccccuuccaaaacgcauacaacguaaagggcaacgcaacaagcgcaaacauaauauaa

SEQ ID NO: 8041 - RNA, 1449 nt, Artificial Sequence
  derived and/or modified CDS sequence (opt11) from CCHFV(66019)__AJ010648.1__N
auggaaaacaaaauagaagugaacaacaaagacgaaaugaaccgcugguucgaagaauucaaaaaagguaacgggcuaguagacaccuucaccaacucguacucguucugcgaaucaguccccaaccuagacagguucgucuuccagauggcaagcgcgaccgacgacgcacaaaaagacagcaucuacgccuccgcccuagucgaagccacaaaauucugcgcacccaucuacgaaugcgccugggucagcagcacaggcaucguaaaaaaaggccuagaaugguucgaaaaaaacgcaggcaccauaaaguccugggacgagucauacacagaacuaaaaguagaaguccccaaaauagaacaacucgcuucauaccaacaagccgcgcucaaauggagaaaagacauaggauuccgagugaacgccaacacagcagcccucucacacaaaguccucgcagaauacaaagucccaggcgaaaucgucauguccgugaaagaaaugcuauccgacaugauaagaaggcgcaaccucauccuaaaccguggaggagacgaaaacccccgaggacccguaagccgcgaacacguagaguggugccgagaauucgucaaaggaaaauacaucauggccuucaaccccccauggggcgacaucaacaaaucaggaaggagcggaauagcacucguggcaaccggacuagccaaacucgcagaaacagaaggaaaaggagucuucgacgaagccaaaaaaacagucgaagcccucaacggguaccuggacaagcacaaagacgaggucgacaaagccagugccgacaacaugacaaccaaccuccugaaacacauagcuaaagcgcaggaacuauacaaaaacagcagcgcccuacgggcacaaggcgcacagaucgacacagcauucagcagcuacuacuggcucuacaaagcgggcguaacccccgaaaccuucccaaccgucagccaauuccuauucgaacucggcaaacaaccacgaggcacaaaaaaaaugaaaaaagcgcuccuguccacccccaugaaauggggcaaaaaacucuacgaacucuucgccgaugacucguuccaacaaaaccgaaucuacaugcacccagcaguacuaaccgccgggcggauaagcgaaaugggcgucugcuuuggaaccauccccgucgccgaccccgacgacgccgcccaaggcucaggacacacaaaaagcauccucaaccucagaacaaacaccgaaacaaacaaccccugcgcaaaaacaaucguaaaacuguucgaaauacagaaaaccggcuucaacauccaagacauggacauagucgcaucagagcaccuccuccaccaaagccucguugggaaacaaagcccauuccaaaacgcauacaacgucaaaggcaacgcaaccagugccaacauaaucuag

SEQ ID NO: 8042 - RNA, 1449 nt, Artificial Sequence
  derived and/or modified CDS sequence (opt11) from CCHFV(8402)__AJ010649.1__N
auggaaaacaaaaucgaaguaaacaacaaagacgaaaugaacaagugguucgaagaguucaagaaaggcaacgggcucguagacaccuucacaaacucauacuccuucugcgaaucugucccaaaccuggaaagauucgucuuccaaauggccagcgccaccgacgacgcccaaaaagacucaaucuacgccuccgcccuaguagaagccacgaaauucugcgcaccaauauacgaaugcgccugggucagcuccaccgggaucgucaagaaaggccucgaaugguucgaaaagaacgccggaaccauaaaauccugggacgaaucauacacggaacuaaaagucgaaguacccaaaaucgaacaacuggccaacuaccagcaggcggcccuaaaauggcgaaaagacauaggauuccgcgucaacgccaacacagccgcccucucgcacaaaguccucgcagaauacaaagucccaggcgaaaucgucaugucagucaaagaaaugcucuccgacaugauccgccgacgaaaccucauacucaacaggggcggagacgaaaacccacgaggccccguaagccgcgaacacgucgaauggugccgcgaguucguaaaaggcaaauacauaauggcauucaacccgcccuggggagauaucaacaaaagcggccgaagcggaaucgcacuugucgcaacgggccuagccaaacucgccgaaacagaaggcaaaggaguauucgacgaagccaagaaaaccguagaagcacucaacggauaccuggacaagcacaaagacgaagucgacaaagcaagcgcagacaacaugaucacaaaccucuucaaacacauagcgaaagcacaagaacucuauaaaaaccuguccgcccuaggcgcacaaggagcacaaaucgacacagcauucucaagcuacuacuggcucuacaaagccggcguaacgccagaaacauuccccacaguaagccaauucuuguucgaacuuggcaaacagccccgaggcacgaaaaagaugaagaaagcacuccuguccacaccaaugaaauggggaaagaaacucuacgaacucuucgccgacgacuccuuccaacaaaaccgcauauacaugcaccccgccguccugacggcagggagaauaagcgaaaugggaguaugcuuuggaaccauacccguagcgaaccccgacgacgccgcgcaaggaucaggccacaccaaaagcauccuaaaccuccgcaccaacacagaaaccaacaaccccugcgcgaaaaccauagucaaacuauucgaaauccagaaaaccggauucaacauacaagacauggacauagucgccagcgaacaccuccuccaccaaagccuagucggcaaacaaagcccauuccaaaaugccuacaacguaaaaggcaacgcaaccagcgcaaacauaaucuaa

SEQ ID NO: 8043 - RNA, 1449 nt, Artificial Sequence
  derived and/or modified CDS sequence (opt11) from CCHFV(Bul/HU517)__AY277676.2__N
auggaaaacaaaauagaaguaaacucaaaagacgaaaugaacaaaugguucgaagaguucaagaaaggcaacggccucauggacaccuucacgaacucauacucauucugcgaaaacguccccaaccuagauaaauucguguuccaaauggccagcgcaaccgacgacgcacaaaaagacuccaucuacgccagcgcccucgucgaagccacaaaauucugcgcccccauauacgaaugcgccugggucagcucaaccggaaucguaaagaaaggccuagaaugguucgagaaaaacuccggggccauaaaaucaugggacgaaaacuacgucgaacuuaaagucgacguacccaaaauagaacaacuagccaacuaccaacaagccgcccuaaaauggcgaaaagacauaggcuuccgcgucaacgcgaacaccgccgcccucuccaacaaaguacuagcagaauacaaaguccccggcgaaaucgucaugucggucaaagaaaugcucagcgacaugaucagaagacgaaaccucauccuaaaccgcggcagcgacgaaaacccgcgcggacccgucucacacgaacacguagaguggugucgcgaguucgucaaaggaaaauacaucauggccuucaaucccccauggggugacaucaacaagucaggccgcagcggcaucgcccucgucgccaccggccuagccaagcucgccgaaacagaaggaaaaggagucuucgacgaagccaagaaaacggucgaagcccuaaacggcuaccuagacaaacaccgagacgaagucgacaaagccagcgccgacuccaugauaaccaaccuccucaaacacaucgcaaaagcacaagaacucuacaaaaacagcucggcccuccgcgcccaaggggcccaaaucgacaccccauucuccagcuucuacuggcucuacaaagcgggcgucacacccgaaaccuuccccacaauaucacaguuccucuucgaacuaggaaaacagccucgcggaaccaagaaaaugaagaaagcacuacuaagcacccccaugaaauggggaaagaaacucuaugaacuguuugccgacgacuccuuccaacaaaaccgcaucuacaugcacccagcagugcucaccgccggccgaauaagcgaaaugggcguaugcuucggaacaauacccgucgccaaccccgacgacgccgcccaaggcagcggccacacaaaaucuauucuuaaccuucgaacauccacagaaaccaacaaccccugcgcaaaaaccauagugaaacuauuugaaauccagaaaacaggcuuuaacauacaagacauggacauagucgccucagaacaccuauuacaccaaucccuagucggcaaacaaagccccuuccaaaacgcauacaacgucaaaggcaacgcaacaagcgccaacaucauauaa

SEQ ID NO: 8044 - RNA, 1449 nt, Artificial Sequence
  derived and/or modified CDS sequence (opt11) from CCHFV(V46/13)__KR011837.1__N
auggaaaauaaaaucgaagucaacucuaaagacgaaaugaacaaaugguucgaagaauucaagaaaggaaacggccuaauggacaccuucacaaacucguacuccuucugcgaaaacguccccaaccuagacaaauucgucuuccaaauggccagcgcaacagaugacgcacaaaaagacuccaucuacgccuccgcccucguagaagccaccaaguucugcgcccccaucuacgaaugcgcaugggucagcuccacgggcaucguaaaaaaaggacuagaaugguucgaaaaaaacagcggcaccaucaaaagcugggacgaaaacuacgccgaacucaaaguagacguucccaaaaucgaacaacuagccaacuaccaacaagccgcccucaaauggcgaaaagacauaggcuuccgcgucaaugcaaacaccgccgcacucucaaacaaaguccucgccgaauacaaaguccccggcgaaaucguaaugagcguaaaagaaaugcucuccgacaugauccgccgccgcaaccuaauacuaaacagaggcuccgacgaaaacccccggggcccggucagccgcgagcacguagaauggugccgagaauucgucaaaggcaaauacauaauggcauucaacccacccuggggcgacauaaacaaaagcggaagauccggcauagcccucgucgcaaccggucucgccaaacucgccgaaaccgaaggcaaaggaguauucgacgaagccaaaaaagcgguagaagcacuaaacggauacuuagacaagcacagggacgaagucguaaaagccuccgccgacagcaugaucaccaaccugcucaaacacauagccaaagcacaggaacucuacaaaaauucauccgcccucagagcccaaggggcccaaaucgacaccccauucucguccuucuacuggcucuacaaagcaggcguaaccccagaaacauuccccaccauaagccaguuccuauuugaacucggcaaacaaccgaggggcacgaaaaaaaugaaaaaagcucuccuaucaacgcccaugaaauggggaaaaaaacuauacgaacuuuucgccgacgacuccuuccaacaaaacagaaucuacaugcaccccgcaguacucacagccggccgcaucagcgagaugggcguaugcuucggaacuauccccgucgcuaacccagacgacgcagcccaaggcagcggccacacaaaaagcauccuuaaccuccgcaccuccaccgaaaccaacaaccccugcgccaaaacaaucgucaaacucuucgaaauccaaaaaaccggguucaacauccaagacauggacauaguggcauccgaacaccuccuccaccagagccuagucggaaaacaauccccauuccagaacgcauacaacgucaaaggaaacgcaaccagcgccaacauaaucuaa

SEQ ID NO: 8045 - RNA, 1449 nt, Artificial Sequence
  derived and/or modified CDS sequence (opt11) from CCHFV(1231-CR/TI-2015)__KU161587.1__N
auggaaaacaaaaucgaaguaaacuccaaagacgaaaugaacaaaugguucgaagaguucaagaaaggcaacggccugauggacaccuucacaaacucauacuccuucugcgaaaacguccccaaccuugacaaauucguauuccaaauggcaagcgccaccgacgacgcgcaaaaagacuccauuuacgcaucggcccuggucgaagccacgaaauucugcgcacccauauacgaaugcgcauggguaucaucaaccgggauaguaaagaaaggccuagaaugguucgagaaaaacagcgggaccaucaaauccugggacgaaaacuacgccgaacuaaaagucgacguccccaaaaucgaacaacucgccaacuaccagcaggcggcccuaaaauggcgaaaagacauaggcuuccgcgucaacgcaaacacagcggcccucagcaacaaagugcuagccgaauacaaaguccccggcgagauagucaugagcguuaaagaaaugcucuccgacaugauacgccgcagaaaccucauccucaaccgcggcggagacgaaaacccacgcggccccguaagccgagaacacguagaauggugccgcgaguucguaaaaggaaaauacauaauggccuucaacccacccuggggagacaucaacaaaucaggcagaagcggaaucgcccuuguagcaaccggcuuagccaaacucgcagaaaccgaaggaaaaggagucuucgacgaagccaagaaaacagucgaagcacuaaacggcuacuuagacaaacaccgagacgaagucgacaaagcauccgcagacuccaugaucaccaaccuccuuaaacacaucgcaaaagcacaagaacuauacaaaaacucauccgcccuacgagcccaaggagcccaaauagacacccccuucagcuccuucuacuggcuuuacaaagcaggcgucaccccggaaaccuuccccaccaucucccaauuccucuucgaacucggaaaacaaccccgaggaaccaagaaaaugaagaaagcccuccucagcacgcccaugaaauggggcaagaaacucuacgaacucuucgcagacgacucauuccaacaaaaccgcaucuacaugcaccccgcaguacuaaccgccggacgaauaucagaaaugggcgucugcuucggcaccaucccugucgccaaccccgacgacgccgcacagggaagcggccacacaaaaagcauacucaaccucaggacaucaaccgaaaccaacaaccccugcgccaaaacaaucguaaaacuauucgaaauacagaaaacaggcuucaacauacaagacauggauaucguagccagcgaacaccuacugcaccaaucacucgucggcaaacaaagccccuuccaaaacgccuacaacgucaaaggaaacgccaccuccgccaacaucauauag

SEQ ID NO: 8046 - RNA, 1449 nt, Artificial Sequence
  derived and/or modified CDS sequence (opt11) from CCHFV(AP92)__U04958.1__N
auggaaaacaaaauagaggucaacuccaaagacgaccuaaacaaaugguucgaagaguucaagaaaggaaacggccucgucgacacguucacuaacucauacuccuucugcgaaaacguccccaaccuagaccgauucgucuaccaaauggcaagcgccaccgacgacgcgcaaaaagacuccaucuacgccuccgcacucguagaagccacaaaauacugcgcccccaucuacgaaugcgcaugggucagcucaaccggaaucguaaagaaaggacucgaaugguucgagaaaaacaccuccaccaucaaauccugggaugaaagcuacaccgaacucaaaguggacauaccaaaaauagaacaacucucaagcuaccaacaagcggcccugaaauggcgaaaagacauaggcuuccgcauaaacgccaacaccacagcacucagcaacaaaguucucgcagaauacaaaguccccggagaaauccuaguccccgucaaagaaauguuauccgacaugauccgccgccguaacaucauccuaaacagaggcucagacgagaauccacgcggcccugucagccacgaacacaucgaauggugccgcgaguucaucaaagguaaauacaucauggccuuuaacccacccuggggcgacaucaacaaauccggacggucaggcauagcccucguagccaccggccucgccaaacucgcagaaaccgaaggcaaaggaguauucgaagaagccaaaaagaccguagaagcccugaaggacuaccuagacaaacaccgcgacgaagucgacaaaacauccgccgacaacauggucaccucacuccucaaacacaucgcaaaagcccaagaacucuacaaaaacucaagcgcccuccgcgcccaaggcgcccaaaucgacacccccuucagcuccuucuacuggcucuacaaagccggcgucacccccgaaaccuuccccaccgucagccaauuccuauucgaacuaggcaaacaaccacgcggcacaaagaaaaugaagaaagcacuccucagcacccccaugaaauggggcaagaaacacuaugaacucuucgcagacgacuccuuccaacaaaaccguaucuacaugcaccccgccguccuaaccgcaggccgcaucuccgaaaugggcgucugcuucggcacaauacccgucgcaaauccagacgaugcagcccaaggcucuggccacaccaaaagcauccucaaccuccgaaccaacaccgaauccaacaaccccugcgcacgaacaaucgucaaacucuucgaaauucaaaagacaggcuucgacaucaaagacauggacaucgucgccucagaacaccuacugcaccaaucccuaguaggaaaacaauccccguuccaaaacgcauacaacgucaaaggaaacgcaacuucagcaaacauaaucuaa

SEQ ID NO: 8047 - RNA, 1449 nt, Artificial Sequence
  derived and/or modified CDS sequence (opt11) from CCHFV(C68031)__M86625.1__N
auggaaaacaaaauagaaguaaacaacaaagacgaaaugaacaaaugguucgaagaguucaagaaaggaaacgggcucgucgacaccuucaccaauccauacuccuucugcgaaucgguacccaaccuagaaagguucguauuccaaauggccuccgccaccgacgacgcccaaaaagacagcaucuacgccuccgcacucgucgaagccaccaaauucugcgcaccaaucuacgaaugcgcauggguaagcucaacaggcauaguaaagaaaggccuggaaugguucgagaaaaacgccggcaccaucaaaucaugggacgaaagcuacaucgaacucaaaguagaagucccuaaaaucgaacaacucgccaacuaccaacaagcggcacugaaauggcgaaaagacaucggcuuccgcguaaacgcgaacacagcagcacuaucacacaaaguccuagccgaauacaaagucccaggagaaaucgucaugagcguaaaagaaaugcucuccgacaugauacgacgacggaaccucauccuaaaccgaggcggagacgaaaacccacgcggcccugucagcagggaacaugucgaauggugcagagaguucgucaaaggaaaauacaucauggcauucaacccgcccuggggcgacaucaacaaaucgggaagaagcggaaucgcacucguagccaccggccucgccaaacuggccgaaacggaaggcaaaggcgucuucgacgaagccaagaaaaccgucgaagcacucaacggcuaccucgacaaacacaaagacgaagucgacaaggccuccgcagacaacaugaucaccaaccuccucaaacauauagcaaaagcccaagaacucuacaaaaacagcucagcccuccgagcccaaggagcccaaaucgacaccgccuucagcucauauuacuggcucuacaaagcaggcgucaccccagaaacauucccgacagucagccaauuccucuucgaacuaggcaaacaacccaggggaacgaagaaaaugaagaaagcacuccucagcacacccaugaaauggggaaagaaacucuacgaacuauucgccgacgacucguuccaacaaaaccgcauauacaugcacccagcaguccuaaccgccggacgcaucagcgaaauggggguaugcuucggcacaauccccguagcaaacccagacgacgccgcccaaggauccggccacaccaaauccauccucaaccuaaggacaaacacggaaacgaacaacccaugugcaaaaacaaucguaaaacucuucgaaauccaaaagacaggcuucaacauccaagacauggacaucguggcaagcgaacaccuccuccaucaaagccucguaggaaaacaaagcccauuccaaaacgcauacaacgucaaaggaaacgcaaccagcgccaacauaaucuaa

SEQ ID NO: 8048 - RNA, 1449 nt, Artificial Sequence
  derived and/or modified CDS sequence (opt11) from CCHFV(1-CR/HU-2015)__KU161586.1__N
auggaaaacaaaaucgaaguaaacuccaaagacgaaaugaacaaaugguucgaggaauucaaaaaaggaaacggccuaauggacacuuucaccaacagcuacucauucugcgaaaacguccccaaccucgacaaguucgucuaccagauggccucagccaccgacgacgcacaaaaagacuccaucuacgcaucagcacuagucgaagccacaaaauucugcgcccccaucuacgaaugcgccuggguaucauccaccgggauagugaaaaaaggccucgaaugguucgaaaaaaacucaggaacaaucaaguccugggacgaaaacuacgcggaacucaaaguagacguacccaaaaucgaacaacucgcaaacuaccagcaagccgcccucaaauggcgcaaggacaucggcuuccgcgucaacgcaaauacagccgcccucuccaacaaaguccucgcagaauacaaaguaccaggagaaauagucauguccgucaaagaaaugcucuccgacaugauccgccgcagaaaccucauccuaaaccgcggcggcgacgaaaacccccguggcccaguaucccgugaacacgucgaauggugccgagaauucgucaaaggcaaauacauaauggccuucaaccccccauggggggacaucaacaaguccgggcgauccggcaucgcccucguugccacaggccuagccaaacuugcagaaaccgaaggcaaaggagucuuugacgaagccaaaaaaaccguugaagcccucaacggcuaccucgacaaacaccgcgacgaagucgacaaagccucggcagacucaaugacaacaaaccuccucaaacacaucgccaaagcgcaagaacuauacaaaaacuccagcgcccuccgcgcccaaggagcccaaauagacacccccuucagcuccuucuacuggcucuacaaggcaggcgucacccccgaaaccuuccccaccaucucccaguuccucuucgaacuaggaaaacaacccagaggcaccaaaaaaaugaaaaaagcccuccucuccacacccaugaaauggggaaaaaaacucuacgaacuguucgccgacgacucauuccaacaaaaccgcaucuacaugcaccccgcaguccucaccgccggccgcauaagcgaaaugggcguuugcuucggcaccauccccguagccaaccccgacgacgccgcgcaaggaagcggccacacaaaauccauacucaaccuacgcaccuccacagagacgaauaacccaugcgccaaaacgauaguaaaacuguucgagauccagaaaacaggcuucaacauccaagacauggacauuguagcauccgaacaccuacuucaccaaagccucgucggcaaacaaucaccauuccaaaacgccuacaacgugaaaggcaacgccaccuccgcaaacauaauauga

SEQ ID NO: 8049 - RNA, 1449 nt, Artificial Sequence
  derived and/or modified CDS sequence (opt11) from CCHFV(36-ST-2014)__KR814838.1__N
auggaaaacaaaauagaagucaacagcaaagacgaaaugaacaaaugguucgaagaguucaagaaaggcaacggccucauggacaccuucaccaacuccuacuccuucugcgaaaacguaccgaaccuagacaaauucguauuccaaauggccagcgcgaccgacgacgcgcaaaaagacuccauauacgccucagcccucguagaagccaccaaauucugcgccccaaucuacgaaugcgcgugggucuccuccaccggcauagucaagaaaggacucgaaugguucgaaaagaacaccggcaccauaaaaucaugggacgacaacuacgccgaacucaaaguagacguaccaaaaaucgaacaacucgccaacuaccaacaggcggcccuaaaauggcgcaaagacauaggauuccgcgucaacgccaacaccgccgcgcuaagcaacaaaguccuggccgaauacaaagucccaggcgaaaucguaaugucggucaaagaaaugcucuccgacaugaucagacgccgcaaccucauccucaacagaggcggagacggaaacccacgcggacccgucagccacgaacacguagaauggugccgcgaguucgucaaaggaaaauacaucauggccuucaacccaccauggggcgacaucaacaaaucuggaaggagcggcaucgcacucgucgccacaggacuagccaagcucgcagaaacggaaggaaaaggagucuucgaugaagccaagcgaacaguagaagcccuaaacggauaucuggacaagcaccgagaugaagucgacaaagccagcgcagacagcaugauaaccaaccuccuaaaacacaucgcaaaagcccaagaacucuacaagaacagcucagcccuacgagcccaaggagcacaaaucgacaccccauucagcucauucuacuggcucuacaaagcaggcgucacacccgaaacauucccaaccaucagccaauuccuauucgaacucgggaaacaacccagaggaaccaaaaagaugaaaaaggcccuccucagcacccccaugaaauggggcaagaagcuauacgaacuauucgccgacgacagcuuccaacaaaaccgcauauacaugcacccggccguacuaacagccggccgaaucagcgaaaugggagucugcuucggcaccauaccgguagccaaccccgacgacgccgcccagggcuccggccacacaaaaagcauacucaaccuccgcaccucaaccgaaacaaacaaccccugcgcuaaaacaauagugaaacuguucgaaauccagaaaacaggcuucaacauccaagacauggacaucguggccagcgaacaccuccuacaccaaagccucgucgguaaacagucacccuuccaaaacgcauacaacgucaaaggcaacgcaaccuccgccaacauaaucuaa

SEQ ID NO: 8050 - RNA, 1449 nt, Artificial Sequence
  derived and/or modified CDS sequence (opt11) from CCHFV(37-ST-2009)__KR814835.1__N
auggaaaacaaaauagucguaaacagcaaagacgaaaugaacaaaugguucgaagaauucaaaaaaguaaacgggcucgucgacaccuucacaaacuccuacucauucugcgaaaacguacccaaccuggacaaauucgucuuccaaauggcgagcgcaaccgacgacgcacaaaaagacuccaucuacgccucugcccucguagaagcaacaaaauucugcgcacccauauacgaaugcgccugggucagcuccaccggaaucguaaaaaaaggccuagaaugguucgaaaaaaacgccggaaccaucaaauccugggacgaaucauacacggaacugaaagucgacguccccaaaauugaacaacucgccucguaucagcaagccgcccuaaaauggcgaaaagacaucggcuuccgcgucaacgccaacaccgccgcccuauccagcaaaguacuguccgaguacaaagucccgggcgaagucgucaugccagucaaggaaaugcuaucagacaugauccgccgccgaaaccucauccugaaccgaggcuccgacgaaaacccacgcggacccguaucgcgggagcacguagaguggugccgcgaauucguaaaagguaaauacaucauggcauucaacccccccuggggagacaucaauaaaucaggccgcagcgggaucgcacuugucgccacgggccuagccaaacucgccgaaaccgaaggcaaagggaucuucgaagaagccagaaaaacagucgaugcucuaaaagacuaccucgaccgacacaaagaagaagucgacaaaacaaacgcagacaacaugguaaccaaccucuucaaacacaucgcaaaagcacaagagcucuacaaaaacagcucugcccugcgcgcgcaaggagcccaaaucgacacaccauucucgagcuucuacuggcucuacaaagccggcgucacccccgaaaccuuuccgaccguaagccaauuccuuuucgaacuaggcaaacaaccccgcggcacacgcaagaugaaaaaagcacuccucucaacacccaugaaauggggcaagaaacucuacgaacuguucgccgacgacucguuccagcaaaaccguaucuacaugcaccccgccguacucacagccggacgagugagcgagaugggcgucugcuucggaacaauacccgucgacaacccagacgacgccgcccaaggaucaggccauaccaaaagcauacuaaaccuaagaaccucagccgaaaccaacaacccaugcgcacgcacuaucgucaaacuauucgagauccagaaagccggcuucaacauccaagaaauggacaucgucgccuccgaacaccuacuacaccaaagccuaguaggaaaacaaucacccuuccagaacgcauacaacgucaaaggcaacgccaccagugccaacaucaucuaa

SEQ ID NO: 8051 - RNA, 1449 nt, Artificial Sequence
  derived and/or modified CDS sequence (opt11) from CCHFV(59-TK-2012)__KR814833.1__N
auggaaaacaaaaucgucguaaacuccaaagacgaaaugaacaaaugguucgaagaauucaaaaaagucaacggacuggucgacaccuucacgaacuccuacucauucugcgaaaacgucccaaaccucgacaaauucguguuccaaauggccagcgccacagacgacgcacaaaaagacuccauauacgccucagcccucguagaagcaacgaaauucugcgcacccaucuacgaaugcgccugggucagcuccaccggcaucgugaaaaaaggucuagaaugguucgaaaaaaacacgggcaccaucaaaagcugggacgaaucauacaccgaacugaaaguagacguacccaaaauagaacaacucgccucguaccaacaagccgcccucaaauggcggaaagacaucggauuccgcgucaacgccaacacagccgcgcuaucaucaaaaguccugagcgaauacaagguuccaggcgaaauagucaugcccguaaaagagaugcuauccgacaugauaagaagaagaaaccuaauccucaaccguggcagcgacgaaaacccccgcggccccgucucgagagaacacgucgaauggugccgcgaguucgucaaaggaaaauacauaauggccuucaauccacccuggggagacaucaacaaaagcggacggagcggcauagcgcuaguagcaaccggccuggccaaacucgccgaaaccgaaggaaaagggaucuucgaagaagcccgcaaaacaguagacgcccucaaagacuaccuagacagacacaaagaagagguagacaaaacaaacgcagacaauaugguaacaaaccuauucaaacacauagccaaagcacaagaacucuacaaaaacucaucagcccuccgcgcacaaggcgcacaaaucgacaccccauucagcagcuuuuacuggcucuacaaagccggcgucaccccagaaaccuucccaaccguuucccaauuccucuucgaacucggcaaacaacccagaggcacccgcaaaaugaagaaagcacuacugagcacacccaugaaauggggcaaaaaacuguacgaacucuucgcagaugacucauuccaacaaaaccgcaucuacaugcacccagccguccugaccgccgggcgaaucuccgaaauggggguaugcuucggcacgauccccguagacaaccccgacgacgcagcacaaggauccggccacacaaaauccauacucaaucuccgcaccuccgccgaaaccaacaacccuugcgccaaaaccaucgucaaacucuucgaaauacaaaaagccggcuucaacauacaagagauggacauagucgccagcgaacaccuccuacaccaaucccucguaggcaaacaauccccauuccaaaacgccuacaacgucaaaggcaacgccacaagcgccaacauaaucuaa

SEQ ID NO: 8052 - RNA, 1449 nt, Artificial Sequence
  derived and/or modified CDS sequence (opt11) from CCHFV(73-ST-2013)__KR814836.1__N
auggaaaacaaaaucgagguaaacaauaaagacgaaaugaacaaaugguucgaagaauucaagaaaggcaacggacucgucgacacauucacaaacuccuacucauucugcgaauccguuccaaaccuggacaaauucguguuccaaauggcaagcgcaaccgacgacgcacaaaaggacucaaucuacgccuccgcacucguagaagccacaaaauucugcgcucccauauacgaaugcgccugggucagcuccaccggcauagucaaaaaaggccucgaaugguucgaaaaaaacgcgggaaccauaaaauccugggacgaaagcuauacagaacucaaagucgacgucccaaagaucgaacagcucgccaacuaccaacaagcagcacuaaaauggcgcaaagacaucggauuccgcguaaacgccaacaccgccgcccucuccaacaaaguccucgccgaauacaagguccccggcgagaucguaauguccgucaaagagaugcucagugacaugauccgacgccggaaccaaauccuaaaccgaggcggcgacgagaacccccgcggacccguauccagggaacacgucgacuggugccgagaguucgucaaagggaaauacauaauggccuucaacccacccuggggcgacaucaauaaguccggccgauccggaaucgcccuaguagccaccggccuagccaaacucgccgagaccgaaggcaaaggcgucuucgacgaagccaaaaaaaccguagaggcccucaacggcuaccucgacaaacacaaagacgaggucgacagagcuucagccgacucaaugaucacaaaccuccucaaacacauagcgaaagcccaagaauuauacaaaaacucaucagcccuacgcgcacaaggcgcccaaaucgacaccgccuucaguuccuacuacuggcucuauaaagcaggcgucacacccgaaacguuccccacagucagccaauuccucuucgaacucggcaaacaacccagaggcaccaaaaaaaugaaaaaagcgcuccucagcacccccaugaaaugggguaaaaaacuauacgaacucuucgcagacgacucguuccagcaaaaccgcauauacaugcaccccgccguccucacggccggccgcaucucagaaaugggcguaugcuucggaacaauacccguagcaaacccagacgacgcagcccaaggcuccggacacaccaaaagcauccucaaccuccgcaccaacaccgaaaccaacaaccccugcgccagaaccauaguaaaacucuucgagauccaaaaaaccggcuucaacauccaagacauggacauaguagccucagaacaccuccuccaccaaagccucgucggcaaacaauccccauuccaaaacgccuacaacguaaaaggcaacgccaccagcgccaacauaaucuaa

SEQ ID NO: 8053 - RNA, 1449 nt, Artificial Sequence
  derived and/or modified CDS sequence (opt11) from CCHFV(75-ST-2010)__KR814845.1__N
auggagaacaaaaucgaagucaacucaaaagacgaaaugaacaaaugguucgaggaauucaaaaaaggcaacggccucauggacaccuucacaaacucauacuccuucugcgaaaacguccccaaccuagacaaguucgucuuccaaauggccagcgccaccgacgacgcccaaaaagacagcauauacgcaucagcacuagucgaagcaacaaaauucugugcccccaucuacgaaugcgccuggguauccucgaccggcauaguaaaaaaaggccucgagugguucgaaaaaaacagcgggaccaucaaauccugggacgaaaacuacgccgaacucaaagucgacguccccaagaucgagcaacucgccaacuaccaacaagcagcucucaaauggaggaaagacaucggcuuccgcgucaacgcaaacaccgcagcccucagcaacaaaguccuugcagaauacaaaguacccggagaaaucgucaugucuguaaaagaaaugcucagcgacaugauccgacgccgcaaccucauccucaaccgaggcuccgacgaaaacccacgaggcccagucucccgcgaacaugucgaauggugccgagaauucgucaaagguaaauacaucauggccuucaaccccccauggggcgacaucaacaaaucaggcagauccggaaucgcccuagucgccaccggacuugcaaaacuagccgaaaccgaaggcaaaggcgucuucgacgaagcaaaaaaaaccguggaagcgcuaaacgguuaccuagacaaacaccgcgacgaaguagacaaggcauccgccgacagcaugaucaccaaccuacuaaaacacauagccaaagcccaagaacucuacaaaaacucaucagcacugcgcgcccaaggcgcccaaaucgacacacccuucuccuccuucuacuggcucuacaaagccggcgucacuccagaaaccuucccaaccaucagccaauuccucuucgagcugggcaaacaaccccgaggcaccaaaaaaaugaaaaaagcacuccucagcaccccaaugaaauggggcaaaaaacucuacgaacucuucgcagacgacuccuuccaacaaaaucgcaucuacaugcacccagcaguccucacugccggccgcaucagcgagaugggcguaugcuucggaacaaucccagucgcuaaccccgaugacgccgcccaaggcagcggacacacaaagucuauccucaaccuccgaaccagcaccgagaccaacaaccccugugccaaaacaaucgucaaacucuucgaaauccaaaaaacaggcuucaacauccaagacauggacaucguagcaagcgagcaccuccuccaccaaucacucguaggaaaacaaagccccuuccaaaacgccuacaacguuaaaggcaacgccaccuccgccaacauaaucuaa

SEQ ID NO: 8054 - RNA, 1449 nt, Artificial Sequence
  derived and/or modified CDS sequence (opt11) from CCHFV(CHH)__KU707898.1__N
auggaaaacaaaaucgaaguaaacuccaaagacgaaaugaacaaaugguucgaagaguucaagaaaggcaacgggcuaguagacacauucaccaacuccuacucauucugcgaaagcguacccaaccuagacagauucgucuuccaaauggccuccgccaccgacgacgcgcaaaaagacuccauauacgccuccgcucuagucgaagccacaaaauucugcgcacccaucuacgaaugcgccugggccucauccacaggcaucgucaagaaaggccucgaaugguucgagaaaaacgcaggcaccaucaaauccugggacgaauccuacacagaacucaaaguggaaguccccaaaaucgaacaacuaagcaacuaccagcaagcugcacugaaauggcgaaaagacaucggauuccgcgucaacgccaacacagccgcccucucgaacaaaguccuggccgaauacaaaguaccaggagaaaucguaaugucagucaaagaaaugcuaagcgacaugauccgccgccgcaaccucauacucaacagaggcggagacgaaaaccccagagggcccgucucacgagaacauguagaauggugccgcgaguucgucaaagggaaauacaucauggcauucaacccacccuggggcgacaucaacaaaucaggacgcucaggcauagcccucgucgccacaggacucgccaaacuagccgaaacagaaggcaaaggcgucuucgacgaggcaaagaaaaccgucgaagcccucaacggcuaccucgacaaacauaaagacgaggucgacaaagccuccgcggacucaaugauaaccaaccucuuaaaacacaucgccaaagcacaagaacucuacaaaaacagcuccgcccuccgcgcccaaggagcccaaaucgacaccguguucucaagcuacuacuggcucuauaaagcaggcgucacacccgacacguucccaaccguaucccaauuccuuuucgaacuaggaaagcaaccccgaggaaccaagaaaaugaagaaagcgcuacucucaacccccaugaaauggggcaagaaacuuuacgaacuguucgccgacgacagcuuccagcaaaaccgcauuuacaugcaccccgccguccucaccgcgggccgaauaagcgaaaugggcgucugcuucggcaccauccccguagccaaccccgacgacgcagcccucggcuccggccacaccaaaagcauccucaaccuacgcaccaauacagagaccaacaacccaugcgccaaaaccaucguaaaacucuucgaaauccagaaaaccgguuucaacauccaagacauggacaucguugccucagaacaccuccuccaccaaagccucgucggcaaacagagccccuuccagaacgccuacaacgucaaaggaaacgcaacaucagccaacaucaucuaa

SEQ ID NO: 8055 - RNA, 1449 nt, Artificial Sequence
  derived and/or modified CDS sequence (opt11) from CCHFV(CJH)__KU707899.1__N
auggaaaacaaaaucgaagucaaaaacaaacacgagaaaaacaaaugguucgaagaguucaagaaaggcaacggccuaguagacacauucaccaacucauacagcuucugcgaaaacguaccaaaccucgaccgcuucguauuccaaauggcaggcgccaccgacgacgcgcaaaaagacucaauauacgcaucagcacucguagaagccacaaaauucugugcccccauauacgaaugcgccugggcaucauccaccggcauagucaagaaaggacucgaaugguucgagaaaaacgccggaacaaucaaaagcugggacgaaaguuacacggaacucaaaguagaaguacccaaaaucgaacaacucuccaacuaccaacaagccgcacucaaauggagaaaagacaucggauuccgaggcaacgcaaacacagccgcccuauccaacaaaguccuagccgaauacaaaguccccggcgaaaucgucaugagcguuaaagaaaugcucagcgacaugauccgccgcagaaaccucauccucaaccgcggcggagacgaaaacccccgcggccccgucucccgcgaacacgucgaauggugccgagaguucguaaaaggaaaauacaucauggccuucaaucccccauggggcgacaucaacaaaucgggacgcucaggaaucgcccucguggccaccggacuagcgaaacuggcggaaaccgaaggaaaaggaguuuucgacgaagccaagaaaaccguagaagcccucaacggauaccuagacaaacacaaagacgaagucgacaaagcauccgcagacagcaugaucaccaaccuccucaaacacauagccaaagcccaagagcuuuacaaaaacucauccgcccuccgcgcccaaggagcgcaaaucgacaccgucuucuccuccuacuacuggcucuacaaagcaggaguaaccccggaaaccuucccaacaguaagccaauuccucuucgaacucggcaaacaacccagaggaacaaagaaaaugaagaaagcgcuccucagcacaccuaugaaauggggcaagaaacucuacgagcuguucgcagacgacucauuccaacaaaaccgcaucuauaugcaccccgcaguacucacagcaggacgcaucagcgaaaugggcgucugcuucggcaccauaccaguagccaacccagacgacgcggcguugggcuccggccacaccaaaucaauccuaaaccuccgaaccaacaccgaaaccaacaacccaugcgcgaaaacaaucguaaaacucuucgaaauccagaaaacaggcuucaacauccaagacauggacaucguagccuccgaacaccuccuccaccaaagccucgucggcaaacaaagucccuuccaaaacgccuacaacgucaaaggcaacgccaccucagccaacauaauauag

SEQ ID NO: 8056 - RNA, 1449 nt, Artificial Sequence
  derived and/or modified CDS sequence (opt11) from CCHFV(CLT/TI05146)__DQ227496.1__N
auggaaaauaaaaucgaaguaaauaacaaagacgaaaugaauaaaugguucgaagaguucaaaaaaggcaacggccucguagacacguucaccaacucauacuccuucugcgaaucgguccccaaccuggaccgauucgucuuccaaauggccuccgccacagacgacgcccaaaaagacuccaucuacgccucagcccuaguagaagcaacaaaauucugcgcccccauauacgaaugcgccuggguaagcuccaccgggauuguaaaaaaaggccuagaaugguucgaaaagaacgccggcaccauaaaaucaugggacgagucauauaccgaacuaaaagucgaagucccgaaaaucgaacaacucgccgacuaccaacaagccgcacugaaauggagaaaagacauaggcuuccgagucaacgccaacaccacagcacucucccacaaaguccuagccgaauacaaagucccaggcgaaauagugaugucaguaaaagaaaugcucuccgacaugauacgccggcgcaaccucauccugaaccggggcggagacgaaaacccgcgcggaccuguaucccgggaacacgucgaauggugccgcgaauucguaaaagggaaauacaucauggccuucaacccaccauggggcgacauaaacaaauccggacgcuccggcauagcccucguagcaaccggccuagccaaacucgcagaaacagaaggaaaaggggucuucgacgaagccaaaaaaacagucgaagcccucaauggauaccucaacaaacacaaagacgaaguagacaaagccuccgccgacucaaugaucaccaaccuccuaaagcacaucgccaaagcccaagaacucuacaaaaacuccagcgcucucagagcccaaggagcacaaaucgacaccgcguucagcucauacuacuggcucuacaaagccggaguaacccccgaaacguucccgaccguaucccaauuccucuucgaacuaggcaagcagccccgggggaccaaaaagaugaaaaaagcccuacucagcaccccacugaaauggggaaaaaaacucuacgaacuuuucgccgacgacuccuuccaacaaaaccgcauauacaugcaccccgcaguccuaaccgcaggacgcauaagcgaaaugggaguaugcuucggaacaauccccgucgccaaccccgacgacgccgcccagggaagcgggcacacaaaaagcauauuaaaccuacgcacaaacaccgaaaccaacaacccgugcgccaaaacaaucgugaaacucuucgaaauccaaaaaaccggauucaacauacaagacauggacaucgucgccagcgaacaccuccuccaccaaucgcuagucgggaaacaaucccccuuccaaaacgccuacaacgucaaaggcaacgcaaccuccgcaaacauaaucuaa

SEQ ID NO: 8057 - RNA, 1449 nt, Artificial Sequence
  derived and/or modified CDS sequence (opt11) from CCHFV(CYT/TI05099)__DQ227495.1__N
auggaaaacaaaaucgaaguaaacaacaaagacgaaaugaacaaaugguucgaagaguucaagaaaggcaacggacucguagacaccuucacaaacuccuacagcuucugcgaauccguaccaaaccuagaccgguucguauuccaaauggccuccgccaccgacgacgcacaaaaagacuccaucuacgcauccgcccucgucgaagcaacaaaauucugcgcacccauauacgaaugcgcgugggucagcucaacaggcaucgucaagaaaggacucgaaugguucgagaaaaacgccggaaccauaaaaucaugggacgaaucauacacagaacuaaaaguugaaguccccaaaaucgagcaacuagcagacuaccaacaagcagcucucaaauggagaaaagacauuggcuuccgcguaaacgcaaacaccaccgcccucucacacaaaguccuagccgaauacaaagugcccggcgaaaucgucaugagcgucaaagaaaugcuauccgacaugauacgacgccgcaaccugauccucaaccgcggcggggacgagaacccccgcggccccgugagccgagagcacgucgaauggugccgagaguucguaaaaggaaaauauaucauggcauucaacccacccuggggagacaucaacaaaucaggcagaagcggaaucgcacucgucgcaacaggccuggccaaacuagcagaaaccgaaggaaaaggcgucuucgacgaagcaaagaaaacagucgaagcacucaacggcuaccuaaauaaacacaaagacgaagucgacaaagcuagcgcagacuccaugaucaccaaccuccuaaaacacauagccaaagcccaagaacucuacaaaaacucaucagcacuaagagcccaaggcgcacaaaucgacacagccuucucaagcuacuacuggcucuacaaagcaggcgucacccccgaaacauucccaaccgucagccaauuccuauucgaacuaggcaaacaaccacgcggcacaaagaaaaugaagaaagcacuacucuccacaccacucaaauggggaaagaaacuauacgaacuauucgccgacgacuccuuccagcaaaaccgcauauacaugcaccccgcaguccucaccgccggacguauaagcgaaaugggcgucugcuucggaaccaucccagucgcaaaccccgaugacgcagcucagggauccggccacaccaaaagcauccccaaccuccgcacaaauaccgagaccaacaaccccugcgccaaaacaaucguaaaacucuucgaaauccagaaaaccggguucaacauacaagacauggacauagucgcaucggaacaccucuuacaccaaagccuagucggcaaacaaagcccauuccaaaacgccuacaacgucaaaggcaacgccacgagcgcaaacauaaucuag

SEQ ID NO: 8058 - RNA, 1449 nt, Artificial Sequence
  derived and/or modified CDS sequence (opt11) from CCHFV(Dubai 616)__JN108025.1__N
auggaaaauaaaaucgaagucaacaacaaagacgaaaugaacaaaugguucgaagaguucaagaaaggaaacggacucgucgacacuuucaccaacuccuacagcuuuugcgaauccguacccaaccucgacagauucgucuuucaaauggccggcgcgaccgacgacgcccaaaaagacuccaucuacgcauccgcccuagucgaagcaaccaaauucugcgcacccaucuacgaaugcgcgugggugagcucgaccggcaucgucaagaaaggccucgaaugguucgagaaaaacgccgguaccauaaaauccugggacgaaucauacacggaacucaaaguagaaguacccaaaaucgaacaacuggccaauuaccaacaagcggcccucaaauggcgcaaagacauaggauuccguguaaacgccaacacagccgcccucucccacaaaguccucgcagaauacaaagucccaggcgaaauagucauguccgucaaagaaaugcuaagcgacaugauccgacgccgaaaccugauacuuaacagaggaggcgacgaaaacccccgcggcccaguaagccgagaacacgucgaauggugccgagaauuugucaaaggcaaauacaucauggccuucaacccgcccuggggcgacaucaacaaaagcggcagaagcggcaucgcacucguagcaacaggacucgccaaacucgcagaaaccgaaggaaaaggagucuucgacgaagccaagaaaaccgucgaagcccucaacggcuaccuggacaaacacaaggacgaagucgacaaagccagcgccgacaacaugaucacaaaccuacucaaacacaucgccaaagcacaagaacucuacaaaaacagcucagccuugcgagcacaaggcgcccaaaucgacacagccuucucgagcuacuacuggcuauacaaagcaggcgucacccccgaaacauuucccaccguaucacaauuccucuucgaacucggcaaacaaccccggggcaccaagaaaaugaagaaagcccuacuguccacccccaugaaauggggaaagaaacuguacgaacucuuugccgacgacucauuccaacaaaaccgcaucuacaugcaccccgcaguccucacggccggccgaaucagugaaaugggagucugcuucgggaccauaccagucgccaacccagacgacgcugcacaaggauccggccacacaaaaagcauacucaaccucagaaccaacacugaaacaaacaacccgugcgccaaaacaaucgucaaacucuucgaaauccagaaaaccggauuuaacauccaagacauggacaucgucgccagcgaacaccuacuacaccaaucccucgucggaaaacaaagccccuuccaaaacgccuacaacgugaaaggcaacgccaccagcgccaacaucauauaa

SEQ ID NO: 8059 - RNA, 1449 nt, Artificial Sequence
  derived and/or modified CDS sequence (opt11) from CCHFV(GRH)__KU707900.1__N
auggaaaacaaaaucgaagucaacuccaaagacgagaugaacaaaugguucgaagaguucaagaaaggaaacggauuagucgacaccuucacgaacagcuacucauucugcgaauccgucccaaaccucgaccgcuucguauuccagauggccagcgcaacagacgacgcgcaaaaagacagcaucuacgcaucagcccuagucgaagcaaccaaauucugcgcccccaucuacgaaugcgcgugggcauccucaaccggaaucguaaagaaaggccucgaaugguucgagaaaaacgccggcacuaucaaaucaugggacgaaucauacaccgaacucaaaguagaaguacccaaaauagaacaacucagcaacuaccaacaagccgcacuaaaauggagaaaagacaucggcuuccgcgucaacgccaacacagccgcccuguccaacaaaguccucgcggaauacaaagucccaggcgaaaucgucauguccgucaaagaaaugcuaagcgacaugaucagacgccgaaaccuaauacugaaccgcggcggcgacgaaaacccccgcggccccgucucacgagaacacgucgaauggugccgcgaguucgucaaaggcauguacaucauggccuucaacccacccuggggcgacauaaacaaaucaggacgcagcggaaucgcgcucgucgccacaggacuagcaaaacuagccgaaaccgaagggaaaggagucuucgacgaagccaagaaaacaguagaagcccucaacggauaccucgacaaacacaaagacgaaguagacaaagccagcgcagacucaaugauaaccaaccuccuaaaacacaucgccaaagcgcaggaacucuacaagaacuccucagcccuacgagcccaaggagcccaaaucgacacagucuucagcaguuacuacuggcuuuacaaagcaggcguaacccccgacacauuccccacagucucccaguuccuauucgaacuaggcaagcagccccgaggcaccaaaaagaugaagaaagcgcuccucagcacacccaugaaauggggcaagaaacuauacgaacucuucgccgacgacuccuuccaacaaaaccgcaucuacaugcaccccgccguccuaacagccggacgcauauccgaaaugggcguauguuucgggaccaucccaguagccaacccagacgacgccgcccucggauccggccacaccaaaagcauacucaaccuccgcaccaacaccgaaacaaacaaccccugcgcaaaaacaaucguaaaacuauucgagauccagaaaaccggauucaacauacaagacauggacaucgucgccagcgaacaccuacuacaccaaagccuagucggcaaacaaucccccuuccaaaacgcauacaacgucaaaggcaacgcaacaagcgcaaacaucaucuaa

SEQ ID NO: 8060 - RNA, 1449 nt, Artificial Sequence
  derived and/or modified CDS sequence (opt11) from CCHFV(Iran-Gilan69)__KJ027521.1__N
auggaaaacaaaaucgaaguuaacuccaaagacgaaaugaacaaaugguucgaagaauucaaaaaaggcaacgggcucauggacaccuucaccaacucauacagcuucugcgaaaacguccccaaccucgacaaauucguguuccagauggcaagcgccaccgacgacgcccaaaaagacuccaucuacgccuccgcccucgucgaagccaccaaauucugcgcacccauauacgaaugcgcguggguauccagcacaggcaucgucaaaaaaggccuagaaugguucgaaaaaaacagcggcacaauaaaaucaugggacgaaaacuacgccgaacuaaaagucgacguacccaaaaucgaacaacuggccuccuaccaacaagccgcacucaaauggcgaaaagacaucgguuuccgcgucaacgccaacacagccgcccucuccaacaagguacuagcagaauacaaagucccaggagagaucgucaugucagucaaagaaaugcuuagcgacaugauccgacgaagaaaccucauccugaaccgcggaggcgacgaaaacccccgcggcccuguaagccgagaacacgucgaauggugccgcgaguucgucaaaggaaaauauaucauggccuucaacccacccuggggcgacauaaacaagucaggaagaagcggaauagcccucgucgccacaggacuagcaaagcucgccgaaaccgaaggcaaaggagucuucgacgaagcaaaaaaaacagucgaagcccucaacggauaccucgacaaacaccgcgacgaaguagacaaagcguccgccgacuccaugaucaccaaccuacuaaaacacaucgccaaagcacaagaacucuacaaaaauuccucagcacuccgcgcccaaggcgcacaaaucgacacccccuucuccucauucuacuggcucuacaaggcgggcgucacgccagaaacauuccccacaauaucccaauuccuauuugaacuuggcaaacagccccgaggaaccaaaaaaaugaaaaaagcccuccuaagcacaccaaugaaauggggcaaaaaacuauaugaguuauucgccgacgacucguuccagcaaaaccgcaucuacaugcaccccgcugugcucacagccggccgaaucagcgaaaugggcguaugcuucggaaccauccccgucgccaaucccgacgacgcggcccaaggcucaggccacaccaaaagcauccucaaccuacggacauccacagaaacaaacaacccaugcgccaaaaccaucguaaaacucuucgaaauccaaaaaacaggcuucaacauacaggacauggacaucguagccuccgagcaccuccuacaccaaucacucgucggcaaacaguccccuuuccaaaacgccuacaacgucaaaggcaacgccacguccgccaacaucaucuaa

SEQ ID NO: 8061 - RNA, 1449 nt, Artificial Sequence
  derived and/or modified CDS sequence (opt11) from CCHFV(Iran-Isfahan78)__KJ027522.1__N
auggaaaacaaaauagaaguaaacuccaaagacgaaaugaacaaaugguucgaagaauucaaaaaaggcaacggacuaauggacacauucaccaauucuuacuccuucugcgaaaacgucccaaaccucgacaaauucgucuuccaaauggcauccgccaccgaugacgcacaaaaagacucaaucuacgccuccgcacuaguagaggccaccaaauucugcgcgccaaucuacgaaugcgcauggguaagcucaacaggcaucgucaaaaaaggccuggaaugguucgagaaaaacagcggaacaauaaaauccugggacgaaaacuacgcagaacucaaagucgacguccccaaaauagaacaacuagcaaacuaccaacaggccgcacuaaaauggcgaaaagacaucggcuuccgcgucaacgccaacacagccgcccucuccaacaaaguccucgccgaauacaaaguccccggcgaaaucguaauguccgucaaagagaugcuauccgacaugauccgccgccgcaaccuaauacuaaacagaggcggagacgaaaacccccgcggacccgucucacgcgaacacgucgaauggugccgugaauucguaaaaggcaaauacauaauggccuucaacccccccuggggcgacaucaacaaaagcggccguuccggaauagcccuggucgcaaccggccucgcuaagcuagcagaaaccgaaggcaaaggcguauucgacgaagccaaaaaaacaguagaagcccuuaacggcuaccuagacaaacaccgcgacgaaguagacaaagccagcgccgacuccaugauaaccaaccuccuaaaacacaucgcaaaagcccaagaacuauacaaaaacagcucagcccuaagagcacaaggagcccaaaucgacacuccauucuccagcuucuacuggcuauacaaagcaggcguaacccccgagaccuucccaacagucucccaauuccucuucgaacucggaaagcaaccccgagguacgaaaaaaaugaagaaagcccuccucaguacacccaugaaauggggaaaaaaacucuacgaacuauucgccgacgacuccuuccaacaaaaccgcauauacaugcacccagcaguacucaccgccggaagaauaagcgaaaugggcguaugcuucggcaccaucccagucgccaaccccgacgacgccgcacaaggcucaggacacacaaaauccauccuaaaccuccgcacauccacugaaaccaacaaccccugcgcaaaaaccauagucaaacucuucgagauccaaaaaaccggauucaacauacaagacauggacaucgucgccuccgaacaccuccugcaucaaucccucgucggaaaacaaucaccauuccaaaacgcauacaacgucaagggcaacgccacaucagccaacaucaucuaa

SEQ ID NO: 8062 - RNA, 1449 nt, Artificial Sequence
  derived and/or modified CDS sequence (opt11) from CCHFV(Iran-KhRazavi72)__KJ485700.1__N
auggaaaauaaaauagaaguaaaaaacaaacacgaaaagaacaaaugguucgaagaguucaaaaaaggcaacggguuaguagacacauucccaaauagcuacagcuucugcgaaaacguccccaaccucgaccgcuucguauuccaaauggccggagcaaccgaugacgcacaaaaagacuccaucuacgccuccgcccugguagaggccaccaaauucugcgcacccaucuacgagugcgcaugggcgagcucaacaggcaucgugaaaaaaggccuggagugguucgaaaaaaacgcaggcaccaucaaaucaugggacgaaucauacaccgagcucaaagucgaaguccccaaaauagaacaacuaagcaacuaccaacaagcggcacuaaaauggcgaaaagacauaggauucagaggcaacgccaacacggccgcacugucaaacaaaguccucgccgaauacaaaguccccggcgaaaucguaauguccguaaaagaaaugcucucugacaugauacgccgccgcaaccuaauccuuaaccgcggcggcgacgaaaacccgcgcggccccguaucccgugaacacgucgaauggugccgcgaauucauaaaaggaaaauacaucauggcguucaacccacccuggggcgacauaaacaaauccggacgaagcgggaucgcccucguagccaccggccuagccaagcuagccgaaaccgaaggaaagggcguauucgacgaggccaaaaaaaccgucgaggcacucaacggauaccuagacaaacacaaagacgaaguagacaaagcgagcgcagacuccaugaucacaaaccuccuaaaacacauagccaaagcccaagaacucuacaaaaacuccagcgcccuccgcgcccaaggagcccagaucgacaccguguucagcucauacuacuggcuauacaaagcgggagucacaccggaaaccuucccaaccguaagccaauuccuauucgaacuaggaaaacaaccccgcggaaccaaaaaaaugaaaaaagcccuccuauccacccccaugaaauggggaaaaaaacucuacgaacuauucgccgacgacagcuuccaacaaaacagaaucuacaugcaccccgccguacuaaccgccggacguaucagcgaaaugggagucugcuucggcaccauaccagucgccaaccccgacgacgcagcacucggauccggacacacuaaaagcauccucaaccuccgcacgaacaccgaaaccaacaacccaugcgccaaaaccaucgucaaacuuuucgaaauccagaaaaccggcuucaacauccaagauauggacaucguagccagcgagcaccuccuacaccaaagccucguaggcaaacaaagcccguuccaaaacgccuacaacguaaaaggcaacgcaaccagcgccaacauaaucuaa

SEQ ID NO: 8063 - RNA, 1449 nt, Artificial Sequence
  derived and/or modified CDS sequence (opt11) from CCHFV(Iran-Zahedan19)__KJ676542.1__N
auggaaaacaaaauagaaguaaacaacaaagacgagaugaacaaaugguucgaagaauucaaaaaaggcaacggccucguagacaccuucacaaacuccuacuccuucugcgaaagcguccccaaccuagaccgcuuugucuuccaaauggcaggggcaaccgacgacgcccaaaaagacucaaucuacgccagcgcacuagucgaggccaccaaauucugcgccccaaucuacgaaugcgcuugggucagcuccaccggcaucguaaaaaagggccuagaaugguucgaaaaaaacgccggcacgaucaaaagcugggacgaauccuacacagaacuaaaagucgaaguacccaaaaucgaacaacucgccaacuaccaacaagccgcacuaaaauggcgcaaagacaucggcuuccgaguaaacgccaacacggccgcccugucacacaaaguacuggcagaguacaaggucccaggcgaaaucguaaugucaguaaaagaaaugcuaucagacaugaucagacgacgaaaccuaauccuaaaccgaggaggcgacgagaacccgcgaggcccagucuccagggaacaugucgaauggugccgagaauucgucaaaggaaaauacaucauggccuucaacccccccuggggagacaucaacaaaagcggccgcagcggaaucgcccuaaucgccacaggccuugcaaaacucgcagaaacagaaggcaaaggcgucuucgacgaagccaaaaaaaccguagaagcccucaacggcuaccucgacaaacacaaagacgaaguagacaaagccagcgcagacaauaugaucacaaacuugcuaaaacacauagccaaagcccaagaacucuacaaaaacagcuccgcacuccgagcacaaggagcacaaaucgauacagccuucucgucauacuacuggcucuacaaagccggcgucaccccagaaacauucccgaccgucagccaauuccucuucgaacuuggcaaacaaccccgcggcaccaagaaaaugaaaaaagcacuacuauccacgcccaugcgcuggggaaaaaaacuauacgaacucuucgcugacgacagcuuccaacaaaaccgcauauacaugcaccccgccguccuaacagcaggccgcauaagcgaaaugggcgucugcuucggcacgaucccagucgccaaccccgacgacgccgcacaaggcuccggccacacaaaaaguauacuaaaccuccggacgaacaccgaaacgaacaaccccugcgccaaaacgaucgugaaacuauucgaaauccaaaaaacuggcuucaacauccaagacauggacaucguagccagcgaacaccuccugcaccaaagccucgucgguaagcaauccccauuccaaaacgccuacaacgucaagggcaacgcaacauccgccaacauaaucuaa

SEQ ID NO: 8064 - RNA, 1449 nt, Artificial Sequence
  derived and/or modified CDS sequence (opt11) from CCHFV(NIV 112143)__JN572089.1__N
auggaaaacaaaauagaaguaaacaauaaagacgagaugaacaaaugguucgaagaguucaagaaagguaacggacucguagacacauucacaaacucguacucauucugcgaaucagucccaaaccucgaccgauucguauuccaaauggccuccgcgaccgacgacgcacaaaaagacagcauauacgccuccgcccucgucgaagccacgaaauucugcgcacccauuuacgaaugcgccugggucagcucgaccggaauagugaagaaaggccucgaaugguucgagaaaaacgcagggaccaucaaaagcugggacgaaagcuacacagaacuaaaagucgaaguccccaaaauagaacaacuagccaacuaccaacaagcggcccucaaauggagaaaagacauaggauucagaguaaacgccaacacagccgcacucucgcacaagguccucgcagaguacaaaguccccggcgagaucgugaugucagucaaagaaaugcuaucagacaugaucaggcguagaaaccuaauauuaaaccgaggcggggacgaaaacccgcgcggacccguuuccagggaacacgucgaauggugccgcgaguucguaaaaggaaaauacaucauggccuucaacccacccuggggcgacaucaacaaaucaggccgcagcggaaucgcacucauagccaccggccuggccaaacucgccgaaacagaaggcaaaggagucuucgacgaagccaagaaaacaguagaagcacuaaacggguacuuggacaaacacaaagacgaagucgacaaagcaucagcagacaacaugaucacaaaccuccuaaaacacauagcaaaagcccaagagcucuacaaaaacagcucggcccuacgcgcacaaggagcccaaaucgacacagccuucucaagcuauuacuggcuauacaaagcgggcgucacccccgaaacauuccccacagucagccaguuccucuucgaacuagggaaacaaccaagaggcacgaaaaagaugaagaaagcccuccugagcacgcccaugcgcuggggaaagaaacuauacgaacucuucgccgacgacucauuccaacaaaaccggauuuacaugcaccccgccguacuuacggccggccgcaucagcgagaugggcguuuguuucggaaccauaccagucgccaacccagacgacgcagcacaaggcucaggacacaccaaaagcauacucaaccuccgaaccaauaccgagaccaacaaccccugcgcuaaaacaaucgugaaacuguucgaaauccagaaaaccggcuucaacauacaagacauggacaucguagcaucagagcaccuccuccaccaaagccuaguaggaaaacaaagccccuuccaaaacgcguacaacguaaaaggcaacgccacgagcgccaacauaaucuaa

SEQ ID NO: 8065 - RNA, 1449 nt, Artificial Sequence
  derived and/or modified CDS sequence (opt11) from CCHFV(NIVA 118595)__JN572088.1__N
auggaaaacaaaaucgaaguaaacaacaaagacgaaaugaacaaaugguucgaagaguucaagaaaggcaacggccuaguagacaccuucaccaacucauacuccuucugcgaaucagucccaaaccucgaccgcuucguguuccagauggcgagcgcgaccgacgacgcccaaaaagacagcauauacgccagugcccuggucgaagcaacaaaauucugcgcacccaucuacgaaugcgcguggguaagcagcaccggaaucgucaagaaaggacucgaaugguucgagaaaaacgcaggcaccauaaaaucaugggacgaaagcuacacagaacucaaagucgaagucccaaaaaucgaacaacucgccaacuaccaacaagcagccuuaaaauggagaaaagacaucggauuccgagucaacgcaaacacagcagcccucagccacaaaguccucgcagaauacaagguccccggcgaaauagucauguccgucaaagaaaugcucagcgacaugauacgucgaaggaaccuaauccuaaaccgcggaggcgacgaaaacccacgcggccccguaucccgcgaacacguagaguggugccgcgaguucgucaaaggaaaauacaucauggccuucaaucccccauggggagacaucaacaaaucaggacgcuccggcauugcccucguagcaacgggccucgcaaaacucgccgaaacagaagggaaaggcgucuucgacgaagccaagaaaacagucgaagcccucaacggcuaccuagacaaacacaaagacgaaguagacaaagccagcgcagacaacaugauaacaaaccuccucaaacacaucgccaaagcccaagaacucuacaaaaacuccagcgcccuccgcgcccaaggcgcccaaauagacacugcauucucaucauacuacuggcucuacaaagcaggcguaaccccagaaacauuccccaccgucucccaauuccuguucgaacuaggaaaacaaccacgcggcaccaagaaaaugaagaaagcccuccucuccacccccaugcgcuggggcaagaaacuguacgaacucuucgcagacgacuccuuccaacaaaaccggaucuacaugcaccccgccguccucaccgccggacgcaucucagaaaugggaguaugcuucggaacaauacccguagccaacccagacgacgccgcccaaggaagcggccacaccaaaagcauccucaaccuaagaaccaacaccgaaacaaacaaccccugugcaaaaacaaucgucaaacucuucgaaauccagaaaaccggcuucaacauacaagacauggacauuguggcaucagaacaccuacuacaccaaucgcucgucggcaaacaaucccccuuccaaaacgccuacaacgugaaaggaaacgcgacgucagccaacaucaucuaa

SEQ ID NO: 8066 - RNA, 1449 nt, Artificial Sequence
  derived and/or modified CDS sequence (opt11) from CCHFV(SPU 130/89)__KJ682821.1__N
auggaaaacaaaaucgaagucaacaacaaagacgaaaugaacaaaugguucgaagaguucaagaaaggcaacggccuugucgacaccuuuacgaacucauacuccuucugcgaaagcguucccaaccucgacaaauucgucuuccaaauggcauccgcaaccgaugacgcacaaaaagacucaauauacgccagcgcccucguagaggcaaccaaauucugcgcacccaucuacgagugcgcgugggucagcuccaccggcaucgucaaaagaggccuagaaugguucgaaaaaaacgcuggcacaaucaaauccugggacgaauccuacaccgaacuaaaaguagacgucccaaaaaucgaacagcucgcgaacuaccaacaagccgcacuuaaauggcgaaaagacauaggcuuccgcguaaacgccaacacagcagcacucucaaacaaaguccucgccgaauacaaggucccaggcgaaaucguaauguccgucaaagaaaugcucagugacaugauccggcgaaggaaccagauacuaaacaggggcggcgacgaaaacccgcgcggacccgucucccgcgaacacgucgacuggugcagagaauucgucaaaggcaaguacaucauggccuuuaacccacccuggggcgacaucaauaaauccggccgcagcggaaucgcacuaguagccaccggccuggccaaacuagcggaaacagaaggcaaaggggucuucgacgaggccaaaaaaaccgucgaagcccucaacggauaccuagacaaacacaaagacgaagucgaccgcgcgucagccgacagcaugaucacaaaccuccucaaacacaucgccaaagcccaagaacuauacaagaacagcucagcccugcgcgcacaaggagcccaaaucgacaccgccuucucaaguuacuacuggcucuacaaagcaggcgucacccccgaaacauuccccacagugagccaauuucucuucgaacuaggaaaacaaccccgcgguacaaaaaaaaugaaaaaagcacuccuaucaacccccaugaaauggggcaaaaaacucuacgaauuauucgcagacgacuccuuccaacaaaaucgaaucuacaugcaccccgccguccucaccgcaggacgaaucagcgaaaugggcguaugcuucggcacaauccccguagccaaccccgacgacgcagcacaaggcagcggccacacaaaaagcauccuuaaccuaaggaccaacaccgaaaccaacaaccccugcgcacgcacaaucgucaaacuauucgaaauccaaaaaaccggcuucaacauacaagacauggacaucgucgccagcgaacaccuacuacaccagagccuagucgggaaacagagcccauuccaaaacgccuacaacguaaaaggaaacgccaccucggcaaacaucgucuaa

SEQ ID NO: 8067 - RNA, 1449 nt, Artificial Sequence
  derived and/or modified CDS sequence (opt11) from CCHFV(SPU 18/88)__KJ682818.1__N
auggaaaacaaaauagaagucaacaacaaagacgagaugaacaaaugguucgaagaguucaagaaaggcaacgggcucguagacacauucaccaacuccuacagcuucugcgaaucgguccccaaccucgacaaauucgucuuccaaauggccagcgccaccgacgacgcccaaaaagacucaauauacgccucagcacuggucgaagcaacaaaauucugcgcacccauauacgaaugcgcauggguaucauccaccggcauaguaaaacggggccuagaaugguucgagaaaaacgcaggaaccauaaaauccugggacgaauccuacacagaauuaaaaguagacguccccaaaaucgaacaacuagccaacuaccaacaagcagcccucaaauggagaaaggacaucggcuuccgcguaaaugccaacaccgccgcacucagcaauaaaguccuagccgaauacaaaguaccaggcgaaaucgucauguccguuaaagaaaugcuauccgacaugaucagacgccgaaaccaaauccugaaccgaggaggagacgaaaacccccgcggcccaguaucacgcgaacacgucgacuggugccgugaguucguaaaaggcaaauacauaauggccuucaacccacccuggggcgacaucaacaaaucgggccgcucaggaauagcccucguggcaaccggacucgccaaacuagccgaaacagaaggcaaaggcgucuuugacgaagcaaagaaaacagucgaagcucuaaacggcuaccuggacaaacacaaagacgaggucgauagagcaagcgcagacagcauggucaccaaucugcuaaaacacauagccaaagcgcaagaacucuacaaaaacucaagcgcccuccgcgcccaaggggcccaaaucgacacagccuucucaagcuacuacuggcuauacaaagcaggcgucacacccgaaacguuccccacgguaagccaauuccuauucgaacuaggcaaacaaccgcggggaacaaagaaaaugaagaaagcacuccucagcacacccaugaaauggggaaagaaacucuacgaacucuucgccgacgacucauuccaacaaaaccgcaucuacaugcacccagccgugcuaaccgccggccgaaucuccgagaugggcgucugcuucggcaccauccccguagccaaccccgacgacgcugcccaaggcuccggacacaccaaaagcauccuaaaccuccgcaccaacacagaaaccaacaaccccugcgcucgcaccaucguaaaacucuucgaaauacagaaaacaggguucaacauccaagacauggacauaguagccagcgaacaccuucuccaccaaucccuaguaggcaaacaaagcccauuccaaaacgcauacaacguaaaaggcaacgccacgagcgcaaacauaaucuaa

SEQ ID NO: 8068 - RNA, 1449 nt, Artificial Sequence
  derived and/or modified CDS sequence (opt11) from CCHFV(SPU 187/90)__KJ682823.1__N
auggagaacaaaauagaagucaacaacaaagacgaaaugaacaaaugguucgaagaguucaaaaagggcaacggccuagucgacaccuucaccaacucguacuccuucugcgaauccguaccaaaccucgacaaauucgucuuccaaauggccucagccaccgacgacgcgcaaaaagacucgaucuacgccucagcacucgucgaagcaacgaaauucugcgcccccaucuacgagugcgccuggguaaguagcacaggaaucgucaaaagaggacuggaaugguucgagaaaaacgcgggcaccauaaaaagcugggacgaauccuauaccgaacucaaagucgacguacccaaaaucgaacaacucgccaacuaccaacaagcggcccucaaauggcgcaaagacauaggcuuccgagucaacgccaacacagcagcacuauccaacaagguccucgcagaauacaaaguccccggcgaaaucgugaugucagucaaggaaaugcucucagacaugauacggcgccgcaaccaaauccucaaccggggcggcgacgaaaacccacgaggacccgucagcagagaacacgucgacuggugccgcgaguucgucaaaggcaaauacaucauggcauucaaucccccauggggagacaucaacaaaucgggccgcuccggcaucgcccuaguggcaaccggacucgccaaacuagccgagaccgaaggcaaaggcguuuucgacgaagccaaaaagacagucgaagcacuaaacggcuaccuggacaaacacaaggacgaaguagaccgcgcaagcgccgacagcaugauaaccaaccuccucaaacauaucgcaaaagcgcaagaacucuacaaaaacagcucagcccuacgcgcgcaaggcgcacaaaucgacaccgcauucagcucauacuacuggcuauacaaagccggcgucacccccgaaaccuuccccaccguaucccaauuccuauucgaacucggcaaacaacccagaggaaccaagaaaaugaagaaagcacuccuaagcacgcccaugaaauggggcaagaaacucuacgaacucuucgccgacgacucauuccaacaaaaccgaauauacaugcaccccgcaguacucaccgccggccgcauaucagaaaugggaguuugcuucggaaccauacccguagccaaccccgacgacgcagcccaaggcagcggccacaccaaaucaauccucaaccuccaaaccaacacugaaacaaacaacccaugcgcacgcacaauaguaaaacuauucgaaauccagaaaacuggauucaacauccaagacauggacaucgucgcaucagagcaccuccuacaccaaagccuggucgggaaacaaagccccuuccaaaacgccuacaacgucaaaggcaacgcaacaagcgcaaacauaaucuaa

SEQ ID NO: 8069 - RNA, 1449 nt, Artificial Sequence
  derived and/or modified CDS sequence (opt11) from CCHFV(SPU 383/87)__KJ682816.1__N
auggaaaacaaaaucgaaguaaacaacaaagacgaaaugaacaaaugguucgaagaauucaaaaaaggcaacggccuagucgacaccuucacuaacucauacucauucugcgaauccguaccaaaccucgacaaauucgucuuccaaauggccggcgcaaccgacgacgcccagaaagacuccaucuacgcaagugcacuggucgaagcaaccaaguucugcgccccaaucuacgaaugcgccugggucagcucuaccggcaucgucaaacgcggacuggaaugguucgaaaaaaacgccggcaccauaaaaucaugggacgaaagcuacaccgaacuaaaagucgacguacccaaaaucgaacaauuagccaacuaccaacaagcagcacucaaauggcgaaaagacauaggcuuccgcgucaacgccaacaccgccgcucucagcaacaagguacuagccgaauacaaaguccccggagaaaucgucauguccguaaaagaaaugcucucagacaugauaagacgcaggaaccagauccuaaaccgaggcggagacgaaaacccacgcggacccguaagccgcgaacacguagacuggugccgagaauucgucaaaggcaaauacauaauggcauucaauccccccuggggcgacaucaacaaauccggccgcagcggcauagcccuaguagcaaccggacucgcaaagcucgccgaaacagaaggcaagggcgucuucgacgaagccaaaaaaacagucgaagcacucaacggauaccuagacaaacacaaagacgaagucgaccgcgccuccgccgacagcaugaucaccaaccuccucaaacacaucgccaaagcacaagaauuauacaaaaacagcucagcacucagagcacaaggagcccagaucgauacggccuucucgagcuacuacuggcuguacaaagcgggagugacacccgaaacauuccccaccguaucacaauuccuauucgagcucggcaaacaaccccgcggcaccaagaaaaugaaaaaagcgcuccuguccacucccaugaaauggggaaaaaaacucuacgaacucuucgccgacgacagcuuccaacaaaacagaaucuacaugcaccccgcaguccuaaccgccggccgaauaagcgaaaugggcgucugcuucggcacaauacccgucgccaaccccgacgacgccgcccaaggcucugggcauaccaaaagcauccuuaaccuacgcacgaacaccgaaaccucaaacccaugcgcacguaccaucgucaaacuauucgaaauccagaaaaccggauucaacauacaagacauggacaucguagcaagcgaacaccuacuccaccaaagccuugucggcaaacaaagcccguuccaaaacgcauacaacguaaaaggcaacgccaccagcgcaaacaucguauaa

SEQ ID NO: 8070 - RNA, 1449 nt, Artificial Sequence
  derived and/or modified CDS sequence (opt11) from CCHFV(SPU 383/87)__KJ682816.1__N
auggaaaacaaaaucgagguaaacaacaaagacgaaaugaacaaaugguucgaagaguucaagaaaggaaacggccuagucgacaccuucaccaacuccuacagcuucugugaauccgucccaaaccucgacaaauucgucuuccaaauggccggagcaaccgacgaugcccaaaaagacucaaucuacgccucagcccuaguagaagcaacaaaauucugcgcacccaucuacgaaugcgccuggguaagcagcacaggcaucgucaaaagaggacucgaaugguucgagaaaaacgcggggaccauaaaauccugggacgaaucauacaccgaacucaaaguggacguccccaaaaucgaacaacuagcaaacuaccaacaagcagcccucaaauggcgaaaagacauaggcuuccgcguaaacgccaacacagccgcccucuccaacaaaguccuggcagaauacaaagucccaggcgaaaucgucauguccgucaaagaaaugcucagcgacaugauccgccgacgaaaccaaauacuaaaccgcggcggcgacgaaaacccccgcggcccagucucccgagaacacgucgacuggugccgagaguucgucaaagggaaauacaucauggcauucaacccgcccuggggcgacaucaacaaaucaggccgaagcgguaucgcccucgucgccaccggccucgccaaacuagcagaaaccgaaggcaaaggggucuuugacgaagccaagaaaacaguagaagcccucaacggguacuuagacaaacacaaagacgaagucgaccgcgccuccgcagacucuaugauaacaaaccuccucaaacacaucgccaaagcccaagagcuauacaaaaacagcucagcccuacgcgcacaaggagcacaaaucgacaccgcauuuagcuccuacuacuggcuauacaaagccggagugacccccgaaaccuuccccaccgucagccaauuccuauucgaacuugggaagcaaccacgaggcaccaaaaagaugaagaaagcacuccuaagcaccccaaugaaauggggcaagaagcuauacgaacucuucgccgacgacucauuccaacaaaaccgcaucuacaugcaccccgcaguccucaccgccggccggaucagcgaaaugggggucugcuucggcaccauccccgucgcaaaccccgacgacgcagcccaaggcucaggccacacaaaaucaauacucaaccuacgcaccaacaccgagaccagcaauccaugcgcccgaaccaucgucaaacuuuucgaaauccaaaagacgggcuucaacauccaagacauggacauaguagccuccgaacaccuccugcaccaaucccuaguaggcaaacaaagccccuuccaaaacgcauacaacgucaaaggaaacgcaacaagcgcaaacaucaucuaa

SEQ ID NO: 8071 - RNA, 1449 nt, Artificial Sequence
  derived and/or modified CDS sequence (opt11) from CCHFV(SPU 431/85)__KJ682815.1__N
auggagaacaaaaucgaagucaacaacaaagacgaaaugaacaaaugguucgaagaguucaagaaaggaaacggccuaguagacaccuucacaaacucguacuccuucugcgaaucgguaccgaaccucgacaaauucguguuccaaauggcaagcgcaaccgaugacgcacaaaaagacuccaucuacgccucagcccucgucgaagccacaaaauuuugcgcccccguauacgaaugcgcauggguaagcucuaccggaaucgugaaacgaggccuggaaugguucgagaaaaacgcgggaacuaucaaauccugggacgaauccuacacggaacuaaaagucgacguacccaaaaucgaacaacucgccaacuaccagcaagccgcccuaaaauggcguaaagacaucggcuucagaguaaacgcaaacacagccgcccucagcaacaaaguccucgccgaauauaaagucccaggcgaaaucgucaugucgguaaaagaaaugcucucagacaugauaagacguaggaaccaaauccuaaacagaggcggggacgaaaacccacgcggacccgucagcagagaacacgucgacuggugccgcgaguucguaaaaggaaaauacaucauggccuucaacccacccuggggcgacaucaacaaauccggcagauccggaauagcccuaguggcaacaggccucgccaaacuagccgaaacagaaggaaagggaguguucgacgaagccaagaaaacagucgaagcccuaaacggcuaccuagacaaacacaaggacgaagucgaccgcgcgagcgcagacucgaugauaacaaaccuacucaaacauauagcaaaagcacaagagcucuacaagaacagcucagcccugagagcgcaaggggcccagaucgacaccgcauucucaagcuacuacuggcucuauaaagcaggagucacaccagaaacguucccaaccguaagccaauuccuauucgaacucggaaaacagcccagaggaaccaagaaaaugaagaaagcccuccuaaguacgcccaugaaauggggcaagaaacucuacgaacucuucgccgacgacacauuccaacaaaaccgcauauacaugcacccggccguacucaccgccggacgcauaucagagaugggaguaugcuucggaaccauccccgucgccaacccugacgacgcagcccaaggcucgggccacaccaaauccauacucaaccuaagaaccaacaccgaaaccaacaaccccugcgcacgaaccaucguaaaacuguucgaaauccagaaaaccggcuucaacauccaagacauggauaucguagcaucagaacaccuacugcaccaaagccuggucggaaaacaaagcccauuccagaacgccuacaacgucaaaggcaacgcaacaagcgucaacauaaucuaa

SEQ ID NO: 8072 - RNA, 1449 nt, Artificial Sequence
  derived and/or modified CDS sequence (opt11) from CCHFV(SPU 45/88)__KJ682819.1__N
auggaaaacaaaauagaaguaaacaacaaagaugaaaugaacaaaugguucgaagaauucaagaaaggcaacggacuagucgacaccuucacaaacucguacucauucugcgaaucuguccccaaccuggacaaauucgucuuccaaauggccagcgcgaccgacgacgcccagaaagacagcaucuacgccucagcccucgucgaggccacaaaauucugcgcacccaucuacgagugcgccugggucagcucgacagguaucgucaaaagaggccucgaaugguucgaaaaaaacgcaggcacaauaaaaucaugggacgaauccuacacagaacugaaagucgacguacccaaaaucgaacaacuggccaacuaccaacaagcagccuugaaauggcgcaaagacaucggcuuccgagucaacgcaaacacggccgcccucuccaacaaaguccuagccgaauacaaaguacccggugaaaucgugaugucagucaaagaaaugcucuccgacaugauacgacgccggaaccagauacuaaacaggggcggagacgaaaacccccgaggacccguaagccgagaacacgucgacuggugccgagaauuugucaaaggcaaauacaucauggccuucaacccacccuggggugacaucaacaaauccggaagguccggcaucgcccucgucgccacgggccuggccaaacuagcagaaacagaaggcaaaggcgucuucgacgaagccaaaaaaaccguagaagcucucaacggauacuuagacaagcacaaagacgaagucgaccgcgcauccgccgacuccaugaucaccaaccuccucaaacacaucgcaaaagcccaagaacuauacaaaaacuccucugcccuccgcgcucaaggcgcccaaauagacaccgcauucagcuccuacuacuggcuauacaaagccggcgucacccccgaaaccuucccaaccgucagccaguuccucuucgaacuaggcaagcaaccaaggggcacaaaaaaaaugaagaaagcacuccuauccacacccaugaaauggggcaaaaaacuauacgaacucuucgcagacgacucuuuccaacaaaaccgaaucuacaugcaccccgccguacucacagccggcagaaucuccgaaaugggagucugcuucggaaccauaccaguagccaaccccgacgacgcggcccaaggauccggccacaccaaauccauacucaaccuacgcaccaacaccgaaaccaacaacccgugcgcaagaaccaucgucaaacuauucgaaauccaaaaaaccggauucaacauccaagacauggacaucguggccuccgagcaccuccuccaccaaagucuagucggaaaacaaagcccauuccagaacgccuacaacgucaaaggcaacgccacgagcgccaacauaaucuaa

SEQ ID NO: 8073 - RNA, 1449 nt, Artificial Sequence
  derived and/or modified CDS sequence (opt11) from CCHFV(SPU 48/90)__KJ682822.1__N
auggaaaacaaaaucgaagucaacaacaaagacgaaaugaacaaaugguucgaagaguucaagaaaggaaacggacucgucgacaccuucacaaacucguacucauucugcgaauccgucccaaaccuagacaaauucguauuccaaauggcauccgcuaccgacgacgcacaaaaagacucgaucuacgccucggcccuagucgaagcaacgaaauucugcgcgcccaucuacgaaugcgcuuggguaagcuccaccggcaucguaaaaaggggccucgaaugguucgagaaaaacgccggaaccaucaaauccugggacgaauccuacacagaacucaaaguagacgugccaaaaaucgaacaacucgccaacuaccaacaagcagcccuaaaauggcgaaaggacaucggcuuccgcgugaacgccaacaccgcagcacucagcaacaagguccucgccgaauacaaagucccuggcgaaaucgucaugucagucaaagaaaugcucagcgacaugauacgccgcaggaaucaaauccugaaucgcggcggggacgaaaacccccgaggccccguaagcagagaacacguagacuggugccgagaguucguaaaagggaaguacaucauggcauucaacccacccuggggagacauaaacaaauccggccggagcggaaucgcacucgucgccaccggacuagcaaaacucgccgaaaccgaagggaaaggcgucuucgacgaagcaaagaaaacagucgaagcucuaaacggcuacuuagacaaacacaaagacgaaguagaccgcgcaagcgccgacuccaugauaacaaaucucuucaaacacaucgcgaaagcacaagaacucuacaaaaacagcucagcccuccgugcccaaggcgcccaaaucgacacagccuucucgagcuacuacuggcuguacaaagccggcgucaccccagagacguucccaaccgucagucaauuccuauucgaacucggaaagcagccgaggggaacaaagaaaaugaagaaagcacuacuaagcaccccaaugaaauggggcaagaaacuauacgaacucuucgccgacgacucauuucaacaaaaccgcauauacaugcaccccgcgguccucaccgcgggaagaaucagcgaaaugggcgucugcuucggcaccauccccgucgcaaaccccgacgacgcagcccaaggcucaggacacacaaaaagcauccucaaccuacgaaccaacaccgagacgaauaacccaugcgcccgcacaaucguaaaacuauucgagauccagaaaaccggcuucagcauccaagacauggacauagucgccagcgaacaccuacugcaccaaucccuagucggcaaacaaucaccuuuccaaaacgcauacaacgucaaaggcaacgccacaagcgcgaacauaauauaa

SEQ ID NO: 8074 - RNA, 1449 nt, Artificial Sequence
  derived and/or modified CDS sequence (opt11) from CCHFV(SPU 497/88)__KJ682820.1__N
auggaaaacaaaauagaagucaacaacaaagacgaaaugaacaaaugguucgaagaguucaagaaaggaaacgggcucgucgacacauucaccaacucauacuccuucugcgaaucggucccaaaccucgacaaauucguauuccaaauggccuccgccacagacgacgcacaaaaagacuccaucuacgccucagcccucguagaagccaccaaauucugcgcccccaucuacgaaugcgccuggguauccagcaccggaaucguaaaaagaggccuagaaugguucgagaaaaacgccgggaccaucaaauccugggacgaaagcuacaccgaacucaaaguagacguucccaaaauagaacaacuagccaacuaccaacaagccgcccuaaaauggcgaaaagacaucggauuccgcgucaacgccaacaccgcagcgcucagcaacaaaguccuagccgaauacaaaguaccaggcgaaaucguaaugagcgucaaagaaaugcuaagcgacaugauccgcagacgcaaccaaauucucaaccgcggaggagacgaaaacccccgagggcccgucagccgcgaacacguagacuggugucgagaguucgucaaaggcaaauacauaauggcauucaacccgccauggggcgacaucaacaaaaguggccgaucgggcaucgcgcucgucgcaacaggccuagccaaacuagccgaaaccgaaggaaaaggagucuucgacgaagcaaagaaaacggucgaagcccucaacggauaccucgacaaacauaaagacgaagucgaccgggccucagcagacagcaugaucaccaaccuccucaaacacauagcaaaagcccaggaacucuacaaaaacuccuccgcccuccgcgcccaaggcgcccaaaucgacacagccuucuccuccuacuacuggcucuacaaagccggcgucacuccagaaacauuccccaccguaagccaauuccucuucgaacucggcaaacaaccccgaggcacaaagaaaaugaagaaagcccugcucagcacacccaugaaauggggcaagaaacucuacgaacucuucgccgacgacuccuuccaacagaaccgcaucuacaugcaccccgcagugcucacagccggacgaaucagcgaaaugggcgucugcuucggagccauccccguagccaaucccgacgacgccgcccagggcuccggccacaccaaaagcauacucaaccuacgcacaaacaccgaaaccaacaaccccugcgcacguaccaucgucaaacuauucgaaauccagaaaacaggauucaacauccaagacauggacaucguagcaucggagcacuuacugcaccaaagccucgucggaaaacaaagcccguuccaaaacgccuacaacgugaaaggcaacgcaaccagugccaacaucaucuga

SEQ ID NO: 8075 - RNA, 1449 nt, Artificial Sequence
  derived and/or modified CDS sequence (opt11) from CCHFV(SPU 556/87)__KJ682817.1__N
auggaaaacaaaaucgaaguaaacaacaaagacgaaaugaaccgaugguucgaagaauucaaaaaagguaacggccucguagacacauucacaaacucauacuccuucugcgaauccguccccaaccucgaccgauucgucuuccagauggccggcgccaccgacgacgcccaaaaagacucaauuuacgccucggcccucgucgaggcaacaaaauucugcgcgccaaucuacgaaugcgccuggguaagcuccaccggaaucgucaaaaaaggccuagagugguucgaaaaaaacgccggcaccaucaaaucgugggacgaaagcuacaccgaacucaaagucgacguacccaaaaucgaacaacucgcaaacuaccaacaggcagcccuuaaauggcgaaaggacaucggauuccgcguaaacgccaacaccgcagcccucuccaacaaaguauuggccgaguacaaaguccccggagagaucgucauguccguaaaagagaugcucuccgacaugauacgacgccgcaaccaaaucuuaaacagaggcggcgacgaaaacccaagaggcccgguaagccgcgaacacgucgacuggugccgcgaauucguaaaaggcaaauacaucauggcguucaacccaccauggggcgacaucaacaaaagcggccgguccggcauagcccucguggccaccggccuagccaagcucgcagaaaccgaaggcaaaggcgucuucgacgaagcgaaaaaaacagucgaagcccucaauggcuaccuagacaaacacaaagacgaaguagaccgcgccagcgccgacuccaugauaaccaaccuccuuaaacacaucgcaaaagcacaagaacucuacaaaaacagcucagcacuacgcgcgcaaggagcccaaaucgacaccgcauucuccagcuacuacuggcuauacaaagccggcgucacacccgaaaccuucccaaccgucagccaauuccucuucgaacucggaaaacagccaaggggcacaaaaaaaaugaaaaaagcccuacucaguaccccaaugaaauggggcaaaaaacuauacgaacucuucgcagacgacagcuuccaacaaaaccgcaucuauaugcauccugccguacuaacagccggccgaauauccgagaugggaguaugcuucggcaccauccccguagccaacccagaugacgcagcccaaggcuccggccacaccaagucaauucuaaaccuccgcacaaacacggagaccaacaacccaugcgccaaaaccauagucaaacuuuucgaaauacaaaaaaccggcuuuaacauacaagacauggacaucgucgccucagaacaccuccuacaccaaagccuaguaggcaaacagagcccauuccaaaacgcauacaacgucaaaggaaacgccacauccgccaacauaauauaa

SEQ ID NO: 8076 - RNA, 1449 nt, Artificial Sequence
  derived and/or modified CDS sequence (opt11) from CCHFV(SPU 92/01)__KC880335.1__N
auggaaaacaaaauagaaguaaacaacaaagacgagaugaacaaaugguucgaagaguucaagaaaggaaacggccucgucgacacauucaccaacagcuacucauucugcgaaagcguaccgaaccuugacaaauucgucuuccaaauggcgagcgcgaccgacgacgcacaaaaagacucgauauacgcaucagcccucgucgaagccaccaaauucugcgccccaauauacgagugcgcauggguaagcagcaccggaaucguaaaaaggggacucgagugguucgagaaaaacgcaggaacaaucaaauccugggacgaaucguacacugaacucaaaguagacgugccaaaaaucgaacaacucgccaacuaccaacaagcagcccuaaaauggagaaaagacaucggcuuccgcguaaacgcaaacacagccgcacucucaaacaaaguccuagccgaauacaaagucccaggcgaaaucgucaugucaguaaaggaaaugcuuucagacaugauacgccggagaaaccagauccucaacagaggcggcgacgaaaacccgcgcggcccaguaagcagggaacacgucgacuggugccgcgaguucguaaaaggcaaauacaucauggccuucaacccgcccuggggagacaucaacaaaagcggcagaagcggcaucgcccuaguagcaacaggacuugcaaaacucgcagaaacagaagggaaaggagucuucgacgaagcuaagaaaacgguagaagcacucaacggauaccuagacaaacacaaagacgaagucgaccgcgcguccgcagacucgaugauaaccaaccuacucaaacacauagcaaaagcccaagaacuauacaaaaacagcuccgcccuccgcgcgcaaggagcacagaucgacacagcguucuccagcuacuacuggcucuacaaagccggcguaacccccgaaacauucccaacaguaagccaguuccucuucgaacucggaaaacaaccacggggcaccaaaaagaugaagaaagcacuacuaagcacacccaugaaguggggaaagaaacuguacgaacucuucgccgacgacuccuuccaacaaaaccgcauauacaugcacccggccguccucacggccgggcgcauaucagaaaugggaguaugcuucggaaccauacccguggccaaccccgacgacgcagcccaaggcucgggccauaccaaaaguauacucaaccuccaaaccaacaccgaaaccaacaacccaugcgcacgcacaauagucaaacucuucgaaauacagaaaacaggauucaacauacaagacauggacaucguagccucagaacaccuacuacaccagagccuagucggaaaacaaagccccuuccagaacgccuacaacguaaaaggaaacgcgaccagcguuaacaucaucuag

SEQ ID NO: 8077 - RNA, 1449 nt, Artificial Sequence
  derived and/or modified CDS sequence (opt11) from CCHFV(SRR)__KU707901.1__N
auggaaaacaaaauagaagucaacaacaaagacgaaaugaauaaaugguucgaggaguucaaaaagggaaacggccuagucgacacauucaccaauagcuacagcuucugcgaauccguccccaaccucgaccgcuucguauuccaaauggcuggcgcaaccgacgacgcacaaaaggacuccauauacgccuccgcccuagucgaggccacaaaauucugcgccccaauauacgaaugcgcgugggucucauccaccggcauagucaagaaaggccuugagugguucgaaaagaacgccggaacaaucaaaagcugggaugaauccuacaccgaacucaaaguggaaguacccaaaaucgaacaacuggcgaacuaccaacaagccgcacucaaauggcgcaaagacauaggcuuccgagucaacgcaaacaccgccgcacucucacacaaaguccucgccgaauacaaagucccaggagaaauaguaaugucgguaaaagaaaugcuaagcgacaugauccgacgcagaaaccuaauacucaaccguggaggagacgaaaaccccagaggccccguaagccgcgaacacguggaauggugcagagaguucgucaaaggcaaauacaucauggcauucaacccacccuggggagacaucaacaaaagcggaagaagcggcaucgcacucguggccaccggccuggcaaaacuggccgaaacggaaggcaaaggagucuucgaugaagcaaagaaaaccgucgaggcacuaaacggcuaccuagacaaacacaaagacgaagucgacaaagccagcgccgacaacaugauaaccaaccuacuaaaacacauagccaaagcccaagaacuauacaaaaacagcagcgcacuacgcgcacagggcgcgcaaaucgacaccgccuucagcagcuacuacuggcucuacaaggccggcgucacccccgaaacauucccaacagucucucaauuccucuucgaacucgguaaacaaccccgaggcacaaagaaaaugaagaaagcacuacuaucuacaccaaugcgauggggcaagaaacucuacgaacucuucgcggacgacuccuuccaacaaaaucgcaucuauaugcacccggcgguacucaccgccggccgcaucagcgaaaugggagucugcuucgggacaauccccgucgccaaccccgaugacgcagcucaaggcagcggccacaccaaauccauccuaaaccuacgaaccaacaccgaaaccaacaacccaugcgcaaaaaccaucguaaaacucuucgaaauccagaaaaccggcuucaacauacaagacauggacaucguagcaucggaacaccuccugcaccaaucccucgucggaaaacaaagcccauuccaaaacgcauacaacgucaaaggcaacgccaccagcgccaacauaaucuaa

SEQ ID NO: 8078 - RNA, 1449 nt, Artificial Sequence
  derived and/or modified CDS sequence (opt11) from CCHFV(STV/HU29223)__AF481802.1__N
auggaaaacaaaauagaaguaaacucaaaagacgaaaugaacaaaugguucgaagaguucaagaaagggaacgggcucauggauaccuucacaaacucauacuccuucugcgaaaacguacccaaccucgacaaauucgucuuccaaauggccagcgccaccgacgacgcacaaaaagacucaaucuacgcaucagcccuagucgaagccacgaaauucugcgcacccauauacgaaugcgccugggugagcuccaccggcauaguaaagaaaggccucgaaugguucgagaaaaacagcggcacaaucaaaucaugggacgaaaacuacgcagaacucaaagucgacgugcccaaaaucgaacaauuagccaacuaccaacaagcagcccucaaauggcgcaaagacaucggauuccgcgugaacgccaacacugcagcccucuccaacaaaguccuagccgaguacaaagucccaggagaaaucgugaugagcguaaaagaaaugcucuccgauaugauccgacgacgcaaccuaauccucaacagaggcggcgacgaaaaccuacgcggacccgucagccgagaacaugucgaguggugcagagaguucgugaaaggaaaguacaucauggcauucaaucccccauggggagacaucaacaagucgggccgcagcggaaucgcacuggucgcaaccggccucgcaaagcucgccgaaaccgaagggaaaggcgucuucgacgaagccaagaaaacaguagaagcccuaaacggauaccuagacaaacaccgagacgaaguagacaaagccuccgccgacucaaugaucaccaaucuccuuaaacacaucgcgaaagcccaagaacucuauaagaacagcagcgcccuccgcgcccaaggagcacaaaucgacacaccauucuccucauucuacuggcucuacaaagccggaguaaccccggaaacauuccccaccauaagccaauuccuauucgaacucggcaaacaacccagaggcaccaagaaaaugaagaaagcccuacucagcacacccaugaaauggggcaagaaacucuacgaacuauucgccgacgacuccuuccaacaaaaccgcaucuacaugcacccugccguccuaacggcaggacgcaucagcgaaaugggcguaugcuucggcaccauacccgucgccaacccagacgacgccgcccaaggcucgggccacacaaaaagcauccucaaccuccgcaccucgacagaaacuaacaacccgugcgccaaaaccaucgucaaacuauucgaaauccagaaaaccggcuucaacauccaagacauggacaucgucgccucagaacaccuccuccaccaaagccucgucggaaaacaaagccccuuccaaaacgcguacaacgucaaaggcaacgccaccagugccaauaucaucuag

SEQ ID NO: 8079 - RNA, 1449 nt, Artificial Sequence
  derived and/or modified CDS sequence (opt11) from CCHFV(TAJ/HU8966)__AY049083.2__N
auggaaaacaaaauagaagucaauaacaaagacgagaugaacaaaugguuugaagaguucaagaaaggaaacggccuagucgacacauucacaaacucauauuccuucugcgaauccguccccaaccuagaccgauucguuuuccaaauggccagcgcaaccgacgacgcacaaaaagacagcauauacgccucggcccucguagaagccacaaaauucugcgcccccaucuacgaaugcgccuggguaagcucaaccgggaucgucaagaaaggccucgaaugguucgagaaaaacgccggcaccaucaaaucaugggacgaauccuacaccgaacuaaaaguagaagucccaaaaauugaacaacuggccaacuaccaacaagcagcccucaaauggcgaaaagacauaggguuccguguaaacgcaaacaccgcagcacuaucccacaaaguccuagccgaauacaaagucccgggcgaaauaguaauguccgucaaagaaaugcuaagcgacaugauccggagacgaaaccugauccucaaccggggcggagacgaaaacccccgcggacccgucuccagagagcacgucgaauggugccgagaguucgucaaaggaaaauacauaauggcauucaacccucccuggggcgacaucaauaaauccgggcgcuccggcauagcccucguagccacgggccucgcaaagcuagccgaaaccgaaggcaaaggcgucuucgacgaagccaagaaaaccgucgaagcccuaaacggauaccucgacaaacacaaagacgaagucgacaaagccuccgcagacaacaugauaaccaaccuccugaaacacaucgccaaagcacaagaacucuacaaaaacagcuccgcccuacgcgcccaaggagcccaaaucgacaccgcauucuccucauacuacuggcucuacaaagcaggcgucaccccagaaacguuccccaccguaucccaauuccuauucgaacuaggcaaacagccccgaggcaccaagaaaaugaagaaagcgcucuuauccacgcccaugaaauggggcaagaaacucuacgaacucuucgccgacgacuccuuccaacaaaaccgcaucuacaugcacccagcaguacucacagccggccgcauaagcgaaaugggcgucugcuucggcacaaucccagucgccgacccugacgacgccgcacaaggcuccggccacacaaaaagcauacuaaaccucagaacaaacaccgaaaccaacaacccgugcgccaaaacgauaguaaaacuauucgaaauacagaaaacaggcuucaacauccaagacauggacaucguagccagcgaacaccuccugcaccaaucacucgucggaaaacagagccccuuccaaaacgccuacaacguaaaaggaaacgccacgucagcaaacaucaucuaa

SEQ ID NO: 8080 - RNA, 1449 nt, Artificial Sequence
  derived and/or modified CDS sequence (opt11) from CCHFV(TAJ/HU8975)__AY297692.2__N
auggaaaacaaaauugaaguaaacaacaaagaugaaaugaacaaaugguucgaagaguucaagaaaggcaacggacucguggauacauucaccaacucauacagcuucugcgaaucaguccccaaccucgacagguucguauuccaaauggccuccgccacagacgacgcccaaaaagacuccaucuacgcaucagcccucgucgaagccaccaaauucugcgcccccauauacgaaugcgcaugggucagcucaaccggcaucguaaagaaaggccuagagugguucgagaaaaacgccggaaccauaaaauccugggacgagucauacauagaacuaaaagucgaaguccccaaaaucgaacaacuagccaacuaccagcaagcggcccucaaauggagaaaagacaucggauuucgagugaacgccaacaccgccgcucuaucccacaaaguccuagcagaauauaaaguccccggagaaauagucaugagcgucaaagaaaugcucuccgacaugauccgacgccggaaccuaauacugaaccgaggcggagaugaaaacccacgcggacccguguccagagaacacgucgaauggugccgagaguucgucaaaggaaaauacauaauggcauucaacccacccuggggcgacaucaauaaauccggccgaagcggcaucgcccuaguagcaacaggacuggccaaacucgccgaaacagaaggcaaaggcgucuucgacgaggccaagaaaacagucgaagcccuaaacggguaucuagacaaacacaaagacgagguagacaaagccucagccgacaacaugaucaccaaccuccucaaacacaucgccaaagcccaagaacuauacaaaaacucaagcgcccuaagagcacaaggagcccaaaucgacaccgccuucagcuccuacuacuggcuauacaaagccggagucacccccgaaaccuuucccaccguuagccaauuccucuucgaacugggaaaacaaccccgcgguacaaagaaaaugaagaaagcccuacucuccacccccaugaaauggggaaagaaacuauacgaacucuucgcagacgacuccuuccaacaaaaccgcaucuacaugcaccccgccguccucaccgcgggccgaaucagcgaaaugggcgucugcuucggcaccaucccaguggccaaccccgacgacgccgcacaaggaucgggccacaccaaauccauccucaaccucagaaccaacaccgagaccaacaacccaugcgccaaaacaaucguaaaacucuucgaaauccagaaaacaggcuucaacauccaagacauggacaucguggcauccgaacaccuccugcaccaaucccuggucggcaaacaaucccccuuccaaaacgccuacaacgucaaaggcaacgccaccagcgccaacaucaucuaa

SEQ ID NO: 8081 - RNA, 1449 nt, Artificial Sequence
  derived and/or modified CDS sequence (opt11) from CCHFV(TAJ/HU8978)__AY297691.2__N
auggagaacaaaaucgaagucaacaauaaagacgaaaugaacaaaugguucgaagaguucaagaaaggcaacggccucguagacaccuucaccaacuccuacuccuucugcgaauccguccccaaccucgaccgcuucguauuccaaauggccggcgcaaccgacgacgcccaaaaagacagcaucuacgccuccgcacucguagaggcaacaaaauucugcgccccaaucuacgaaugcgccuggguaucauccacaggcauagucaagaaaggccucgaaugguucgagaaaaacgcaggcacaaucaaaucaugggacgaauccuacaccgaacuaaaagucgagguccccaaaaucgagcaacucgccaacuaccaacaagccgcccuaaaauggcgcaaagacauaggauucagagucaacgccaacacagccgcgcucucccacaaaguacucgcagaauacaaaguccccggagaaaucgucaugagcgucaaagaaaugcucuccgacaugauacgucggcgaaaccuauuccucaacagaggaggcgaugagaacccccgaggccccgucagcagggaacacguagaauggugccgcgaguucguaaaaggaaaauacaucauggccuucaacccgccauggggagacaucaacaaaagcggacgcuccggaauagcccucguagccacaggacucgcaaaacucgccgaaaccgaaggcaaaggagucuucgacgaagccaaaagaaccguggaagcacucaacggguaucuagacaaacacaaagacgaaguagacaaagccagcgccgacaacaugauaaccaaccuacucaaacacauagcaaaggcgcaagagcucuacaaaaacuccagcgcccuccgagcccaaggcgcacaaauagacaccucauucucauccuacuacuggcuauacaaagccggccgaaccccagaaaccuuccccacaguaagccaauuccucuucgaacucggaaaacaaccccgaggcacaaagaaaaugaagaaagcccuacucagcaccccaaugaaauggggcaagaaacucuacgaacuauucgcagaugacucauuccaacaaaaccgcaucuacaugcacccagccguccucaccgccggccgcaucuccgaaaugggagucugcuucggcaccauccccgucgccaacccagacgacgccgcccaagggagcggccacaccaaaagcauccucaaccuccgaaccaacacagagaccaacaaccccugcgcaaaaacgaucgucaaacucuucgagauacagaaaaccggauucaacauacaagacauggacaucgucgcguccgaacaccuccuccaccaaagccucgucggcaaacaaagccccuuccaaaacgccuacaacgucaaaggcaacgccaccuccgccaacaucaucuaa

SEQ ID NO: 8082 - RNA, 1449 nt, Artificial Sequence
  derived and/or modified CDS sequence (opt11) from CCHFV(Uzbek/TI10145)__AF481799.1__N
auggaaaacaaaauugaagucaacaacaaagaugaaaugaacaaaugguucgaagaauucaaaaaaggcaacggacuugucgacacauucacaaacucauacagcuucugcgaaucaguacccaaccucgaccgcuucguauuccagauggcauccgcaacagacgacgcacaaaaagauagcaucuacgcgagcgcccucgucgaagccacaaaauucugcgcacccauauacgaaugcgcaugggucagcagcaccggaauagucaaaaaaggccucgaaugguucgaaaagaacgccggcacaauaaaauccugggacgaaagcuacacggagcuaaaaguagaaguaccaaaaaucgaacaacuggccgacuaccaacaagccgcccuaaaauggagaaaagacauaggcuucagaguaaacgcgaacaccgcagcacucagccacaaaguccuagcggaguacaagguaccaggcgaaauaguaaugagcguaaaggaaaugcuauccgacaugaucagacgacgcaaccucauccucaaccgcggaggcgacgaaaacccccgaggccccgucagccgcgagcacguagaauggugcagggaauucgucaaaggcaaauacaucauggcauucaacccacccuggggcgacaucaacaaauccggccgauccgggaucgcacucgucgccaccggccuggccaaacucgccgaaaccgagggcaaaggggucuucgacgaggcuaaaaaaaccgucgaagcacucaacggcuaccuagacaaacacaaagacgaagucgacaaagcaagcgccgauaacaugaucaccaaccuacuaaaacacaucgcuaaagcccaagagcucuacaaaaacuccucagcucuacgagcacaaggcgcccaaaucgacacggccuucucaucauacuacuggcuauacaaagcaggcgucacacccgaaacguucccaacagucagccaauuccucuucgaacucggcaaacaaccccgcggcaccaaaaaaaugaaaaaagcccuccucagcacacccaugaaauggggcaaaaagcuuuacgaacuauucgcagacgacucauuccaacaaaaccgaaucuacaugcaccccgccguccucacagccggccgaauaucagaaaugggcgucugcuucggaaccauccccgucgccaaccccgacgacgccgcccagggcucaggccacaccaaauccauacucaaccuccgaaccaacaccgaaaccaacaacccaugugccaaaacaaucgucaaacuguucgaaauccaaaaaaccggcuucaacauccaagacauggacaucguggcaagcgaacaccuccuccaccaaagccuagucgggaaacaaucaccauuccaaaacgccuacaacgucaagggaaacgccaccuccgcaaacaucaucuaa

SEQ ID NO: 8083 - RNA, 1449 nt, Artificial Sequence
  derived and/or modified CDS sequence (opt11) from CCHFV(ROS/TI28044)__AY277672.1__N
auggaaaauaaaaucgaaguaaacuccaaagacgaaaugaacaagugguucgaggaauucaaaaaaggcaauggacuaauggacacauucacaaacucauacagcuucugcgaaaacgucccaaaccuagacaaguucguauuccaaauggccagcgccacagacgacgcacaaaaagacagcaucuacgcaucagcccuaguggaagccaccaaguucugcgcccccaucuacgaaugcgcaugggucagcagcaccggaauaguaaaaaaaggucuagaaugguucgaaaaaaacagcggcacuauaaaaagcugggacgaaaacuacgccgaacucaaagucgacguacccaaaauagaacaacucgccaacuaccaacaagccgcccucaaauggagaaaagacauaggauuccgagucaacgccaacaccgcagcccuauccaacaaaguccuagcggaauacaaagucccuggcgaaaucgucauguccgucaaagaaaugcucagcgacaugauacgccgaagaaaucugauccucaaucgaggaggcgacgaaaauccccgcggacccgucagucgagaacacgucgaguggugccgcgaauucguaaaaggaaaauacauaauggcauucaacccacccuggggcgacaucaacaaacccggccgaucaggaaucgcccuagucgccaccggccucgccaaacucgccgaaacagaaggcaaaggagucuucgacgaagcgaaaaaaaccguagaagcccucaacggcuaccucgacaaacaccgagacgaaguagacaaagcguccgcagacuccaugauagcaaaccuccuaaaacacaucgccaaagcccaagaacucuacaagaauagcucagcacugcgagcccaaggagcacaaauagacaccccauucucauccuucuacuggcucuacaaagccggcguaacccccgagacauucccaacgauaagccaauuccuguucgaacuuggaaaacaaccccgaggcaccaaaaaaaugaaaaaagcguuacucucaacacccaugaaauggggcaaaaaacucuacgaacuguucgccgacgacuccuuccaacaaaaccgcaucuacaugcaccccgcgguccucaccgccggccgaaucagcgaaaugggcgucugcuucggcaccauccccgucgcgaaccccgacgacgcagcccaaggaagcggccacaccaaaagcauccuaaaccuccgcaccagcaccgaaaccaacaaccccugcgccaaaaccauaguaaaacucuucgaaauccaaaaaacggguuucaacauccaagacauggacaucgucgccagcgaacaccugcuccaccaaagccucgucggaaaacaaucccccuuccaaaacgcauacaacgucaaaggcaacgccacgagcgccaacaucaucuaa

SEQ ID NO: 8084 - RNA, 1449 nt, Artificial Sequence
  derived and/or modified CDS sequence (opt11) from CCHFV(7001)__AF415236.1__N
auggaaaacaaaaucgaagugaacaacaaagacgaaaugaacaaaugguucgaagaguucaagaaaggaaacggccucgucgacaccuucacaaacuccuacuccuucugcgaauccguccccaaccuagaccgcuucgucuuccagauggccuccgcaacagacgacgcacaaaaagacucgaucuacgccucagcccuagucgaagcaaccaaauucugcgcccccaucuacgaaugcgccuggguaucaucaaccggaauaguaaaacgcggccuagaaugguucgagaaaaacgccgguacaaucaaaucaugggacgaauccuacacggaacugaaagucgaaguccccaaaaucgaacaacuggccgacuaccaacaagcagcccucaaauggcgcaaagacaucggauuccgcgucaacgccaacacaacggcccucagccacaaaguccucgccgaauacaaagucccaggcgaaauaguaaugagcgucaaagaaauguuauccgacaugauccgccgccguaaccucauccucaaccgaggcggcgacgaaagcccccgcggccccgucucccgcgaacacgucgaauggugccgagaguucgucaaaggaaaauacauaauggcauuuaacccacccuggggcgacaucaacaaaucaggccgaagcggcaucgcccuagucgcaaccggccuagcuaaacucgccgaaacagaaggaaaaggggucuucgacgaagccaagaaaacagucgaagcccucaacggauaccucaacaaacacaaagacgaagucgacaaagccucagccgacuccaugaucaccaaccuccucaaacacaucgccaaagcgcaagaacuauacaaaaacucauccgcccuaagagcccaaggcgcacaaaucgacaccgcauucucuagcuacuacuggcucuacaaagccggaguaaccccggaaacauuccccaccgucucccaauuccucuucgaacuuggaaaacagccccgaggaacgaagaaaaugaagaaagcccuccucucaaccccauuaaaauggggcaagaaacucuacgaacucuucgcagacgacagcuuccaacagaaccgaaucuacaugcacccagcagugcuuacagccggccgcaucuccgaaauggguguaugcuucggcaccauccccgucgccaacccagacgacgcagcccaaggcuccggacacaccaaaucaauccuaaaccuacgcaccaacaccgaaaccaacaacccaugccccaaaacaaucgucaaacuauucgaaauccagaaaaccggcuucaacauccaagacauggacaucguagccagcgaacaccuccuacaccagagccucguuggaaaacaaagcccauuccaaaacgccuacaacgucaaaggcaacgcaaccagcgccaacaucauauag

SEQ ID NO: 8085 - RNA, 1449 nt, Artificial Sequence
  derived and/or modified CDS sequence (opt11) from CCHFV(79121M18)__GU477494.1__N
auggaaaacaaaauagaggucaauaacaaagacgagaugaacaaaugguucgaggaguucaaaaagggcaacggccucguagacaccuucacaaacuccuacuccuucugcgaauccguaccaaaccucgaccgcuucguguuccaaauggccuccgcaaccgacgacgcacaaaaagacuccaucuacgcaagcgcccucguagaagcgaccaaauucugcgccccgauauacgaaugcgccugggucagcagcaccggcauagugaaacgaggacuugaaugguucgagaaaaacgcaggcaccaucaagagcugggacgaaucauacaccgaacuuaaaguagaaguaccgaaaauagaacaacucgccgacuaccaacaggcagcccuaaaauggagaaaagacauaggguucagaguaaacgccaacacaaccgcccucagccacaaaguccucgccgaauacaaaguaccaggagaaaucgucaugagcguaaaagaaaugcucucagacaugauacgacgacgaaaccucauccugaaccgcggcggcgacgaaucaccccgcggccccgucagcagagaacacgucgaauggugccgcgaguucguaaaaggcaaauacaucauggccuucaacccacccuggggagacaucaacaaaagcgggcgaagcggaaucgcccucgucgccaccggacuagccaaacuggccgaaacugaaggaaaaggaguauucgacgaagccaagaaaacaguggaagcccugaacggguaccugaacaagcacaaagacgaagucgacaaagccuccgcagacuccaugaucacaaaccuccucaaacacauagcaaaagcccaagaacucuacaaaaacagcucagcacuccgagcccagggcgcacaaaucgacaccgccuucucaagcuacuacuggcuauacaaagcaggagucacccccgaaacauucccaacaguuagccaauuccucuucgaacuaggcaaacaaccccgcggaacaaagaaaaugaagaaagcacuccuaagcaccccacuuaaauggggaaagaaacuauacgaacucuucgccgacgacagcuuccaacaaaacagaaucuauaugcaccccgcagugcucacagccggccguauaucagaaaugggagucugcuucggcaccauaccagucgcaaaccccgacgacgccgcacaaggcagcggccacaccaaauccauccucaaccuucgcaccaacacagaaacuaacaaccccugcgcuaaaacaauagucaaacucuucgaaauccagaaaaccggauucaacauccaagacauggacauagucgcaagcgaacaccuccuucaccaaagccuaguaggcaaacaaagucccuuccaaaacgcauacaacgucaaaggaaacgccaccuccgccaacaucaucuaa

SEQ ID NO: 8086 - RNA, 1449 nt, Artificial Sequence
  derived and/or modified CDS sequence (opt11) from CCHFV(AP92)__DQ211638.1__N
auggaaaacaaaauagaagucaauagcaaagacgaccuuaacaaaugguucgaagaauucaaaaaagguaacgggcuaguagacacauuuaccaauagcuacagcuucugcgaaaaugucccuaaccuagacagauucgucuaccaaauggccucagccaccgacgacgcgcaaaaagacagcaucuacgccuccgcacuuguagaagccaccaaauacugugccccaauauacgaaugcgccuggguaucauccaccggaaucgucaaaaaaggucucgaaugguucgaaaagaauacauccacaaucaaaagcugggacgagagcuacaccgagcuaaaaguagacauccccaaaaucgaacaacucuccagcuaccaacaagccgcucucaaauggcgcaaagacaucggcuuccgcaucaacgcaaacaccacagcucucuccaacaaaguccuagccgaauacaaaguccccggcgaaauccuaguccccguaaaagaaaugcucucugacaugauccgcagaagaaacauaauacuaaaccgaggcuccgaugaaaacccccggggcccggucucacacgagcacaucgaauggugccgcgaauucaucaaaggcaaauacauaauggcauucaacccccccuggggagacauaaacaaaucaggacgauccggcaucgcccucgucgccacaggccucgccaaacucgcagagaccgaaggaaaaggaguauucgaagaagcaaaaaaaaccgucgaagcccuaaaagacuaccucgacaaacacagagacgaagucgacaaaacaucagcggacaacaugguaaccagccuacucaaacacaucgccaaagcccaagaacucuacaaaaacucauccgcacuacgagcacaaggcgcccaaaucgacaccccuuucagcuccuucuacuggcucuacaaagcaggagucacccccgaaaccuuccccacagucucccaauuccucuucgaacucggaaaacagccccgaggcaccaaaaaaaugaaaaaagcccuccuaucgacccccaugaaauggggaaaaaagcucuacgaacucuucgccgacgacuccuuccaacaaaaccgcaucuacaugcaccccgcgguacucacagccggacgcaucuccgaaaugggcgucugcuucggaaccauacccgucgccaaccccgacgacgccgcgcagggcucaggccacaccaaauccauccucaaccuacgcaccaacaccgagucaaacaaccccugcgcccguacaauagucaaacucuucgaaauccagaaaaccggcuucgacaucaaagacauggacaucgucgccucagaacaccuccuccaccaaagccucgucggcaaacaaagccccuuccaaaacgccuacaacgucaaaggcaacgccaccuccgccaacaucauauaa

SEQ ID NO: 8087 - RNA, 1449 nt, Artificial Sequence
  derived and/or modified CDS sequence (opt11) from CCHFV(ArD15786)__DQ211640.1__N
auggaaaacaaaauagaagucaacaacaaagacgaacuaaacaaaugguucgaagaguucaagaaaggcaacgggcucguggacacauucacaaacagcuacuccuucugcgaaaacgucccaaaccucgacagauucgucuuccaaauggcaggcgccaccgacgacgcccaaaaagacuccaucuacgccagcgcccuaguagaagccaccaaauacugcgcccccaucuacgaaugcgccugggucagcagcaccggcauagugaaacgaggccucgaaugguucgagaaaaacacagggaccauaaaauccugggacgaaagcuacacagaacuaaaaguagacguccccaaaaucgaacaacuagcaaacuaccaacaggccgcccuaaaauggcguaaggacauaggauuccgcguaaacgcaaacacagccgcacucuccaacaaaguccugagcgaauacaaaguacccggagaaaucguaaugucgguaaaagaaauguuaagcgacaugauacgccgacgcaaccugauccucaaccgcgggggcgacgaaaacccacgaggaccaguuucaaaagaacacauagaauggugcagggaguucgugaaaggcaaauacauaauggcguucaacccacccuggggagacguaaacaaauccggcagaagcggaauagcgcuaguagccacaggccucgcaaaacucgccgaaaccgaaggcaaaggggucuucgaagaagccaaaaagaccguagaagcccuaaaagaauaccuugacaaacacaaagacgaggucgacaaagcaucagccgacagcaugguaacaaaccuccuaaaacauauaacaaaagcacaagaacucuacaaaaacagcagcgcacucagagcccaaggagcacaaaucgacacccccuucagcagcuucuacuggcuauauaaagcaggcguaaccccggaaaccuucccaaccgucagucaauuccuauucgaacucggaaaacagccgcgcgggacgaagaaaaugaagaaagcccuccucuccacccccaugaaauggggaaagaaacucuacgaacucuucgcagaugacucauuccaacaaaaccgcaucuacaugcacccggccguacucaccgccggccgcaucagcgaaaugggcgucugcuucggcaccaucccggucgccaaccccgacgacgcagcacaaggaagcggccacacaaaaagcauacucaaccuccgcaccaacuccgaaaccaacaaccccugcgcaaaaaccaucguaaaacuauucgaagugcagaaaaccggcuucaacauccaagacauggacauaguagccucagaacaccuccugcaccagagccuaguaggaaaacagagcccauuccaaaacgccuacaacguaaaaggcaacgcaacgucggccaacauaaucuag

SEQ ID NO: 8088 - RNA, 1449 nt, Artificial Sequence
  derived and/or modified CDS sequence (opt11) from CCHFV(ArD39554)__DQ211641.1__N
auggaaaacaaaaucgaagucaacaacaaagacgaaaugaacaaaugguucgaagaguucaagaaaggcaacggccuaguagacaccuucacgaacuccuacagcuucugcgaauccgucccaaaccucgacaaauucgucuuccaaauggccagcgccaccgacgacgcgcaaaaagacagcaucuaugcuuccgcccucgucgaagccaccaaauucugcgcacccaucuacgaaugcgccuggguaagcagcacaggaaucguaaaaagaggccuagaaugguucgagaaaaacgccggcaccaucaaauccugggacgaauccuacaccgaauuaaaagucgacgucccaaaaaucgaacaacucgccaacuaccaacaagcagcccuaaaauggagaaaagacauaggauuccgaguaaacgccaacaccgccgcacuauccaacaaaguccuggccgaauacaaagucccaggcgaaaucguaaugagcguaaaagaaaugcuuucggacaugauacggcgacgcaaccaaauccucaaccgcggcggcgacgaaaacccacgaggaccagucucgcgggaacacgucgacuggugccgagaguucguaaaaggaaaauacaucauggccuucaacccacccuggggcgacaucaauaagucaggccgaagcgggauagcccuagucgccacuggccuagccaaacucgcagaaaccgaagggaaaggagucuucgacgaagcaaagaaaacagucgaagcccucaacggcuaccucgacaaacacaaagacgaaguagacaaagccuccgccgacuccaugaucaccaaccuacucaaacacauagccaaagcacaagaacucuacaaaaacucaagcgcacuccgcgcccaaggagcccaaauugacacagcauucucaagcuacuacuggcuguauaaagccggagucacccccgagaccuucccgaccgucagccaauuccuauucgaacucggcaaacaaccccgaggcaccaagaagaugaagaaagcacuccuaacaacccccaugaaauggggcaagaaacuuuacgaacucuucgccgacgacuccuuccaacaaaaccgcaucuacaugcaccccgccguccucaccgcuggccgcauaagcgaaaugggcgucugcuucggaacaauccccgucgccaaccccgacgacgcggcccaaggcagcggacacaccaaauccauacucaaccucaggacaaacaccgagaccaauaacccaugcgcacgcacaaucgucaaacucuucgagauccaaaagacaggauucaacauccaagacauggacaucgucgccuccgagcaccuacuccaccaaucccuagucgggaaacaaagcccguuccaaaacgccuacaacgucaaaggcaacgccaccagcgccaacauaauuuag

SEQ ID NO: 8089 - RNA, 1449 nt, Artificial Sequence
  derived and/or modified CDS sequence (opt11) from CCHFV(BT958)__EF123122.1__N
auggaaaacaaaaucgaagucaacaacaaagacgagaugaacaggugguucgaagaguucaagaaagaaaacggccuugucgacacauucacaaacagccacucauucugcgaaucaguccccaaccuagacaaauucgucuuccaaauggcaagcgcgaccgacgacgcccaaaaagacuccauauacgcagccgcccuaguagaagcaaccaaauucugcgcgccaauauacgaaugcgccugggucucaucgaccggaaucguaaagaaaggccuggaaugguucgagaaaaacgccggcacaauaaaaucgugggacgaaucauacacagaacucaaagucgaagucccaaaaaucgaacaacuaagcaacuaccaacaagccgcccuaaaauggcgaaaagacauaggcuucagaguaaacgcgaacaccgcaacccucucacacaaaguccucgccgaauacaaagucccaggcgaaaucgugauguccgucaaagaaaugcuauccgacaugauacgccgacgaaaccucauccuaaaccgaggcggagacgaaaacccccgcggccccguaucccgcgaacacgucgaauggugcagagaguucgucaaaggcaaauacauaauggcauuuaacccaccauggggagacaucaacaaauccggccgaucgggaaucgcccuaguagcaaccggacucgcaaagcucgccgaagccgaagggaaaggcgucuucgacgaagccaagaaaacagucgaagcacugaacggguaccuagacaaacacaaagacgaagucgauaaaucauccgccgacuccaugauaacaaaccuacugaaacauaucgccaaagcccaagaacucuaucgcaacagcuccgcccuccgcgcacagggcgcccagaucgacaccgcauuuuccaguuacuacuggcucuacaaagcaggcgucaccccagaaacauucccaacugucucccaauuccucuucgaacuaggcaaacaaccccgcggcacgaaaaagaugaagaaggcccuccuauccacacccaugaaauggggcaagaaacucuacgaacuauuugccgacgacucauuccaacaaaaccgcaucuacaugcacccggccguacucacagccggacgcauaagcgaaaugggcgucugcuucggcaccauacccgucgcuaaccccgacgacgcggcacuaggcuccggccacacaaaauccauccuaaaccuccgcaccucaaccgaagccaacaaccccugcgcaaaaaccaucguaaaacuguucgaaauccagaagaaaggcuucgucauaaaagacauggacaucgucgccagcgaacaccuccugcaccaauccuuagucggaaaacaaagcccguuccagaacgcauacaacgucaaaggcaacgccaccuccgccaacauaaucuag

SEQ ID NO: 8090 - RNA, 1449 nt, Artificial Sequence
  derived and/or modified CDS sequence (opt11) from CCHFV(C-68031)__DQ211642.1__N
auggaaaacaaaauagaagucaacaacaaagacgaaaugaacaaaugguucgaagaauucaaaaaagggaacggccucguagacaccuucaccaacucguacucauucugcgaauccgugcccaaccuggaaagguucguauuccaaauggccagcgcaaccgacgacgcacaaaaagacucaauuuacgccagcgcccuaguagaggccacaaaauucugcgccccgauauacgagugcgcauggguaaguucgaccgggaucgucaaaaaagggcucgaaugguucgagaaaaacgccggaacaauaaaaucaugggacgaauccuacauagaacugaaaguagaaguacccaagaucgaacaacuggccaacuaccaacaagcagcccuaaaauggcgaaaagacauaggauuccgcguaaacgcaaacacggccgcacuaucgcacaaagucuuagccgaauacaaaguccccggcgaaaucguaauguccgucaaagaaaugcucucggacaugaucagacgccggaaccuaauccugaacagaggaggcgacgaaaacccaagaggccccgucagcagagaacacgucgaauggugccgagaguucguaaaaggaaaauauaucauggcauucaacccacccuggggcgacauaaacaaauccggcagauccggcauagcccuaguggcaaccggacucgccaaacucgcagaaacggaagggaaaggcgucuucgacgaggccaaaaaaacgguagaagcccucaacggcuaccuagacaaacacaaagacgaagucgacaaagcaagcgcagacaacaugauaacaaaccuacucaaacacaucgcgaaagcccaagaacucuauaaaaacagcuccgcccuacgcgcgcagggagcacaaaucgacaccgcauucuccagcuacuacuggcucuacaaagcgggcguaaccccagaaacauucccaaccgucagccaauuccuauucgaacuaggcaaacaaccgcgaggcaccaaaaaaaugaaaaaagcacuccugagcacgcccaugaaauggggcaaaaaacuauacgaacuauucgcggacgacagcuuccaacaaaaccgaaucuacaugcacccagccguccucacagccggacgaaucagcgaaaugggggucugcuucgggaccauccccguagccaacccagacgacgccgcccaagguucaggccacaccaaaagcauccucaaccuacgaaccaacacagaaacaaacaacccaugcgcgaaaaccaucgucaaacuguucgagauccaaaaaaccggcuucaacauacaagacauggacaucguagccucagaacaccuccuccaccaaagccuaguaggaaaacaaucccccuuccagaacgcauacaacgucaaaggcaacgcaacaagcgccaacauaaucuaa

SEQ ID NO: 8091 - RNA, 1449 nt, Artificial Sequence
  derived and/or modified CDS sequence (opt11) from CCHFV(China)__AF354296.1__N
auggaaaacaagauagaagucaacaacaaagacgaaaugaacaaaugguucgaagaguucaaaaaaggaaacggacuaguagacaccuucacaaacucauacagcuucugcgaauccguccccaaccuagaacgcuucgucuuccaaauggcaucagcaaccgacgacgcacagaaagacagcaucuacgcauccgcccuagucgaagccaccaaauucugcgcacccauauacgagugcgccugggucaguuccaccggcaucgucaaaaagggacucgaaugguucgaaaaaaacgcaggcaccauaaaaagcugggacgaaucauacaccgaacuaaaagucgaaguccccaaaauagagcaacuagccaauuaccagcaagccgcccuaaaauggcgcaaagacauaggcuuccgcgugaacgcaaacaccgccgcccucagccacaaaguacucgccgaauacaaaguccccggcgagaucguaauguccgucaaagaaaugcuaucagacaugauccgccgccgaaaccucauccucaacuccggcggcgacgaaaacccccgcggccccguaucccgagagcacgucgaguggugccgagaauucgucaaaggaaaauacauaauggcauucaaccccccauggggugacauaaauaaauccggccgauccggcaucgcccucguagcaacaggccucgccaaacucgcagaaacaggcggaaaaggcgucuucgacgaagccaaaaaaacagucgaagcccugaacggauaccuagacaaacacaaagacgaggucgacaaagccagcgcagacaacaugaucacaaaccuccuaaaacacauagccaaagcacaagaacucuacaaaaacucaagugccuuacgagcccaaggagcccaaauagacacagcauucuccagcuacuacuggcucuacaaagcaggagccacacccgagaccuucccaacagucucccaauuccuauucgaacucggcaaacagccaagaggcaccaaaaaaaugaaaaaagcacuccuaagcacacccaugaaauggggcaaaaaauuauacgagcucuucgccgacgacuccuuucaacagaacagaaucuacaugcaccccgccguccucaccgccggccgcaucucagaaaugggagucugcuucggcaccauccccguagcaaaccccgacgacgcggcacagggaucgggccacaccaaaagcauacucaaccuccgcaccaauaccgagaccaacaaccccugcgccaaaaccauaguccgccucuucgaaauacaaaaaaccggauucaacauccaagacauggacaucgucgccuccgaacaccuacuccaccaaucacucguaggaaaacaauccccguuccaaaacgccuacaacguaaaaggcaacgccacaagcgccaacaucaucuag

SEQ ID NO: 8092 - RNA, 1449 nt, Artificial Sequence
  derived and/or modified CDS sequence (opt11) from CCHFV(China)__AF358784.1__N
auggaaaacaaaauagaagucaacaacaaggacgaaaugaacaaaugguucgaagaauucaaaaaaggcaacggccuagucgacaccuucaccaacuccuacuccuucugcgagucagugcccaaccuagaccgauucguauuccaaauggccucagcaacagacgacgcacaaaaagacucaaucuacgcauccgcccucgucgaagcaaccaaauucugcgcaccaaucuacgaaugcgcgugggucagcuccacaggcaucguaaagcgaggccuagagugguucgagaaaaacgcaggcaccaucaaauccugggacgaaucauacaccgaacugaaagucgaaguccccaaaauagaacaauucgcggacuaccaacaggcagcccucaaauggcgcaaagacauaggcuuccgcguaaacgcaaacaccaccgcccucucgcacaagguacucgccgaauacaaaguccccggagaaaucguaaugagcguaaaagaaaugcucagcgacaugauucgcagacgcaaccuaauccucaaccgaggcggagacgaguccccccgaggccccguaagcagagaacacgucgaauggugcagagaauucgucaaaggcaaauacaucauggcauucaaccccccauggggcgacaucaacaaauccggcaggucaggcaucgcccucgucgcaaccggacuagccaaacucgccgaaacagaggggaaaggcgucuucgacgaggcgaaaaaaaccguagaagcccucaacggcuaccucaacaaacacaaggacgaagucgacaaagcguccgcagacucaaugauaaccaaccuccucaaacacaucgccaaagcccaagaacuauauaaaaacagcagcgcccuacgugcccaaggcgcccaaaucgacaccgccuucagcagcuacuacuggcuguacaaagcaggcgucaccccagaaacguuccccaccguaagccaguuccucuuugagcucggcaaacaaccacgcggaacaaaaaaaaugaaaaaagcccuccuauccacaccccuaaaauggggaaaaaaacucuacgagcuauucgccgacgacucguuccaacaaaaccggauauacaugcaccccgccguccucaccgcaggcagaaucagcgaaaugggcguuugcuucggcaccauccccguagccaaccccgacgacgccgcacaaggcuccggacacacuaaaagcauacucaaccuacgaacgaacacagagaccaacaauccaugcgcaaaaaccaucgugaaacuauucgaaauccaaaaaaccggcuucaacauacaggacauggacaucguagccuccgaacaccuacuacaccaaucccucguaggaaaacaaaguccguuccaaaacgcauacaacgucaaaggcaaugcaacauccgccaacauaauauag

SEQ ID NO: 8093 - RNA, 1449 nt, Artificial Sequence
  derived and/or modified CDS sequence (opt11) from CCHFV(China)__AF362080.1__N
auggaaaacaaaaucgaaguaaauaacaaagacgagaugaacaaaugguucgaagaguucaaaaagggcaacggccuagucgacaccuucacaaacagcuacucauucugcgaaucaguccccaaccucgaacgcuucgucuuccaaauggcaagcgcaaccgacgacgcccaaaaagacucaaucuacgcauccgccuuagucgaagcaaccaaauucugcgcacccaucuacgaaugcgcauggguauccucaaccggaauagucaaaaagggacuggaaugguucgagaaaaacgccggcacaaucaaaucgugggacgaauccuacaccgaacugaaaguagaaguacccaaaaucgaacaacucaccaauuaccaacaagcggcacuaaaauggcgcaaagacaucggcuuccgugucaacgccaacaccgcggcacuaucccacaaaguccuagccgaauacaaaguaccgggcgaaaucgucaugagcgucaaagaaaugcucagcgacaugauacgcagacgcaaccucauccucaaccgaggcggagacgaaaacccacgcggccccguaucacgcgaacacguagaauggugccgcgaguucgucaaaggaaccuacaucauggccuucaacccucccuggggcgacaucaacaaauccggccgcuccggaaucgcccuagucgcaacaggccucgccaaacucgccgaaaccgaaggcaaaggcguauuugacgaagcgaagaaaacagucgaagccuugaacggauaccucgacaaacacaaagacgaaguagacaaagccagcgcagacaacaugaucaccaaccuccuaaaacacauagccaaagcccaagaacucuacaaaaacuccucugcccuacgcgcacaaggagcccaaaucgacacagcguucuccagcuacuacuggcuauacaaagccggcgucaccccggaaaccuuccccaccguaagccaguuccucuucgaacucggcaaacaaccacgcggcaccaagaaaaugaagaaagcucuacuaucaacgcccaugaaauggggcaagaaacucuacgaacuauucgccgacgacagcuuccaacaaaacagaauauacaugcaccccgcaguccucaccgccggccgcaucucagagaugggcguaugcuucggcacaauacccguagccaaccccgacgacgccgcacagggcucaggacauacuaaaagcauacucaaccuccgcaccaacaccgaaaccaacaaccccugcgccaaaacaaucguaaaacucuucgaaauccagaaaaccggcuucaacauccaagacauggacauagucgcgucagagcaccuccugcaccaaagccucgucggcaaacaaucccccuuccaaaacgcguacaacgucaaaggaaacgcuacaagcgccaacaucauauga

SEQ ID NO: 8094 - RNA, 1449 nt, Artificial Sequence
  derived and/or modified CDS sequence (opt11) from CCHFV(China)__AY029157.1__N
auggaaaacaaaauagaaguaaacaacaaagacgaaaugaacaaaugguucgaggaguucaagaaaggcaacggccuggucgacacauucacaaacuccuacucguucugcgaaagcguccccaacuuagaacgcuucgucuuccaaauggcaagcgccacagacgacgcacaaaaagacagcaucuacgccagcgcgcucguagaagccaccaaauucugcgcccccauauacgaaugcgccuggguaucaagcacaggcaucgucaagaaaggacucgaaugguucgagaaaaacgccggaaccauaaaaagcugggacgaaagcuacaccgaacugaaagucgaaguccccaaaaucgaacaacucgccaacuaccaacaggccgcgcucaaauggcgaaaagacaucgguuucagagucaacgccaacaccgccgcacucagccacaaaguccuagcagaauauaaagucccaggagaaaucgucaugagcguaaaagaaaugcucagcgacaugauccgacggcgaaaccucauccucaaccgcgguggagacgaaaacccccgcggcccaguaagccgagaacacgucgaguggugccgagaguucgucaaaggcaaauacaucauggcauucaaucccccauggggagacaucaacaaaagcggcagaagcggaauagccuuagucgcgaccggccucgccaaacuagcagaaaccgaaggcaaaggagucuucgacgaagcaaagaaaaccgucgaagcgcucaacggcuaccuagacaaacacaaagaugaagucgacaaagccucagccgacaacaugaucaccaaccuccucaaacacaucgcgaaagcacaagaacuauacaaaaacuccagcgcccuccgcgcacaaggcgcacaaauugacacagccuucagcagcuacuacuggcuauacaaagcaggagucacgccagaaaccuuccccaccgucagccaauuccucuucgaacucggcaaacaaccccgcggaaccaagaaaaugaagaaagcacuccucucaacaccgaugaaauggggcaagaaacucuacgaacucuucgccgacgacagcuuccaacaaaaccgaaucuacaugcaucccgcgguccucaccgccggccgaauaucagaaaugggcgucugcuucggaacaaucccaguagcuaacccugacgacgcagcacaaggcuccgggcacaccaaaagcauacuaaaccuccgcacaaacaccgagaccaacaaccccugcgcaaaaacaaucgugaaacuauucgaaauacagaaaacaggcuucaacauacaagacauggacauagucgccagcgagcaccuucugcaccaaagccuagucggaaaacaaagccccuuccaaaacgccuauaacguaaaaggaaacgccacauccgccaacaucaucuaa

SEQ ID NO: 8095 - RNA, 1449 nt, Artificial Sequence
  derived and/or modified CDS sequence (opt11) from CCHFV(DAK 8194)__U88411.1__N
auggaaaacaaaaucgaagucaacaacaaagacgaacucaacaaaugguucgaagaguucaagaaaggcaacggccucgucgacacauucaccaacuccuacucauucugcgaaaacaugcccaaccuagaccgauucgucuuccaaauggccggcgccacagacgacgcccaaaaagacucgaucuacgccucagcccucguagaggcaaccaaauacugcgccccgaucuacgaaugcgccugggucagcuccaccggaauugucaaaagaggccucgaaugguucgagaaaaacacaggaacaaucaaaucaugggacgaaucuuacaccgaacucaaaguagacgucccuaaaaucgaacaacucgccaacuaccagcaagccgcccucaaauggcgcaaagacaucggcuucagagucaacgcaaacaccgccgcccuauccaacaaaguccucuccgaguacaaaguccccggcgaaaucgucaugagcgucaaagaaaugcucucagacaugauccgacgccgcaaccuaauccugaaccgcggcggcgacgaaaacccccgaggacccgucagcaaagaacacaucgaauggugccgcgaguucguaaaaggcaaauacaucauggccuucaacccuccauggggcgacgucaacaaaagcggccgcagcggaaucgcccuagucgcaaccggccucgcaaaacucgcugaaacagaaggaaaaggugucuucgaagaagccaagaaaaccgucgaagcccuaaaagaauaccuagacaaacauaaagacgaagucgacaaagcaucagccgacucaauggucacaaaccuacucaaacacauaacaaaagcacaagaacuauacaaaaacucaagcgcacuccgagcccagggcgcccagaucgacaccccauucagcucauucuacuggcucuacaaagccggcgugaccccagagacauuccccaccgucagccaauuccucuucgaacuuggcaaacaaccacgaggcaccaagaaaaugaagaaagcccuccucucuacgccaaugaaaugggggaagaaacuauacgaacucuucgccgaugacucauuccaacaaaaccgcauauacaugcauccagcaguucuaacagccggccgcauauccgagaugggcgucugcuucgggaccauacccgucgccgaccccgacgacgcagcacaaggcuccggccacaccaaauccauccucaaccuacgaacauccuccgaaaccaacaaccccugcgccaaaaccauaguaaaacuauucgaaguccagaaaacaggauucaacauccaagacauggacaucguagccagcgagcaucuccuccaccaaucccucgucggaaaacaaucccccuuccaaaacgccuacaacguaaaaggcaacgcaacaagcgcaaacaucaucuaa

SEQ ID NO: 8096 - RNA, 1449 nt, Artificial Sequence
  derived and/or modified CDS sequence (opt11) from CCHFV(Drosdov)__U88412.1__N
auggaaaacaaaaucgaagucaacuccaaagacgaaaugaacaaaugguucgaagaauuuaagaaagaaaacggacucauggacaccuucacaaacuccuacucauucugcgaaaacguccccaaccucgacaaauucgucuuccaaauggcaagcgcaaccgacgacgcccaaaaagacucaaucuacgcaagcgccuuaguagaagcaaccaaauucugcgcacccaucuacgaaugcgcaugggucagcuccaccggcaucgugaagaaaggccucgaaugguucgagaaaaacagcggcacgauaaaaucaugggaugaaaacuacacagaacucaaagucgacgugcccaagaucgaacaacuagccaacuaccaacaagcggcccucaaguggcgaaaagacauaggauuccgcguaaacgccaacacagcagcccucucaaacaaaguccuagcagaauacaaaguccccggcgaaaucgucaugagcgucaaagaaaugcucucugacaugauccgacgacgaaaccuuauacuaaaccgcggcggcgacgagaacccccgcggccccgucucccgagaacacgucgaauggugcagagaguucgucaagggcaaguacaucauggcuuucaacccacccuggggcgacaucaauaaauccggccgcagcgggaucgccuuggucgccacaggacuggccaaacucgcugaaaccgaaggcaaaggcgucuucgacgaagccaagaaaaccgucgaagcccucaacggcuaccucgacaaacaccgggaugaaguagacaaagccuccgccgacagcaugauaaccaaccuucucaaacacaucgcaaaagcccaagaacuguacaaaaacagcucagcccuacgagcacaaggcgcccaaaucgacacacccuucuccagcuucuacuggcucuacaaggccggcgucacccccgaaaccuuccccacaauaucccaauuccucuucgaacuuggcaaacaaccccgaggaacaaagaaaaugaagaaagcccuacucagcaccccaaugaaauggggcaagaaacucuacgaacucuucgccgacgacucauuccaacaaaaucgaauauacaugcacccggccguccucaccgccggaagaaucagcgaaaugggagucugcuucggaaccaucccagucgcaaaccccgacgacgcagcccaaggcucgggccacaccaaaagcauacucaaccuccgcacaucaaccgaaacaaacaaccccugcgccaaaaccaucgucaaacuguucgaaauccaaaagacaggcuucaacauacaagacauggacaucgucgccucagaacaccuacuccaccaaucucuagucgguaaacaaucccccuuccaaaacgccuacaacguaaaaggcaacgccaccagcgcaaacaucaucuga

SEQ ID NO: 8097 - RNA, 1449 nt, Artificial Sequence
  derived and/or modified CDS sequence (opt11) from CCHFV(Eskisehir23-2012)__KR092376.1__N
auggaaaacaaaaucgaggucaacucaaaagacgaaaugaacaaaugguucgaagaauuuaaaaagggaaacggccucauggacacauucacgaacagcuacuccuucugcgaaaacguaccaaaccucgacaaauuuguauuccaaauggccagcgccacagacgacgcacaaaaagacuccaucuacgcguccgcacucgucgaagccaccaaauucugcgcaccaaucuaugaaugcgccugggucuccucaaccgguaucguuaaaaagggacuagaaugguucgagaaaaacaccggcaccaucaagagcugggacgaaaacuacgcggaacucaaagucgacgucccaaaaaucgaacaacuagccaacuaccaacaagccgcccucaaauggcgcaaagacaucggcuuccgagucaacgcuaacaccgcagcccuuuccaacaaaguccuagccgaauauaaagucccaggcgaaaucguaaugagcguaaaagaaaugcuauccgacaugaucagacgacgaaaccuaauccuaaaccggggaggaggcgaaaacccgcgagggcccguaagccgagaacacguggaauggugccgcgaguucgucaagggaaaauacauaauggccuucaacccacccuggggagacaucaacaagucaggccguuccggaauagcacucguagcaaccggacucgcaaaacucgcggaaaccgaaggcaaaggaguauucgacgaagccaaaagaaccgucgaagcucucaacggauaccucgacaaacaccgagacgaagucgacaaagcauccgccgauucaaugaucacaaaccuccucaaacacaucgccaaagcccaagaacuauacaaaaacucuucagcccuccgcgcccaaggcgcccaaauagacacccccuucagcuccuucuacuggcucuacaaagccggcguaacccccgaaacauucccaacaauaucccaauuccucuucgaacucggcaaacaaccccgcggcacgaaaaagaugaagaaagcccuccucuccacacccaugaaauggggcaagaaacucuacgaacucuucgccgacgacagcuuucaacaaaaccgcaucuacaugcaucccgccguucuaaccgcgggccgcaucuccgaaaugggcgucugcuucggaacgauccccguagccaaccccgacgacgccgcacaaggcagcggacacaccaaauccauacuaaaccuccgaacaucaaccgaaaccaacaacccaugcgcgaaaaccaucguaaaacuauucgaaauccagaaaaccggcuucaacauccaagacauggacauaguggccuccgaacaccuccuccaccaaagccuagucgggaaacaaucuccauuccaaaacgccuauaacguaaaagggaacgcaacaagcgccaacauaauauga

SEQ ID NO: 8098 - RNA, 1449 nt, Artificial Sequence
  derived and/or modified CDS sequence (opt11) from CCHFV(Hodzha)__AY223475.1__N
auggaaaacaaaaucgaagucaacaacaaagacgagaugaacaaaugguucgaagaguucaagaaaggcaacggccuagucgacacauucaccaacucauacucauucugcgaaagcguccccaaccucgaccgcuuugucuuccaaauggccagcgcaacagacgacgcccaaaaagacagcaucuacgccucagcacucguugaagcaacaaaauucugcgccccaaucuacgaaugcgcaugggucucaucaaccggaaucgugaagaaaggccucgaaugguucgagaaaaacgccggaaccaucaaaagcugggacgaaucauacaccgaacucaaagucgaaguacccaaaaucgaacaacucgcaaacuaucagcaagccgcccuaaaauggcgcaaagacaucggguucaggguaaacgccaacaccgcagcacuaucccacaaaguacuauccgaauacaaagucccuggcgaaaucgucaugucggucaaagaaaugcucuccgacaugauccgccgccgcaaccucauccucaaccgaggaggggacgaaaaccccagaggacccgugagccgggaacacgucgaauggugccgcgaguucgucaaaggaaaauacaucauggccuuuaacccacccuggggagacauaaacaaaagcggccgaucaggcaucgcccucguagccacaggacuagcgaaacucgcagaaacagaaggcaaaggagucuucgacgaagccaagaaaaccguagaagcacugaacggcuaccucgauaaacacaaagacgaagucgacaaagcguccgccgacaacaugaccaccaaccuccuaaaacacaucgccaaagcucaagaacuauacaaaaacagcucagcccuaagagcccaaggcgcccaaaucgacacagccuucuccagcuacuauuggcuguacaaagcgggagucacccccgaaacauuccccaccguaagccaauuccucuucgaacugggcaaacaaccccgcggaacaaagaaaaugaagaaagcccuacucuccacccccaugaaauggggaaagaaacuauacgaacucuucgccgacgacuccuuccaacagaaccgcauauacaugcaccccgccguacuaaccgccggacgcauaucugagaugggaguuugcuucggaaccguaccaguagcggaccccgacgacgccgcacaaggcuccggccacaccaaaagcauccuaaaccuccgcacaaacaccgaaaccaacaacccaugcgccaaaaccauagucaaacuauucgaaauccagaaaacaggcuucaacauccaagacauggacaucguagccagcgagcaccuccuccaccaaagccuagucggaaaacaaagccccuuccaaaacgcauacaacguuaaaggcaacgcaaccuccgccaacauaaucuag

SEQ ID NO: 8099 - RNA, 1449 nt, Artificial Sequence
  derived and/or modified CDS sequence (opt11) from CCHFV(Iran-52)__DQ446212.1__N
auggaaaacaaaauagaaguaaacagcaaagacgaaaugaacaaaugguucgaagaguucaagaaaggcaaugggcucgucgacaccuucacaaacuccuacucauucugcgaaucuguccccaaccuagacagauuugucuuccagauggcaagcgccaccgacgacgcacaaaaagauuccaucuacgccagcgcccugguagaagccacaaaauucugcgcacccaucuacgaaugcgccugggcaucaucaaccggaauaguaaagaaaggacucgaaugguucgagaaaaacgccggcaccauaaaauccugggacgaaucauacaccgaacucaaagucgagguccccaaaaucgaacagcucuccaacuaccaacaagcagcccucaaauggaggaaagacaucggcuuccgaguaaacgccaacaccgccgcccucucaaacaaaguacuagccgaguacaaaguccccggcgagauagucaugagcguaaaagaaaugcucuccgacaugauccgccgccggaaccugauccucaaccgaggcggcgacgagaacccccgcggaccagucucacgagaacacgucgaauggugccgagaguucguaaaagggaaauacaucauggccuucaacccacccuggggagauauaaacaaaucaggccgaucaggcaucgcucucguagccaccggccuggccaaacucgcagaaaccgaagggaaaggagucuucgacgaagcaaagaaaaccgucgaagcccugaacggauaccucgacaaacacaaagacgaagucgacaaagccagcgcagacucaaugauaacaaaccuccucaagcacauagcgaaagcccaggaacucuacaaaaacagcucagcccuccgagcacaaggcgcccaaaucgacacaguauucucaagcuacuacuggcucuacaaagccggagucacccccgacaccuuccccaccguaucccaauuccuauucgaacucggcaaacaaccccgaggaacaaagaaaaugaagaaagcacuccucagcaccccaaugaaauggggcaagaaacucuacgaacuauucgccgacgacuccuuccaacaaaaccgcaucuacaugcacccugccguccucacugcaggccgcaucagcgaaaugggagucugcuucgggaccauccccgucgcuaaccccgacgacgccgcccucggaucaggucacaccaaauccauccuuaaccuacgaaccaacacggaaaccaacaacccaugcgcacgcaccaucgucaaacuguucgaaauccagaaaaccgguuucaacauacaagauauggauaucguagccuccgaacaccuacuacaccaaagccucguaggaaaacagagccccuuccaaaacgcauacaacgucaaaggcaacgccaccuccgccaacauaaucuaa

SEQ ID NO: 8100 - RNA, 1449 nt, Artificial Sequence
  derived and/or modified CDS sequence (opt11) from CCHFV(Iran-53)__DQ446213.1__N
auggaaaacaaaauagaagucaacucaaaagacgaaaugaacaaaugguucgaagaauucaaaaagggaaacggccuaguagacaccuucacaaacuccuacucauucugugaaucaguccccaaccuagaccgguucgucuuccaaauggccuccgccacagacgacgcccaaaaagacagcaucuaugccucagcccucguagaagccacuaaauucugcgcccccaucuacgagugcgcaugggccagcuccaccggcaucguaaaaaagggacuagaaugguucgaaaaaaacgccggcaccaucaaguccugggacgagucauacaccgagcucaaaguggaaguucccaaaaucgagcaacucagcaacuaccaacaagcagcccuaaaauggcgcaaagacaucggcuuccgagucaacgccaacacggccgcccuaucaaacaaaguccucgccgaauacaaaguccccggagaaaucgucauguccgucaaggagaugcucuccgacaugauccgccgacgcaaccucaucuuaaacaaaggaggagacgaaaacccacgcggcccagucagccgagaacacgucgaauggugccgcgaauucgugaaaggcaaauacaucauggcauucaacccaccuuggggagacauaaacaaauccggcagaucaggcaucgcccuagucgccaccggucucgccaaacucgccgaaaccgaagggaaaggagucuucgacgaagccaaaaaaaccgucgaagcccucaacggcuaccucgacaaacauaaagacgaaguagacaaagcauccgccgacucuaugauaaccaaccuacuaaaacacaucgccaaagcacaggaacuauacaaaaacuccuccgcccuccgagcacaaggcgcccaaaucgacaccgucuucucauccuacuacuggcucuacaaagccggcguaacccccgacacguuccccaccgucucccaauuccucuucgaacucggaaaacaaccacgcggcacaaaaaaaaugaaaaaagcacuucuauccacacccaugaaauggggcaaaaaacuauacgagcucuucgcagacgacucauuccaacaaaaccgaauuuacaugcaccccgccguccuaaccgccggacgcauuagcgagaugggcguaugcuucggcaccauccccgucgccaaccccgacgacgcagcacuaggcucaggccacaccaaaagcauccucaaccuaagaaccaauaccgaaaccaacaacccaugcgcacgcaccauagucaaacucuucgaaauccaaaaaaccggauuuaacauccaagacauggauaucguagccuccgaacaccuacuacaccagagccuagugggcaaacaaagcccuuuccaaaacgccuacaacgucaagggcaacgccacgagcgcaaacaucauauga

SEQ ID NO: 8101 - RNA, 1449 nt, Artificial Sequence
  derived and/or modified CDS sequence (opt11) from CCHFV(JD 206)__U88414.1__N
auggaaaacaaaaucgaagucaacuccaaagacgaaaugaacaaaugguucgaggaguucaagaaaggcaacggccuagucgacacauucacaaacagcuacucauucugcgaaaacgucccaaaccuagaccgguucgucuuccaaauggcaagugcaaccgacgacgcucaaaaagacuccauauacgcaucagcccucgucgaagccaccaaauucugcgcgccaauauacgagugcgccugggcaagcucaaccgggauagucaagaaaggccuggaaugguucgagaaaaacgccggaacaauuaaaagcugggacgaaucauacaccgaacuaaaaguagaaguacccaaaaucgaacaacucagcaacuaccaacaagcagcccuaaaauggcgaaaagacaucggauuccgggucaacgcaaacacagcagcacuauccaacaaaguccucgcagaauacaaagucccaggcgagauagugaugagcgucaaagaaaugcuaucagacaugauacggcgcagaaaccucauacuaaaccgcggaggcgacgaaaacccacgaggaccagucagcagggaacacguagaauggugccgagaguucgucaaaggaauguacaucauggccuucaacccaccauggggcgacaucaacaaaucaggccgauccggcaucgcccucgucgccaccggccucgccaaacuggcggaaacagaaggcaagggcgucuucgacgaagccaagaaaaccguagaagcccucaacggcuacuuagacaaacacaaagacgaaguagacaaagcgagcgcagacucaaugaucaccaaccuccucaaacacauagcaaaagcccaagaacucuacaaaaacagcucggcacuccgcgcccaaggcgcgcaaaucgauaccgucuucuccagcuacuacuggcucuacaaagcaggcgugacacccgacaccuuccccaccgucagccaauuccucuucgaacucggcaagcaaccccgcggcaccaagaaaaugaaaaaggcccuacuauccacacccaugaaauggggaaagaaacuauacgaacucuucgccgacgacucauuccaacaaaaccgcaucuacaugcacccagcaguccucaccgccggccgaaucagcgaaaugggcgucugcuucggaaccauaccagucgccaacccagacgacgccgcccuagggucaggacacaccaaaagcauccucaaccuccgaacaaacacagaaacaaacaacccaugcgccaaaaccaucgugaaacuauucgaaauccagaaaaccggcuucaacauccaagacauggacaucguagccucagaacaccuccuacaccaaagccuagucggaaaacaaagccccuuccaaaacgccuacaacgucaaaggaaacgccaccagcgcaaacaucauauaa

SEQ ID NO: 8102 - RNA, 1449 nt, Artificial Sequence
  derived and/or modified CDS sequence (opt11) from CCHFV(Kashmanov)__DQ211644.1__N
auggaaaacaaaaucgaaguuaacucaaaagacgaaaugaacaaaugguucgaagaauuuaagaaagaaaacggacucauggacacauucaccaacuccuacucauucugcgaaaacguaccaaaccuagacaaauucgucuuccaaauggccagcgcaaccgacgacgcccaaaaagacuccaucuacgcaagcgcccuugucgaagcaacaaaauucugcgccccaauauacgaaugcgcaugggucagcucaaccggcaucgucaagaaaggccucgaaugguucgaaaagaacagcggcaccaucaaauccugggacgaaaacuacgccgaacucaaaguagacguacccaaaauagaacaacucgccaacuaccaacaagccgcccugaaauggcgaaaagacaucggcuuccgugucaacgccaacacggccgcacuaucuaacaaaguccucgccgaauacaaagucccaggcgaaaucgucauguccguaaaagaaaugcucucagacaugauccgucgcaggaaccuaauacuaaaucgcggcggcgacgaaaacccgcgcggcccagucagccgugaacacgucgaauggugccgcgaguucgucaaaggaaaauacaucauggccuucaacccacccuggggagacaucaacaaaucaggccgcagcggaaucgcccuagucgcaacgggccuagccaaacucgcagaaaccgaaggaaaaggcgucuucgacgaagccaagaaaacaguagaagcccucaacggauaccucgacaaacaccgcgacgaagucgacaaagcaagcgcagacucaaugaucacaaaccuccugaaacacaucgcuaaagcccaagaacucuacaaaaacagcuccgcacuacgugcccaaggcgcacaaaucgacaccccauucuccagcuucuacuggcucuacaaagcaggcgucaccccagaaacauucccaaccaucagccaauuccuguucgaacuaggaaaacaaccaagaggaaccaagaaaaugaagaaagcacuacuauccacacccaugaaauggggcaagaaacucuacgaacucuucgcagacgacuccuuccaacaaaacagaaucuacaugcaccccgcaguccuaaccgccggacgcaucagcgaaaugggagucugcuucggcacaaucccugucgccaaccccgacgacgcggcccaaggcuccggccacaccaaauccauccuaaaccuccgcaccucaaccgaaaccaacaacccuugcgccaaaaccaucguaaaacuguucgaaauacagaaaacaggcuucaacauccaagacauggacauaguagccuccgaacaccuacuccaccagucccuagucggcaaacaaucccccuuccagaacgccuacaacgucaaagguaacgccaccagcgccaacaucaucuaa

SEQ ID NO: 8103 - RNA, 1449 nt, Artificial Sequence
  derived and/or modified CDS sequence (opt11) from CCHFV(NIV 10405051)__JF922681.1__N
auggaaaacaaaauagaagucaacaacaaagacgaaaugaacaaaugguucgaagaguucaagaaaggcaacggacucgucgacacauucaccaauaguuauagcuucugcgaaagcgucccaaaccucgaccgcuucguauuccagauggcuuccgccacagacgacgcacaaaaagacucaaucuacgcgucagcccuugucgaagccaccaaauucugcgcccccaucuacgaaugcgcauggguaagcagcacgggaauaguaaagaaaggccuggaaugguuugagaaaaacgccggcacaaucaaaucaugggacgaaucauacacagaacucaaaguggaagucccaaagauagagcaacuagccaacuaccaacaagccgcccucaaauggcgcaaagacaucggcuuccgagucaacgccaacacagccgcacucucccacaaaguccuggccgaauacaaagucccaggcgaaaucgucaugucagucaaagaaaugcucucggacaugauccggcgcaggaaccugauccuaaacagaggaggagacgaaaacccccgaggacccguaagccgcgaacacgucgaauggugccgugaguucguaaaaggcaaauacauaauggcauucaacccgccauggggcgacaucaacaaaucgggcaggucaggcauagcccuaguagcaacaggccuagcaaaacucgccgaaacagaaggcaagggcguauucgacgaagccaagaaaacuguagaagcacugaacggcuaccuggacaaacacaaagacgaagucgacaaggccagcgccgacaacaugaucaccaaccuccucaaacacaucgccaaagcacaagaacuauacaaaaacagcuccgcccuccgcgcccaaggcgcccaaaucgacaccgccuucagcuccuacuacuggcucuacaaagccggcgucaccccagaaaccuuucccaccguaagccaauuccucuucgaacucggcaaacaaccccgaggcacaaagaaaaugaagaaagcccuacuaagcacacccaugcgcuggggcaagaaacuauacgaacucuucgccgacgacucauuccaacaaaaccgaaucuacaugcaccccgccguacucacagccggacgaaucagcgaaaugggaguaugcuucggcacaaucccgguagcaaacccagacgacgccgcccaaggcagcggccacacaaaaagcauacucaaccuccgaaccaacaccgagaccaacaaccccugcgccaaaacuaucgucaaacuguucgaaauccagaaaacaggcuucaauauacaagauauagacaucguggccagcgagcaccuacuccaccaaucacuggucggaaaacaaaguccauuccagaacgccuacaacgucaaaggaaacgcaaccuccgccaacauaaucuaa

SEQ ID NO: 8104 - RNA, 1449 nt, Artificial Sequence
  derived and/or modified CDS sequence (opt11) from CCHFV(Oman)__DQ211645.1__N
auggaaaacaaaauagaggucaacaacaaggaugaaaugaacaagugguucgaagaguucaagaaagggaacggccuaguagacaccuucaccaacagcuacucauucugcgaaucagucccaaaccucgaccgauucguauuccagauggccagcgccaccgacgacgcacaaaaagacagcaucuaugcauccgcccucgucgaggccaccaaauucugcgcacccauauacgaaugcgcaugggccagcagcaccggaaucguaaaaaaaggacuagaaugguucgaaaaaaacgcgggaaccauaaaauccugggacgaaucguacacagaacugaaagucgaaguccccaaaaucgaacaacucucaaacuaccaacaagccgcccucaaauggcggaaagacaucggcuucagaguaaacgccaacacagccgcccucucaaacaaaguacuagccgaauacaaaguaccaggagaaaucgucaugucaguaaaagaaaugcuauccgacaugauccgacgccgaaaccugauccugaaccgaggaggagacgaaaaccccaggggacccguaagccgcgaacacguagaauggugccgagaauucauaaaaggcaaauacaucauggccuucaaccccccauggggcgacauaaauaaguccggcagaagcggcaucgcccucgucgccaccggacucgccaaacucgcagaaacagaaggcaaaggcguauucgacgaagcaaaaaaaaccgucgaggcccuaaacggcuaccucgacaaacacaaagacgaggucgacaaagccagcgccgacucaaugaucaccaaccuacuaaaacacauagccaaagcgcaagaacucuacaaaaacuccagcgcucuccgggcccagggagcucaaaucgacacaguguucuccagcuacuacuggcucuacaaagccggcgugacacccgacacauucccaacaguuucccaauuccuuuucgaacucggaaaacaaccuagaggcaccaaaaaaaugaaaaaagcccuccucagcaccccaaugaaguggggaaaaaaacuguacgaacucuucgccgacgacagcuuccaacaaaaccgcauauacaugcacccagccguccucacagccggacgcaucagcgaaaugggagucugcuucggaaccauccccgucgccaacccagacgacgcagcccucggcagcggccacaccaaaucaauacucaaccuaagaaccaacaccgaaaccaacaaccccugcgcaaaaaccauagucaaacuauucgaaauccaaaaaacaggauucaacauccaggacauggacaucguagccucagaacaccuacuccaccaaucccucgucggcaaacaaagccccuuccagaacgccuacaacgucaaaggcaacgcaacauccgcaaacaucauauaa

SEQ ID NO: 8105 - RNA, 1449 nt, Artificial Sequence
  derived and/or modified CDS sequence (opt11) from CCHFV(SCT ex Afghanistan)__JX908640.1__N
auggagaacaaaauagaaguaaacaauaaggaugaaaugaacaaaugguucgaagaguucaagaaaggaaacggacucguggacacuuucacaaacagcuacagcuucugcgaaucgguccccaaccucgaccgcuucgucuuccaaauggccagcgccacagacgacgcacaaaaagacagcaucuacgccucagcacucgucgaagccaccaaauucugcgcaccuauauacgaaugcgccugggcgagcagcaccggaauagucaagaaaggccuagaaugguucgagaaaaacgcaggaaccaucaaaagcugggacgaaagcuacaccgaacuaaaagucgaagucccgaaaauugaacaacuaagcaacuaccaacaagccgcccucaaauggagaaaagacauaggcuucagagugaacgccaacacagcggcacucucuaacaaaguacucgccgaauacaaggucccaggagaaauaguaauguccgucaaagaaaugcucucagacaugauaagaagaagaaacuuaauacugaacagaggaggcgacgaaaacccucgcgggcccgucagcagggaacacgucgaauggugccgcgaguucauaaaaggcaaauacaucauggccuucaacccacccuggggagacaucaacaaaagcgggcgcucuggcaucgcacucguagccaccggucuagccaaacuagccgaaaccgaaggcaaaggagucuucgacgaagcaaagaaaaccgucgaagcccucaacggcuaccucgacaaacacaaagacgaagucgacaaagcaagcgcagacucaaugaucaccaaucuccuaaaacacaucgccaaagcccaagaacuguacaaaaacuccagcgcccuccgagcacaaggcgcgcagaucgacaccgucuucucaagcuacuacuggcucuacaaagccggcgucaccccggaaacauuccccaccguaagccaguuccucuucgaacucggcaagcaaccccgaggaaccaagaaaaugaagaaagcccuccucagcacccccaugaaauggggaaagaaacuauacgaacuauucgcagacgacuccuuccaacaaaacagaauauacaugcacccugccguacuaaccgccggaagaaucagcgaaaugggcguaugcuucggaaccauccccgucgcaaaccccgacgacgcagcacuuggcuccggccacaccaaaagcauccuaaaccuacgcaccaacaccgaaaccaacaacccgugcgcaaaaacaaucguaaaacuauucgagauacagaaaacaggcuucaacauccaagacauggacaucgucgccucagaacaccuacuccaccaaucacucgucggaaaacaaagccccuuccaaaacgcauacaacguaaagggcaacgcaaccagcgccaacaucauauag

SEQ ID NO: 8106 - RNA, 1449 nt, Artificial Sequence
  derived and/or modified CDS sequence (opt11) from CCHFV(Semunya)__DQ076413.1__N
auggaaaacaaaauugagguaaccucuaaagacgaaaugaacagaugguucgaggaguucaagaaaagcaacggccuaguagacaccuucaccaacuccuacuccuucugcgaaucaguccccaaccucgaccgcuucgucuuccaaauggcaagcgcaaccgacgaugcccaaaaagacagcaucuacgccagcgcccucguagaagcaaccaaauucugcgcacccaucuacgagugcgcaugggucuccuccacaggcauagucaagaaaggccuagaaugguucgagaaaaacgccgggacaaucaaauccugggacgaaucauacacagaacugaaaguaggcguaccaaaaaucgaacaacucgccaacuaccaacaagccgcccugaaauggcgcaaagacaucggcuuccgcgucaacgccaacacggcagcacuauccaacaaaguccuggcagaauacaaagugcccggagaaauaguaaugagcgucaaagaaaugcucucagacaugauaagaagaaggaaccuaauccugaaccgcggcggcgacgaaaacccccguggacccgucagccgcgaacacgucgaauggugccgcgaguucguaaaaggcaaauacaucauggcauucaacccacccuggggcgacaucaacaaaagcggacgcagcggaauagcacucgucgcaacaggccucgccaaacuagcagaaacagaagggaagggcguuuucgacgaagccaagaaaaccgucgaagcccuuaacggauaccuagacaaacacaaagacgaagucgacaaagcaagcgccgacggaauggucaccaaccuacuaaaacacaucgccaaagcacaagaacuauacaaaaacagcagcgcccuccgagcccaaggagcacaaaucgauacccccuucagcagcuucuacuggcuauacaaagcaggagucagcccggaaaccuucccaaccguaucacaauuccucuucgaacucggaaaacaaccccgcgggacaaagaaaaugaagaaagcccuccucaguacaccaaugaaauggggcaagaaacucuacgaacucuucgccgacgacucauuccaagaaaaccgaaucuacaugcaccccgcaguccugacagccggccgaaucagcgaaaugggcgucugcuucggcacaauccccguggcgaacccagacgacgccgcccaaggcagcggccacaccaaaagcauccuaaaccuccgcaccaacaccgagaccaacaaccccugcgcaaaaaccaucgugaaacuuuucgagauccagaaaaccggcuucaacauacaagacauggacauaguagccucggaacaccuccuacaccaaucccuggucggaaaacaaucccccuuccaaaacgccuacaacguaaaaggcaacgcaaccucagcaaacaucauauaa

SEQ ID NO: 8107 - RNA, 1449 nt, Artificial Sequence
  derived and/or modified CDS sequence (opt11) from CCHFV(SK 2015/human)__KX129738.1__N
auggaaaacaaaauagaaguaaacaacaaagacgaaaugaacaaaugguucgaagaguucaagaaaggaaacggccuagucgacacauacacaaauucauacuccuucugugaauccguccccaaccuagacagauucguauuccaaauggccagcgccaccgacgacgcccaaaaagacucgaucuacgcaucggcgcuaguagaagcaacaaaguucugcgccccaaucuacgaaugcgccugggcgagcuccacaggaaucgucaaaaaggggcuagaaugguucgagaaaaacgcaggaacgauaaaacuaugggacgaaucguacgccgaacucaaaguagaaguccccaaaauagaacaacucagcaauuaccaacaagccgcccucaaauggcgcaaagacaucggcuucagaguaaacgcaaacaccgccgcccucagcaacaagguacucgcagaauacaaaguacccggcgaaauaguaauguccgucaaagaaaugcugagcgacaugauacgccgcagaaaccuaauccugaaccgaggcggagacgaaaacccccgaggacccguaagcagggaacacgucgaauggugccgagaguucguaaaaggaaaguacaucauggccuucaacccaccauggggcgacauaaacaaaucaggcaggagcggaaucgcgcuggucgccacaggccuagcaaaacuugccgaaacagaaggaaaaggcguauucgacgaagccaagaaaaccgucgaagcccuaaacggcuaccucgacaaacacaaagacgaagucgacaaagccagcgccgacucaaugauaacaaaccuacucaaacacaucgccaaagcccaagaacuuuacaaaaacucaagcgcccuacgagcccaaggggcccaaaucgacaccguauucucaagcuauuacuggcuauacaaagcgggcgugaccccagacacauuccccaccguaagccaauuccuguucgaacucgggaaacaaccccgcggcacaaagaaaaugaagaaagcccuacuauccaccccaaugaaauggggaaagaaacuauacgaacucuucgccgacgacagcuuccaacaaaaccgcauauacaugcaccccgcaguccuaaccgccggccgcauaagcgaaaugggagucugcuucggaacgguaccagucgcaaaccccgacgacgccgcccucggcagcggccacaccaaaagcauccuaaaccuccgaaccaacaccgaaaccaacaaccccugcgccaaaacgaucgucaaacucuucgaaauccagaaaaccggcuucaacauacaagacauggacaucguggcauccgaacacuuacuccaccaaucauuagucggaaaacaaagccccuuccaaaacgcguacaacgucaaaggaaacgccacgagcgcaaacaucaucuag

SEQ ID NO: 8108 - RNA, 1449 nt, Artificial Sequence
  derived and/or modified CDS sequence (opt11) from CCHFV(SPU128/81/7)__DQ076415.1__N
auggaaaacaaaaucgaaguaaacaacaaacacgaaaugaacaaaugguuugaagaguucaagaaagguaacggccucguagacacguucacaaacucauacagcuucugcgaauccguccccaaccucgacaaauucguauuccaaauggccuccgcgaccgacgacgcacaaaaagacuccaucuacgccucggcacucgucgaagccaccaaauucugcgccccaauauacgaaugcgccuggguguccucaaccggcaucguaaaaagaggacuggaaugguucgagaaaaacgcaggaaccauaaaaucgugggacgaaucauacacagaacugaaaguagacguccccaaaauagaacaacucgccaauuaccaacaagccgcccugaaauggagaaaagacauaggcuuccgcguaaacgcaaacaccgccgcccucagcaacaagguacucgcagaauacaaaguacccggagaaaucguaauguccguaaaagaaaugcucucggacaugauccgacgccgaaaccaaauccucaaccgcggcggggacgagaacccgcgaggacccguaagccgggaacacguagacuggugcagagaguucgucaaaggcaaauacaucauggccuucaacccgcccuggggcgacaucaauaaaucaggccggagcggcauagcgcucguagccaccggccucgccaaacuagcggaaacagaaggcaaaggcgucuucgacgaagccaagaaaacagucgaaguccucaacggcuaccuggacaaacacaaagacgaagucgaccgcgcaagcgcagacuccaugauaaccaaccuccucaaacacaucgccaaggcgcaagaacuauacaaaaacagcucggcccuacgcgcgcaaggcgcacagauugacaccgcauuuagcagcuacuacuggcucuacaaagcaggcguaacccccgaaacauuccccacggugagccaauuccucuucgaacucggcaaacaaccucgcggcacaaagaaaaugaagaaagcacuccucagcacacccaugaaauggggaaagaaacucuacgaacucuucgccgacgacucauuccaacaaaaccgaauauacaugcacccagcaguacucaccgccggccgcauaagcgaaaugggaguaugcuucggaaccauacccgucgcuaaucccgacgacgcagcccaaggcuccggccauaccaaaagcauacucaaccuccgcaccaacaccgaaaccaacaacccaugcgcccgcacuaucguaaaacuauucgagauccagaaaacaggauucaacauacaagacauggacauaguagccuccgaacaccuccuacaccaaucccuggucggcaaacaaaguccguuccaaaacgcauacaacgucaaaggaaacgcgacaagcgcaaacauaaucuaa

SEQ ID NO: 8109 - RNA, 1449 nt, Artificial Sequence
  derived and/or modified CDS sequence (opt11) from CCHFV(Sudan Al-Fulah 4-2008)__GQ862372.1__N
auggaaaacaaaaucgaagucaacaacaaagacgaaaugaacaaaugguucgaagaguucaagaaaggaaacgggcuuguagacaccuucaccaacucauacaguuucugcgaauccguaccgaaccuggacaaauucguauuccaaauggcaagcgcgaccgacgacgcccaaaaagacagcaucuacgccuccgcccucguagaagcaacaaaauucugcgccccaaucuacgagugcgccuggguaagcucaaccggcaucgucaaacgcggccucgagugguucgagaaaaacgccggaaccaucaaauccugggacgaauccuacaccgaacucaaaguugacguccccaaaaucgaacaacuagccaacuaccaacaagcagcacucaaauggcgcaaagacauaggcuuccgcgugaacgcaaacaccgcagcccuauccaacaaaguccuggccgaguacaagguaccgggagaaaucguaaugucggucaaggaaaugcuauccgacaugaucagacgcagaaaccaaauacuaaaccgaggcggggacgaaaacccacgcggacccguaagccgagaacauguggacuggugccgcgaguucguaaaaggcaaguacaucauggccuuuaacccacccuggggcgacaucaacaaaucaggccgcucaggaauagcacucgucgccaccggccuggcaaagcuagccgaaacagaaggaaaaggagucuucgacgaagccaagaaaacaguagaagcccuaaacggcuaccuggacaaacacaaagacgaagucgaccgcgcaagcgcagacucaaugauaaccaaccuccucaaacacaucgccaaagcgcaagaacucuauaaaaacuccagcgcacuacgggcacaaggagcacaaauagacacugcguucuccagcuacuacuggcuauacaaagcgggggucaccccggaaaccuuccccaccgucucacaguuccucuucgaacuaggcaaacaaccacgcgguacaaagaaaaugaagaaagcgcuccuaagcacccccaugaaauggggcaagaaacuauacgaacuauucgccgacgacucauuccaacaaaaccgaaucuacaugcacccagcaguacuaaccgccggacgcaucucagaaaugggagucugcuucgggaccauucccguggccaacccugacgacgccgcccagggcuccggccacacaaaaagcauccucaaccuacggacaaacacagaaaccaacaaccccugcgcacgaacaaucgugaaacuauucgagauacagaaaacaggcuucuccauacaagacauggacaucguagccucagaacaccuacuacaccaaucccuuguaggcaaacaaagcccguuccaaaacgcauacaacgucaaaggcaacgcaacaagcgcaaacauaaucuaa

SEQ ID NO: 8110 - RNA, 1449 nt, Artificial Sequence
  derived and/or modified CDS sequence (opt11) from CCHFV(TAJUK)__JN086996.1__N
auggaaaacaaaaucgaaguaaacaauaaagacgaaaugaacaaaugguucgaagaguucaagaaaggcaacggccucgucgacaccuucacaaacucauacucauuuugcgagucaguccccaaccucgacagauucguauuccaaauggcaagcgcaaccgacgaagcacagaaagacucgaucuacgccucggcacucgucgaagccaccaaauucugcgcacccauauacgaaugcgcauggguaagcucaacaggcaucgucaagaaaggacuggaaugguucgagaaaaacgccgggacgaucaaaagcugggacgaauccuacacagaacucaaagucgaaguacccaaaaucgaacaacucgccaacuaccaacaagcagcccuaaaauggcgcaaggacauaggauuccgcguaaacgcgaacacggcagcacuaucccacaaaguacucgccgaauacaaagucccgggcgagaucguaaugagcgucaaagaaaugcucagcgacaugauccgccgaaggaaccugauccugaaccgcggcggggacgaaaacccccgcggacccgucuccagagaacacguagaguggugccgagaguucguaaaaggaaaauacaucauggcguucaacccacccuggggcgacaucaacaaauccggacgcuccgggauagcauuaguggccaccggacucgccaaacucgcagaaacggaaggcaaaggagucuucgacgaagcaaagaaaacaguagaagcccucaacggauaccuagacaaacacaaagacgaagucgacaaagcaagcgccgacaacaugauaacaaaccuccuaaaacacaucgccaaagcccaagaacucuacaaaaacagcuccgcccuacgcgcacaaggcgcacaaaucgacaccgcauucucauccuacuauuggcucuacaaggcgggcgucacccccgaaaccuuccccacgguaucccaauuccuguucgaacuuggcaaacaaccacgcggcaccaagaaaaugaaaaaggcacuauuaagcacccccaugaaauggggaaagaaacuguacgaacuauucgcagacgacuccuuccagcaaaacagaaucuacaugcacccagccguccucaccgccggccgaauaagcgagaugggagucugcuucgggaccaucccagucgccaaccccgacgacgccgcacaaggaagcggacacaccaaauccauacucaaccucagaacaaacaccgaaacaaacaacccaugcgccaaaacaauagucaaacucuucgaaauccagaaaaccggcuucaacauccaagacauggacauagucgccucagaacaccuccuccaccaaagucucguaggcaaacaaucaccauuccaaaacgcuuacaacgucaaaggcaacgccacaagcgccaacaucaucuaa

SEQ ID NO: 8111 - RNA, 1449 nt, Artificial Sequence
  derived and/or modified CDS sequence (opt11) from CCHFV(UG3010)__DQ211650.1__N
auggagaacaaaaucgaggucacaagcaaagacgagaugaacagaugguucgaagaauucaaaaaaagcaacggcuuaguggacaccuucaccaacucuuacagcuucugcgaguccguacccaaccuagaccgauucgucuuccagauggcauccgccaccgacgacgcccaaaaagacuccaucuacgccuccgcccucguagaagcgacaaaauucugcgcaccaaucuaugaaugcgcaugggucagcagcaccggcauaguaaaaaaaggacuagaaugguucgaaaaaaacgccggaacaauaaaaagcugggacgaaagcuacacagaacucaaagucggaguaccaaaaauagagcaacuagcaaacuaucaacaagccgcccucaaauggcgcaaagacaucgguuuccgcgucaacgccaacaccgccgcccucagcaacaaaguccucgcagaguacaaggucccaggcgaaaucgucaugagcgucaaagaaaugcucuccgacaugauucgccgccggaaccucauacuaaaccgaggcggcgacgagaacccccgcggcccagucagccgagaacacguagaauggugccgcgaguucguaaaaggcaaauacaucauggcauucaacccccccuggggcgacaucaacaaauccggucgaagcggaaucgcccucgucgcaaccggccucgccaaacuagcagaaacagaaggaaaaggcguauucgacgaagccaaaaaaacagucgaagaccuaaacggauaccuagacaaacacaaagacgaagucgacaaagcauccgcagacggaauggucaccaaucuacucaaacacauagccaaagcacaagaacuauauaagaacagcucagcacuccgcgcacaaggcgcccaaauugacacaccauucagcagcuucuacuggcucuacaaagcaggcguaagccccgaaaccuuccccaccgucucccaauuccucuucgaacucggaaaacaaccccgcggcacgaaaaaaaugaaaaaagcccuacucuccacccccaugaaauggggcaaaaaacucuacgaacucuucgcagacgacagcuuccaagaaaaccggaucuacaugcacccagccguacucaccgccggccgaaucagcgagaugggcgucugcuucgggaccauccccgucgcaaacccagacgacgccgcccagggauccggacacacgaaaagcauacuaaaccuccgaaccaacaccgaaacaaacaaccccugcgccaaaaccaucguaaaacucuucgaaauccaaaaaaccggcuucaacauacaggacauggacauaguagccagcgaacaccuccuccaccaaagccuagucggaaaacaaucaccauuccaaaacgccuacaacgugaaaggcaacgccaccucggcaaacauaauauga

SEQ ID NO: 8112 - RNA, 1449 nt, Artificial Sequence
  derived and/or modified CDS sequence (opt11) from CCHFV(UGANDA 3010)__U88416.1__N
auggaaaacaaaaucgaaguaaccagcaaagacgaaaugaaccgcugguucgaagaguucaagaaauccaacggccugguagacaccuucaccaacagcuacuccuucugcgaauccguccccaaccuagaccgauucgucuuccaaauggcguccgccaccgacgacgcacaaaaagacagcauauacgcaagcgcacucguugaagcaaccaaauucugcgcccccaucuacgaaugcgccuggguguccucaaccggaaucguaaagaaaggcuuagaaugguucgagaaaaacgccggcacaaucaaauccugggacgaaagcuacaccgaacugaaaguaggaguaccaaaaauugaacaacuagccaacuaccaacaagcagcccuaaaauggagaaaagacaucggcuuccgugucaacgccaacacagcugcccucuccaacaaaguccucgccgaauacaaaguacccggagaaauagucauguccgucaaagaaaugcugagcgacaugauccgccgucgaaaccucauccuaaaccgaggcggcgacgaaaacccacggggccccgucagccgggaacacguggaauggugccgcgaauuugucaaaggaaaauacauaauggccuucaacccaccauggggcgacauaaacaaauccggcagauccggcaucgcccucgucgccacaggccuagccaaacucgcggaaaccgaaggcaaaggcguauucgacgaagccaagaaaacggucgaagaccuaaacggcuaccuugacaaacacaaagacgaagucgacaaagcaagcgcugacggaauggucaccaaccuacucaaacacauagcaaaagcccaggaacuuuacaaaaacucauccgcccuccuccuacaaggagcccaaaucgacaccccguucagcagcuucuacuggcuauacaaagcaggcgugagcccagaaaccuucccaacaguuagccaauuccucuucgaacucggcaaacaacccagagggaccaagaaaaugaagaaagcacuccucagcaccccuaugaaauggggcaagaaacucuacgaacucuucgccgacgacuccuuccaagaaaaccgcauauacaugcaccccgcgguacucacagccgggcgcaucuccgaaaugggaguaugcuucgggacaauacccguagccaacccagacgacgccgcccaaggcagcggacacaccaaauccauacucaaccuaggcaccaacacagaaaccaacaacccuugcgccaaaacaaucgucaaacuauucgaaauccagaaaaccggauucaacauccaagacauggacaucgucgcaucagaacaccuacuacaccaaucccucguaggaaaacaaucccccuuccaaaacgcauacaacguaaaaggcaacgccaccucagccaacauaauauaa

SEQ ID NO: 8113 - RNA, 1449 nt, Artificial Sequence
  derived and/or modified CDS sequence (opt11) from CCHFV(UK ex Bulgaria)__KM201260.1__N
auggaaaacaaaaucgaaguaaacagcaaagacgagaugaacaaaugguucgaagaauuuaagaaaggaaacggacugauggacaccuucacaaacuccuacagcuucugcgaaaauguccccaaccucgacaaauucgucuuccaaauggccagcgcaacagacgacgcccaaaaagacucaaucuacgccucagcacucgucgaagccacacgcuucugcgcccccauuuacgaaugcgcguggguaagcagcaccgggaucgugaagaaaggccuggaaugguucgagaaaaacucuggcaccauaaaaagcugggacgaaaacuacgccgaacucaaaguagacguacccaaaauagaacaacuagccaacuaccaacaagccgcccucaaauggcgcaaagacauaggauucagagucaacgccaacacagcugcccucuccaacaaaguccuagccgaauacaaagucccaggcgaaaucgucaugagcgucaaagaaaugcuauccgacaugaucagacgacgcaaccuaauccucaacaggggcggcgacgaaaacccccgcgggcccguaagcagagaacacgucgaauggugccgagaguucgucaaaggcaaauacauaauggccuucaacccaccauggggcgacaucaacaaauccggcagaagcggcauagcccuggucgcaaccggccuagccaaacuggccgaaaccgaaggcaaaggagucuucgacgaagcaaagaagacggucgaagcacugaacggcuaccuagacaaacaccgcgacgaagucgacaaagcauccgcggacuccaugaucaccaaccuacuaaaacacauagcaaaagcacaagaacucuacaaaaauagcucagcacuccgagcccaaggcgcccaaaucgacacaccauucuccuccuucuacuggcucuacaaagcuggagucaccccagaaaccuucccaaccaucucccaauuccuguucgaacucggaaaacaaccgagaggcaccaagaaaaugaagaaagcacuacuguccacccccaugaaauggggaaagaaacuauacgaacuauucgccgacgacucguuccaacaaaaccggauauacaugcacccggccguccucacagcuggccgaaucuccgagaugggagucugcuucggaaccauccccguagccaaccccgacgacgccgcccagggaucgggacacaccaaauccauccucaaccuaagaaccuccaccgagaccaacaaccccugcgccaaaacaaucguaaaacucuucgaaauccagaaaacaggauucaacauccaagacauggacauagucgcaagcgagcaccuacugcaccaaucccuagucggcaaacaauccccauuccaaaaugccuacaacgucaaaggcaacgcaaccagcgcgaacaucauauaa

SEQ ID NO: 8114 - RNA, 1449 nt, Artificial Sequence
  derived and/or modified CDS sequence (opt11) from CCHFV(Yozgat19-2012)__KR092375.1__N
auggaaaacaaaauagaaguaaacuccaaggacgaaaugaacaaaugguucgaggaguucaagaaagggaacggccucauggacaccuucaccaacagcuacagcuucugcgaaaacgucccaaaccucgacaaauucgucuuccaaauggcgucagccaccgacgacgcacaaaaagacagcauauacgcaagcgcgcucguagaagccaccaaauuuugcgcccccaucuacgaaugcgccugggucuccaguaccggcaucgucaagaaagggcuggagugguucgagaaaaacuccggcacaaucaaauccugggacgaaaacuacgcagaacuaaaaguagaugugcccaaaaucgaacaacucgcaaacuaccaacaagcagcccugaaauggcgaaaagacaucggcuucagaguaaacgccaacaccgccgcgcucucaaacaaaguccuugccgaauacaaaguccccggagaaaucgucaugagcguaaaagaaaugcuuagcgacaugaucagacgccgcaaccucauccugaaccgaagcggggacgaaaacccccgaggcccaguaucacgcgaacacgucgaauggugccgugaguucgucaaaggaaaauacaucauggccuucaacccacccuggggagacauaaacaaaagcggccgcuccggcaucgcccucgucgccacgggccuagccaaacucgccgaaaccgaaggcaaagguguauucgacgaggcaaagaaaacagucgaagcacuaaacggcuaccuugacaaacaccgcgacgaaguagacaaagccagcgccgacucaaugauaaccaaccuccuaaaacacaucgccaaagcacaagaacuauacaaaaacucaagcgcccuacgcgcccaaggcgcccaaaucgacacccccuucagcucuuucuacuggcucuacaaagccggcgucacccccgaaaccuuucccaccaucucccaauuccucuucgaacucggaaaacaaccacgcggcaccaagaaaaugaagaaagcccuccucuccacccccaugaaauggggcaagaaacuauacgaacucuucgccgacgacucauuccaacaaaaucgaaucuacaugcaccccgccgugcuaacagccggccgcauaucagagaugggaguaugcuucggcacaaucccagucgccaacccagacgacgcagcacaagguucuggccacacgaaaagcauacuaaaccuacgcacauccacagaaaccaacaauccaugcgccaaaacaauagucaaacucuucgaaauccagaaaaccggauucaacauccaagacauggacaucguagccagcgaacaccuacuucaccaaucccucguaggaaaacaaagccccuuucaaaacgccuaccacgugaaaggcaacgcgacaucagcaaacaucaucuaa

SEQ ID NO: 8115 - RNA, 1449 nt, Artificial Sequence
  derived and/or modified CDS sequence (opt11) from CCHFV(Yozgat207-2011)__KR092377.1__N
auggaaaacaaaaucgaagucaacucaaaagacgaaaugaacaaaugguucgaagaguucaaaaaaggcaacggccuaauggacacguucaccaacuccuacagcuucugcgaaaacguaccaaaccuggacaaauucguauuccaaauggccagcgccaccgacgacgcccagaaagacuccauauacgccucagcccucguagaagcgaccaaauucugcgcccccauauacgaaugcgccugggucuccagcacagggauaguaaaaaaaggccucgaaugguucgaaaaaaacuccggcacaaucaaaucaugggacgagaacuacgccgaacucaaagucgacguaccaaaaaucgaacaacuggccaacuaccagcaagccgcccucaaauggcgcaaagacauaggauuccgcguaaacgcaaacacagccgcacucagcaacaaaguccucgcagaauacaaaguccccggcgaaauaguaaugagcgucaaagaaaugcuauccgacaugaucaggcgccgaaaccucauccuaaaccggggcggagacgaaaacccacgcggccccgucagccgcgaacacgucgaauggugccgugaauucgucaaaggaaaauacaucauggccuucaacccccccuggggagacaucaacaaauccggccgaagcggcaucgcccucguagccacaggacuagccaaacuagcagaaacggaagggaaaggcgucuucgacgaagccaaaaaaaccgucgaggcacuuaacggguaccucgacaaacaccgcgacgaagucgacaaagccucugccgacuccaugauaaccaaccuacuuaaacacaucgccaaagcgcaagagcuauacaaaaacagcucagcccuacgcgcacaaggcgcccagaucgacacccccuucaguuccuucuacuggcuguacaaagcgggcgucaccccagaaaccuuccccacaauaucacaguuccuguucgaacucggcaaacaaccccgagguaccaaaaaaaugaaaaaagcccuccuaagcaccccuaugaaauggggaaagaaacuauacgaacuauucgcagacgacucauuccaacaaaaccgaaucuacaugcacccggccguccucacagcaggacgcaucagcgaaaugggcgucugcuucggcaccauccccguugccaacccggacgacgccgcccaaggcucaggccauaccaaauccauccuaaaucuucgcaccucgaccgagaccaacaacccaugcgcaaagaccaucguuaaacucuucgaaauccaagaaaccggcuucaacauccaagacauggacauagucgccuccgaacaccuccuacaccagagccucguuggaaaacaaucccccuuccagaacgccuacaacguaaaaggcaacgccaccuccgccaacauaauauaa

SEQ ID NO: 8116 - RNA, 1452 nt, Artificial Sequence
  derived and/or modified CDS sequence (opt11) from DUGV(ArD44313)__AF434161.1__N
auggaaaaccaaaucaaagccaacaacaaaaaagaauucgacgaaugguucaaaccauucuccgaaaaacugcaauuaagaucuaaucucaccaacucagccagccuaugcgaccgcguacccgaccucgcccucgcagaaaugaaaauggcccucgcaacagacgacaaagaaaaagacuccauauucuccaacgcccucguggaagcaacccgcuucugcgcccccaucuacgaaugcgccuggacuuguagcaccggagucguccaaaaaucccucuccugguucgacaaaaauaaagacuucaucaaacuaugggacgccaaauacauggaccucaaaaaaggcaucccggaaccagaacagcucgucagcuaccaacaagcagcccaaaaauggcgcaaggacgucggauacgaaaucaaccaauucacacgcucccuaacccaccccgucguggccgaauacaaaguacccggcgaaaucgcuguagacguaaaagagaugcuauccgacaugauccgcagacgcaacguccuccucaacggugacggugagaacgcaggcaaaaaaggccccauaucccgcgaacacgucucguggggccgagaacucgcaggcggcaaauuccaagucgucuucaacccgcccuggggagacaucaacaaaugcggcaaaucagggaucccgcucgccgccaccgcaaugguaaaaguagcagaacucgacggcagcaaaaaacuagaagacauccgccaagcccuccuagaccuaaaaaaaugggucgaagacaacaaggacgcccuagaagacgggaaaggaaacgaacucguccaaaccaugaccaaacaccucgcacaagccguagaacucagcaaaaaaagcaacgcacuccgcgcccaaggggcccaaauagauacccccuucucagccuacuacugggccuggagcgccggcguaaaaccagaaacauucuucacccucucccaauuccuguucgaaaugggccaaucagcacgaggaggaaaaaaaaugaucaaagcccucaccucaaccccccuccgcuggggcaaaggccucaucaaccucuucgccgacgacgacuuccuaggcaaccgccucuacaugcacccagccguccuaacuccagggcgaauguccgaaaugggagcaugcuucggcgucauaccaguagccucacccgaagacgcaauacuaggcucaggccacucaaaaaacauccuaaacuucaagaucgacaccucaguacagaacccaugcgcgucaaccauaguccaacucuaccgaauacaaaaauccggcuucgaccuggaaucccucgagguaguuagcacagaacaccuccuccaccaaagcuucguaggaaaaagaugccccacccaaaacgccuacaaaguccgaggaaacgcaaccaacgugaacauaaucuaa

SEQ ID NO: 8117 - RNA, 1452 nt, Artificial Sequence
  derived and/or modified CDS sequence (opt11) from DUGV(ArD16095)__AF434162.1__N
auggaaaaccaaaucaaagccaacaacaagaaagaguucgacgaaugguucaaacccuucagcgagaaacuucagcucaggagcaaccucacaaacagcgcaagccucugcgaccgcguacccgaccucgcacuggccgaaaugaaaauggcccuagccaccgacgacaaagaaaaagacagcauauucagcaaugcacucguagaagcaacacgcuucugcgccccaauauacgaaugcgcauggaccugcucaaccggcgucguccagaaaucccugagcugguuugacaagaacaaagauuucaucaaacucugggacucaaaauacauggaccuccgaaaaggaauccccgaacccgaacaacucgucucauaccaacaagccgcccaaaaauggcgaaaagacgucggcuacgaaaucaaucaauucaccagaucccugacacaccccguagucgccgaguacaaagucccaggagaaaucgcagucgacgugaaagaaaugcucagcgacaugauccgacgccguaacguccuccuaaacggagacggagaaaacgcgggaaagaaaggcccaaucagccgagaacacgucucauggggacgcgaauuagccggaggcaaauuccaagugguauucaacccacccuggggcgacaucaacaaaugcggaaaauccggcaucccccucgccgccacagcaauggucaaagucgccgaacucgacggcucaaagaaacuagaagacauccgacaagcccuucucgaccucaagaaauggguggaagacaacaaagacgcacucgaagacggcaaaggcaacgagcuagugcaaaccaugaccaaacaccuagcacaagcaguggaacuguccaagaaauccaacgcgcuacgcgcacaaggggcccaaaucgacacacccuucagcgcguacuauugggccugguccgccggggucaaacccgaaaccuucuucacacucucccaauuccucuucgaaaugggacaaagcgcccgcggaggaaagaaaaugaucaaagcccucacauccacaccccuccgauggggcaaaggccucaucaaccuguucgccgacgacgacuucagcggcaaucgccuauacaugcaccccgccguccucacccccggacgaaugucagaaaugggcgcaugcuucggcgucauccccguagccagcccggaagacgcaauucuaggcucaggccacagcaaaaacauacugaacuucaaaaucgacaccagcguacagaacccaugcgccagcaccaucguccaacucuaccgcauccaaaaaucgggauucgaccuagaaagccucgaaguagucagcaccgaacaucuacuccaccagagcuuugucggaaaacguugccccacacaaaacgccuacaaagucagaggaaacgccaccaacguaaacauaaucuga

SEQ ID NO: 8118 - RNA, 1452 nt, Artificial Sequence
  derived and/or modified CDS sequence (opt11) from DUGV(IbH11480)__AF434163.1__N
auggaaaaccaaaucaaagcgaacaacaaaaaagaauucgacgaaugguucaaaccguucuccgaaaaacuccaacuccguucaaaccucaccaacagcgccagccugugcgacagagucccggaccucgcccuggcagaaaugaaaauggcccucgcgacagacgacaaagaaaaagacuccaucuucuccaacgcgcuggucgaagccacaagauucugcgccccaaucuacgaaugcgccuggaccugcagcaccggcgucguacagaaaucccucuccugguucgacaaaaacaaagacuucauaaaacuaugggacgcgaaauacauggaccuccgcaaaggcauccccgaacccgaacaacuagugagcuaccaacaagccgcccaaaaauggcgcaaagacguaggcuacgaaaucaaucaguucacccgaagccucacccaccccgucgucgcggaauacaaaguaccaggcgaaaucgcagucgacgucaaagaaaugcucagcgacaugauccgccgccgcaacguccugcucaauggggacggcgagaacgcagggaagaagggcccaaucucccgcgagcacguaucguggggccgcgaacucgcgggcggcaaguuccaagucgucuucaaccccccauggggcgacaucaacaaaugcggcaaaucaggaaucccacucgcagccacugccauggucaaagucgcggaacucgacggcuccaaaaaacuagaagacauacgccaagcccuacuagaccucaaaaaauggguagaagacaacaaagacgcacuagaggacggcaaaggcaacgaacucgugcaaaccaugacaaaacaccuagcccaagccgucgaacuaucaaaaaaaagcaacgcccuaagagcccaaggagcacaaaucgacaccccauucucagcauucuacugggcuuggucagcaggagucaaacccgaaaccuucuucacacugucccaauuccucuucgaaaugggccaaucugcccgcggcggcaaaaaaaugaucaaagcacucacaagcacuccacugcgguggggcaaaggccuuaucaaccuauucgccgacgacgauuuccuaggcaacagacucuacaugcaccccgccguacuaacucccggcagaaugagcgaaaugggagcaugcuucggcgucauacccguagcaucacccgaagacgcaauccuaggcuccggacacagcaaaaacauccucaacuucaaaaucgacaccucaguacaaaacccaugcgcaagcaccauaguccaacuguacagaauccaaaaaucaggcuucgaccucgaaucauuagaaguugucagcaccgaacaccuccuacaccaaagcuucgugggaaaaagaugcccgacacaaaacgccuacaaaguccgcggcaacgcaaccaacguaaacauaaucuga

SEQ ID NO: 8119 - RNA, 1452 nt, Artificial Sequence
  derived and/or modified CDS sequence (opt11) from DUGV(IbAr1792)__AF434164.1__N
auggaaaaccaaaucaaagcaaacaacaaaaaagaauucgaugaaugguucaaacccuucucagaaaaacuacaacuacgcagcaaccuaaccaacucagcaucccuaugcgaccgcguccccgaccucgcgcuagccgagaugaagauggcccuagccaccgacgacaaagaaaaagacagcaucuucuccaacgcucucgucgaagccacccgauucugcgcgcccaucuacgaaugcgccuggacaugcuccacgggcgucguccaaaaaucccucucaugguucgacaaaaacaaagacuucauaaaacucugggacgcaaaauacauggaccuacgcaaaggcauacccgaaccagaacaacucguauccuaccaacaagcagcccaaaaguggcgcaaagacgucggcuacgaaauaaaccaauucacccgaucacuaacccaccccguaguggccgaauacaaagugcccggagaaauagccgucgacgucaaagaaaugcucagugacaugauccgacgacgcaacguccuccuaaauggagacggcgagaacgccggaaaaaaaggacccauaagcagagaacacguauccuggggccgagaauuagccggcggaaaauuccaagucguauucaacccccccuggggagauaucaacaaaugcggaaaauccggcaucccacuagccgcaacagccaugguaaaagucgcagagcuugacggaagcaaaaaacuggaagacauccgccaagcccuucucgaccuuaaaaaaugggucgaagacaacaaagacgcgcucgaagacggcaagggaaacgaacucguacaaaccaugaccaaacaccucgcccaggcugucgaacucagcaaaaaguccaacgcccuccgcgcucaaggcgcacaaauagacacccccuucuccgccuacuacugggccuggucagcaggcguaaaaccagaaaccuucuucacccucucccaauuccucuucgaaaugggccaguccgccagaggagggaaaaaaaugaucaaagcccugacaagcacaccccuccgcuggggaaaaggacucaucaaccucuucgcagacgacgacuucuuagguaacaggcucuacaugcaccccgccguacucacacccggcagaauguccgaaaugggggccugcuucggagucauacccguagccagcccagaagacgcaauccuaggaucgggacacucaaaaaacauccugaacuucaaaaucgacaccagcguccaaaaccccugcgcguccaccaucguacaacucuaccgcauacagaaauccggauucgaccuagaaagccucgaggucguaagcaccgaacaccuacuccaccaauccuucgugggcaaacggugcccaacccagaacgccuacaaaguccgcggaaacgcgaccaacguaaacauaaucuag

SEQ ID NO: 8120 - RNA, 1452 nt, Artificial Sequence
  derived and/or modified CDS sequence (opt11) from DUGV(KT281/75)__AF434165.1__N
auggaaaaccaaaucaaagccaacaccaagaaagaguucgacgaaugguucaaacccuucagcgacaaacuucaacuccgcagcacccucacgaacucagccucacucugcgaccgaguuccagaccuggcccuggccgaaaugaaaauggcccucgcuaccgaugacaaagaaaaagacuccaucuucuccaacgcccuagucgaagcaacacgauucugcgccccaaucuacgaaugcgcguggacuugcuccacgggcgucguccagaaaagccugucaugguucgacaagaacaaagauuucaucaaacucugggacgcaaaauacauggaccuacgcaaaggaauccccgaacccgaacaauuagucuccuaccaacaagccgcccaaaaauggcgaaaagacaucggguacgaaaucaaccaauucacccgcucccucacccaccccgucguggccgaauacaagguacccggcgaaauagcagucgacgugaaagaaaugcuguccgacaugauccgccgccgcaacguccuccuaaacggcgacggcgaaaacgccggcaagaaaggcccaaucucccgcgaacacguauccuggggccgcgaacuagcaggcggcaaauuccaggucgucuucaaucccccauggggagacaucaacaaaugcggcaaaagcggcaucccccucgccgcgaccgccauggucaaagucgccgaacuugacggcuccaagaaacucgaagacauccgacaagcucuccucgaccucaagaaauggauagaagauaacaaagacgcccucgaagacggaaaagguaacgaacucauccaaaccaugacaaaacaccuagcacaagccguagaacuuucaaagaaauccaacgcccuccgagcacaaggcgcccaaauagacacacccuucucagccuucuacugggcauggagcgccggaguaaaacccgagacauuuuucacccucucacaauuccuauucgaaaugggccaaucagcccgcggcggaaagaaaaugauaaaagcgcuaaccagcaccccacuccgguggggcaaagggcuaauaaaccucuucgccgacgacgacuucuccggcaacagacuauacaugcaccccgcaguccucaccccagggcgcauguccgaaaugggagccugcuucggcgucaucccagucgccucaccagaagacgcaauccuaggaagcggccacagcaaaaacauccucaacuucaaaauagacacaucaguccaaaaccccugcgccucaaccaucguccaacuauaccgaauacaaaaauccggcuucgaccuagaaucccucgaagucgucuccaccgaacaccuccuacaccaauccuucgucggcaaacgcugcccaacccaaaacgccuacaaaguccgcggcaacgccacaaacgucaacauaauauaa

SEQ ID NO: 8121 - RNA, 1452 nt, Artificial Sequence
  derived and/or modified CDS sequence (opt11) from DUGV(NJT130)__FJ422213.2__N
auggaaaaccaaaucaaagcuaacaacaaaaaagaauucgacgaaugguucaagcccuucuccgacaaacuacaacuaagauccacgcucaccaacucagccucccuaugcgacaaaguccccgaccuggcacuagccgaaaugaaaauggcccuagccaccgacgacaaagagaaagacuccaucuucuccaacgcccuagucgaagcuaccagauucugcgcacccaucuacgaaugcgccuggacuugcagcaccggcgucguccaaaaaucccuaucaugguucgacaaaaacaaagacuucauaaaacuaugggacgccaaauacauggaccuccgaaaaggcauacccgaaccagaacaacuagucagcuaccaacaagccgcccaaaaauggcgcaaagacaucggauacgaaauaaaccaauucaccagaucccucacccaccccguaguugccgaauacaaaguccccggcgaaauagccgucgacgugaaagaaaugcucucggacaugauccgacgacguaacguacuucuaaacggagacggcgagaacgccggcaaaaaaggccccauaucccgagaacacgucagcuggggccgcgaacucgccgaaggcaaauuccaaguagucuuuaacccacccuggggcgauaucaacaaaugcggcaagucaggaauaccccucgcagccaccgcaauggucaaagucgccgaacuggauggcuccaaaaaacuagaagacauccgccaagcgcugcucgaccucaagaaaugggucgaagacaacaaagacgcccucgaagacggcaaaggcaacgaacuuauccaaacaaugacaaaacaccuagcccaagccgucgaacucagcaaaaaauccaacgcccuccgagcacaaggcgcccaaaucgacacacccuucucagccuucuacugggcauggucagccggcgucaaacccgaaaccuucuucacccucucccaauuccuauucgaaaugggacaaagcgcccgaggcggcaagaaaaugaucaaagcccugacauccaccccccuacgcugggggaaaggccucauaaaccuauucgccgacgacgacuucagcgggaaccgccuuuacaugcaccccgccguccuaaccccaggccgaaugucggaaaugggcgcgugcuucggcgucauccccgucgccagccccgaagacgccauucucggauccggccacucaaaaaacauccuaaacuucaaaauagacaccagcguccaaaaucccugcgccuccaccaucguccaacucuaccgcauccaaaaauccggcuucgaccuagaaagccuagaagucguaucuacagaacaccuacuccaucaaucauucguaggcaaacgaugcccaacacagaacgcauacaaaguucgcgggaacgcaaccaacgucaauauaaucuaa

SEQ ID NO: 8122 - RNA, 1452 nt, Artificial Sequence
  derived and/or modified CDS sequence (opt11) from DUGV(IbAr1792)__KU925457.1__N
auggaaaaccaaaucaaagccaacaacaaaaaagaauucgacgaaugguucaaaccauucuccgaaaagcuacaacuacgaagcaaccuaaccaacucugccagccucugcgaccgcguccccgaccuagcccucgccgaaaugaaaauggcccucgccaccgaugacaaagaaaaagacuccaucuucucaaacgccuuagucgaggcuacacguuucugcgcccccauauacgaaugcgcguggacaugcuccaccggcgucguccaaaaaagccugaguugguucgacaaaaacaaagacuucaucaaacuaugggacgccaaauacauggacuuacgaaaagguauccccgagcccgagcaacucguaucauaccaacaagcagcccaaaaauggcgcaaagacgucggcuacgaaauaaaccaguucacccgcagccucacccaccccgucguagcagaauacaaaguccccggcgaaaucgcggucgacgucaaagaaaugcucagcgacaugauccgccgacgaaacguccuccucaacggagacggagaaaacgcaggcaaaaaaggcccuaucucgcgagaacacgucuccuggggacgcgaacucgcaggaggcaaguuccaagucguuuucaaccccccguggggagacauaaacaaaugcggaaaaucaggcauaccccucgccgccaccgcaauggucaaagucgccgaacuagacggauccaaaaaacuagaagacauccgacaagcacuccucgacuuaaaaaaaugggucgaagacaacaaagacgcccucgaagacggaaaaggcaacgaacuaguacaaaccaugaccaaacaccucgcccaagccgucgagcucucaaaaaaauccaacgcccuccgcgcacaaggagcccaaauagacacccccuucuccgcauucuacugggccugguccgcaggagucaaacccgaaaccuucuucacccuaucccaauuccucuucgaaaugggacaaaacgcccgaggcggcaaaaaaaugauaaaggcacuaaccuccacgccccuaagauggggcaagggccucaucaaccuauucgccgacgacgacuuccucggaaaccgccucuacaugcaccccgcgguccucacacccggccgcaugucagaaaugggcgccugcuucggcguaaucccgguggccagccccgaagacgccauccucggaaguggucacagcaaaaacauacuuaacuucaaaaucgacaccagcguccagaaucccugcgccagcaccauaguacaacuauaccgcauacaaaaauccggcuucgaccucgaaucccucgagguagucagcacagaacaccuccuccaccaaucguucguaggcaaacgaugccccacccaaaacgccuacaaaguccgcggcaacgccaccaacguaaacauuauauga

SEQ ID NO: 8123 - RNA, 1449 nt, Artificial Sequence
  derived and/or modified CDS sequence (opt11) from NSDV(Jilin)__NC_034386.1__N
augcaaaaccaaauagucgcagacaauaaagacgccauacucgcguggcacaaaaccuacucagagaagcacagacucaaaagcguacucacaaacucagcgucguucugcgaaacgauccccgaccuuagcggauacgaaguaagcaugcgacuggucagcucagaaagcgaaaaagacagcguauacgccucggcccugguagcggccacgaaauucugcgcgcccauacucgaaugcgcauggacaagcugcaccggaaugguggaaaggggccuagacugguucgagaacaacaaagagacaguaaaaauaugggaugccgaauacgggaaacuccgaacggaagcgcccucgcccgaacaacuacucggauaccaacgcgccgcacugaaauggcgcaaagacaccaaauacggcauaaacagaaacacggccgcgcuagcagccgcaaucgcgaccgaguaccgagucccaggcuccaucguagucaacguaaaagacaugcucucagacaugauccgacgccgcaacaaaauccucaacagagacgggagcgaagacguacccaaacgaggacccguaagcaaagaacacaucgacugggcacgcgaccucgcacaagggaaauuccucguagucuucaacccacccuggggcgacauaaauaaagcgggcaaaagcgggaucgcacuagcggcaacaggcauggccaaacucaucgaacucgacgggcccaaaaucgcagaagaccuccgagaaucacuaaaaggccuagucgccuggaucaacgcgcacaaagacgaagucgaaaacggaaaagaagucguggacggacucacaaaacaccuccaaaaagcacuagaacucgcaaaacaaagcuccgccaugagagcacaaggagcacaaauagacaccguguucucaagcuacuacuggcucuggaaagcgggaguaaccgccgaaauguucccaaccgugagccaguuccuauucgaacucggaaaagugcccagaggcaacaaaaaaaugaaaaaagcgcucucaagcaugccacugaaauggggaaaaaaacuacucgcacucuuugcggaugacucauucacagccaaucgcauauacaugcaccccggaguacucacagcagggcgcaugagcgagcucggagucugcuucggggcaauucccguagcaaacccagacgacgcggccgaagguuccggacacauaaaaaacauacuagcacaaacaaccgacacccaggccgggaacccuugcgcccaaaacauagucgcccuauucaacauccaaaaagcgggcuucgacauagaaucaauggacaucguagcccuagaacaccuccuacaccaaagccuagucggcaaaagaagcccguuccagaacgcguacaacauccgcggcaacgcaaccagcauacaaaucaucuag

SEQ ID NO: 8124 - RNA, 1449 nt, Artificial Sequence
  derived and/or modified CDS sequence (opt11) from NSDV(62873)__HQ286609.1__N
augcaaaaccaaauagucgcagacaacaaagacgccauacuugccuggcacaaaaccuacucggaaaaacacaaacucaaaagcguacucacaaacucagcaucauucugcgaaacuaucccagaccugagcggauacgaaguaucaaugcgacucguguccuccgaaucagaaaaagacucaguauacgccucagcucuagucgcagccacaaaauucugcgcucccauccuugaaugcgcguggacgagcugcacagggaugauacaaagaggccuggacugguucgagaacaacggagagaugguaaaaauaugggacgccgacuauggaaaacuacgaacggaaauacccucacccgaacaacugcucggguaccagcgcgccgcccuaaaauggcgaaaagacacaaaauacggcaucaacaaaaacacugccgcacuagcagcagcgaucgcaaccgaguaccgcgucccaggcuccaucguagucaacgucaaagacaugcucucggacaugauaagacgccgaaacaaaauccucaacagggacgggagugaggacguacccaagcgcgggcccgugagcaaagaacacaucgacugggcgcgcgaccucgcacagggaaaauuucuaguaguauucaacccaccauggggcgacaucaacaaagccggcaagagcggaaucgcacucgcagccacgggaauggccaaacuaaucgaacuagacggacccaaagucgcggaagaccucaaagagucccucaaaagccuagucgcauggaucaacgcgcacaaagacgaagucgaaaacgggaaagaggucguagacggacucacgaaacaccuccaaaaagcacuugagcucgcaaaacaaagcuccgcaaugcgcgcacaaggagcccagaucgacaccguauucucaagcuacuacuggcucuggaaggcaggaguaaccgcggaaauguucccaaccguaucccaguuccucuucgaacucggaaaaguacccaggggcaacaagaaaaugaagaaagcccuauccagcaugccccuaaaauggggaaagaaacugcucgcacuauucgccgaugacucguucaccgccaaccgcauauacaugcacccgggcguacuaacagccggacgcaugagcgaacucggagucugcuuuggggccauccccguagcaaaucccgacgacgcggccgaaggaucgggccacaucaaaaacauccucaauuacaaaacagacacccaagccggaaauccgugcgcgcaaaacauaguagcccuauucaacauccagaaagcgggcuucgauaucgagucaauggacaucguagccucagaacaccuccugcaccagagccuggucggaaaacggagcccauuucaaaacgcauacaacauccgaggcaacgccacaagcauacaaauaaucuag

SEQ ID NO: 8125 - RNA, 1449 nt, Artificial Sequence
  derived and/or modified CDS sequence (opt11) from NSDV(779)__HQ286602.1__N
augcaaaaucaaauagucgcagacaacaaagacgcaauacucgcguggcacaaaacauacucagaaaaacacaaacucaaaagcgugcucacgaacucagccucauucugcgaaacgauccccgaccucuccggauacgaagucucaaugcgccuaguuagcuccgaaucggaaaaagacucagucuacgccucagcccucgucgcagccaccaaauucugcgcccccauacucgagugcgcauggacgagcugcaccggaaugauccaaagaggccucgacugguucgacaacaacggcgaaauggucaaaaucugggacgcggacuacggcaaacuccgaacggaaguacccucaccagaacaacugcuaggauaccaacgcgcagcacugaaauggagaaaagacacaaaauacggaauaaacaaaaacacggccgcgcuagcagcagcaaucgcaaccgaauaccgcguccccggaucaauaguagucaacgucaaagacaugcucucggacaugauaaggagacgcaacaaaauccuaaaccgagacggcagcgaagacgucccaaaacgcggccccgucagcaaagaacacaucgacugggcccgagaccuagcccaaggcaaauuucuagucgucuucaauccacccuggggagacaucaacaaagccggcaaaagcggcauagcacuagccgcaacaggcauggccaaacucauagaacuggacgggcccaaggucgcagaagaucuaaaagaaucacuaaaaagccuagucgcauggauaaacgcacacaaggacgaaguagagaacggaaaagaggucgucgacggucuaaccaaacaccuccaaaaagcacucgaacucgcaaaacagucauccgccaugcgcgcccaaggugcccagaucgauaccguauucucgagcuacuacuggcuguggaaggccggagucaccgcagaaauguucccaaccgucagccaguuccucuucgaacucggaaaaguaccacgaggcaacaagaaaaugaagaaagcacucucaagcaugccccugaaauggggaaagaaacuacuugcacucuucgccgacgauuccuucaccgccaaccgcauauacaugcauccaggaguacucacggccggacgcaugagcgaacuaggggucugcuucggagccauaccaguggccaaccccgacgacgcagccgaaggcucgggccacaucaaaaacauacucaacuacaaaaccgauacccaagccggaaaccccugcgcccaaaacaucguagcccuguucaacauacagaaagccggcuucgacauugaaucaauggacauaguagccucagaacaccuacugcaccaaagccucgucggaaaacgcagcccauuccagaacgccuacaacauccgcggcaacgcaacaucaauacagaucaucuaa

SEQ ID NO: 8126 - RNA, 1449 nt, Artificial Sequence
  derived and/or modified CDS sequence (opt11) from NSDV(6233)__HQ286603.1__N
augcaaaaccaaauaguugcagacaacaaagaugccauacucgcauggcacaaaaccuacucggaaaaacacaaacuaaagagcguccucacgaacucagccucauucugcgaaacuaucccggaccuaucaggguacgagguauccaugagacucguauccucggaaucagaaaaagacucgguauaugccuccgcccuagucgcggcaacaaaauucugcgcccccauacucgaaugcgcguggacgagcugcaccggaaugauucaaagaggccuggacugguucgacaacaacggcgaaaugguaaaaauaugggacgccgacuacgggaaauuacgcaccgaagugcccucccccgagcaacuacucggauaccaacgcgcagcucuaaaauggcgaaaagacacgaaauacggaauaaacaaaaacacagccgcacuugcagccgcaauagcgaccgaauaccgcgucccgggcuccaucguaguaaacgucaaagacaugcucuccgacaugaucagaagaaggaauaagauccucaacagggacggaagcgaagacguacccaaacguggccccguaagcaaggaacacauagacugggcacgagaccucgcacaagggaaauuccucguagucuucaacccgcccuggggcgacaucaacaaagcgggaaaaagugggaucgcacucgcagcaacgggcauggccaaacuaauagaauuagacgggcccaaggucgccgaagaccucaaggaaucccucaaaucccuggucgccuggaucaacgcacacaaagacgaggucgagaacggcaaagacgucguagacgggcugacaaaacaccuccaaaaagcacucgaacucgccaaacaaagcuccgccaugcgagcacaaggcgcccaaaucgauaccgucuuuuccagcuacuacuggcucuggaaagcaggcgucaccgccgaaauguuccccaccguuucccaauuccuuuucgaacucggcaaagugccccggggcaacaagaagaugaagaaagcacucagcagcaugccacuaaaauggggcaagaaacuacuugcgcuauucgccgacgacucauucacggccaaccgcauauacaugcacccgggcgugcucacggccggaagaaugagcgaacucggggucuguuucggggcaauccccgucgcaaaccccgacgacgcggcagagggcuccggacacaucaaaaacauacuaaacuacaaaaccgacacccaagccggcaacccaugcgcgcaaaacaucgucgcgcuauucaacauccagaaagcgggcuucgacauagaaucuauggacaucguagcaucagaacaccuacuacaccaaagucuggucgggaaaaggagcccauuccagaacgcauacaacauccgaggcaacgccacaagcauacaaaucaucuag

SEQ ID NO: 8127 - RNA, 1449 nt, Artificial Sequence
  derived and/or modified CDS sequence (opt11) from NSDV(40350)__HQ286608.1__N
augcaaaaccaaaucgucgcggacucgaaagacgccauacuagcguggcacaaaacauacucugaaaaacacaaacuaaaguccguacucacaaacucggcaucauucugugaaacgaucccagaccuaagcggguacgaggucucaaugaggcuggucagcucagacuccgaaaaggacucgguauacgcaucggcacuggucgcggccacgaaauucugcgcgcccauccucgaaugcgcguggacgagcugcacagggaugauacaaagaggccuggacugguucgagaacaacggcgagauggugaaaaucugggaugccgacuacgggaaacugcgcacagaagugcccucacccgagcaacuccuaggauaccaacgugcagcccuaaaauggcgaaaagacacgaaauacggcauaaacaagaacacggccgcccucgcggccgcgaucgcaacagaguacagagucccgggcucaaucguagucaacgucaaagacaugcuaagcgacaugauccgccgaagaaacaagauauuaaauagggacggcagcgaggacgugccaaaacgaggccccguaagcaaggaacacaucgacugggcacgcgaccuagcacaaggcaaauuccucguggucuucaacccgcccuggggcgacaucaacaaagcaggcaagagcggaauagcgcucgcggccacaggcauggccaaacucauagaacuggacggaccgaagaucgcagaagaccucaaggaaucacuuaaaagucugguagcguggauaaacgcgcacaaggacgaagucgaaaacgggaaagaagucguggacggucuaacgaaacaccuacagaaagcguuagaacucgcgaaacaaagcucagcaaugagagcgcaaggggcacaaauagacaccguguucucgagcuacuacuggcuauggaaagcgggagugacagcagaaauguucccaaccguaagccaguuccucuucgagcucggaaaaguaccccggggcaacaagaaaaugaagaaagcgcucucaagcaugccacucaaauggggcaagaaauugcuagcccucuucgccgacgacucguucacggccaacagaauauacaugcaccccggcgugcucacggcaggacgaaugagcgaacucggggucuguuuuggggccauaccaguagccaacccagaugacgcagccgagggaucgggccacaucaaaaacauacuaaacuacaaaacagacacccaggccggaaacccaugcgcgcaaaacaucguagcccuguucaacauacaaaaagcgggcuucgacauagaaucgauggacaucguagccucggaacaucugcuacaccagagccuaguagggaaaagaagcccguuccagaacgcguacaacaucagaggcaacgccacaaguauacaaauaaucuag

SEQ ID NO: 8128 - RNA, 1449 nt, Artificial Sequence
  derived and/or modified CDS sequence (opt11) from NSDV(616287)__HQ286605.1__N
augcaaaaccaaaucgucgcagacaacaaagacgccauacucgcauggcauaaaacauacagcgaaaaacacaaacucaaauccguacuaaccaacucagccagcuucugugaaacgaucccagaccuauccggcuacgaaguauccaugagacucguaagcuccgaaucagaaaaagacucaguauacgccucggcucugguagcagccaccaaauucugcgcgcccauccucgaaugcgccuggaccagcugcaccggaaugauucaaagaggccucgacugguucgacaacaacggcgaaaugguaaaaauaugggacgccgacuacgggaaacuacgcacagaaguacccucacccgaacaacuccucggauaccaaagggcagcccucaaauggcgcaaagacacgaaauacggaauaaacaagaacacggccgcacucgcggcagcaauugcgaccgaguacagagucccaggcagcaucgugguaaacguaaaagacaugcucagcgacaugauacggcgaagaaacaagauccucaacagggacggaagcgaagacguccccaaaaaggguccagugagcaaagagcacguagacugggcccgcgaccuagcgcaagggaaauuccucguggucuucaaucccccauggggcgacauaaacaaagcaggcaaaagcggaaucgcacucgcagccaccggaauggcaaaacucauagaacuggacggacccaaggucgccgaagaccucaaagaaucacuaaaaagccucguugcauggaucaacgcucacaaagacgaagucgaaaacggaaaagaaguuguggacgggcuaaccaaacaccuccaaaaagcauuagaacucgccaaacaaagcucagccaugcgcgcacaaggagcacaaaucgacaccguauucagcagcuacuacuggcuauggaaggccggcguaacagcagaaauguuccccacaguaagccaauuccuauucgaacucggaaaaguaccacggggaaacaagaaaaugaagaaagcacucucaaguaugccccuaaaauggggcaagaaacuacuagcccucuucgcggacgacuccuucacagcaaaccgaaucuacaugcacccagggguccucaccgccgggcgcaugagcgaacuaggaguaugcuucggagccauacccgucgccaaccccgacgacgccgcagagggcucaggacacaucaaaaacauccucaacuacaaaacagacacccaggcaggcaacccaugcgcgcaaaacaucguagcccucuucaacauccaaaaagcgggcuucgacauagaaucaauggacaucguggcaucagaacaccuccuccaccaaucccuagucggcaaacggucccccuuccagaacgcauacaacaucagaggaaacgccacauccauacaaaucaucuaa

SEQ ID NO: 8129 - RNA, 1449 nt, Artificial Sequence
  derived and/or modified CDS sequence (opt11) from NSDV(615526)__HQ286606.1__N
augcaaaaccaaauagucgccgacaacaaagacgccauacucgcguggcacaaagcauacuccgaaaagcacaaacuaaaaagcgugcucacgaacuccgccucauucugugaaacaaucccagaccugagcggguacgaagucucaaugcggcucguaagcucggaaucggaaaaagacuccguguaugccucagcccuagucgcagccacaaaguucugcgcgcccauacucgagugcgcauggacaagcugcaccggaaugauccaaagaggccucgacugguucgacagcaauggcgaaauggucaaaauaugggacgccgacuacgggaaacugcgcacggaaguaccaucgcccgaacaacugcucggguaccagcgagccgcccucaaauggcgaaaagacacgaaauacggcauaaacaagaacacagccgcacuagccgcagcgauagcgaccgaauacaggguuccaggcucgaucguaguaaacgucaaagacaugcucuccgacaugauaagacgaagaaacaagauccuaaaccgagacggaagcgaagacguacccaaagguggaccuguaagcaaagaacacaucgauugggcaagagaccucgcgcaagggaaauuccucgucgucuucaacccacccuggggcgacauaaacaaagcaggcaaaagcggcauagcacucgcagccaccggcauggcaaaacucauagaacuagacggccccaaaaucgcagaggaccucaaggaaucacucaaaagccucgucgcguggauaaaugcacacaaagacgaagucgagaacggaaaagaggucgucgacggacuaacaaaacaccuacaaaaagcacucgaacucgccaaacaaagcucagcaaugcgcgcacaaggagcacaaaucgacaccguauucucaagcuacuacuggcucuggaaagcgggcgugaccgcagaaauguucccgacaguaagccaguucuuauucgaacucgggaaagucccccgcggcaacaagaaaaugaagaaagcccucucaagcaugccccuaaaauggggaaagaaacugcucgcacucuucgccgacgacucuuucaccgccaaccgcaucuacaugcacccaggagugcucacggccggacgaaugagugagcucggaguaugcuucggagccauaccaguggcaaaccccgacgacgcagcagaaggaucaggccacaucaaaaacauccuaaacuacaaaaccgacacccaagcaggaaaccccugcgcgcaaaacaucguagcccuguucaacauccagaaagcaggcuucgacauagaaucaauggacaucguagcaucggaacaccuccugcaccaaagccuagucgggaaacggagccccuuccaaaacgcauacaacaucagaggcaacgccaccucaauacaaauaaucuaa

SEQ ID NO: 8130 - RNA, 1449 nt, Artificial Sequence
  derived and/or modified CDS sequence (opt11) from NSDV(708)__AF504293.1__N
augcaaaaccaaauaguagcagacaacaaagacgcaauacuugcguggcacaaagcguacucggaaaagcacaagcucaagagcguacucacaaacucggcaucguucugcgaagcgaucccagaccugagcggauacgagguaucgaugaggcuaguaagcucggacucggaaaaggacucaguauacgccucggcccuagucgcagccacaaaauucugcgcgcccauacuggaaugcgcguggacgagcugcaccggaauggucgaaaggggucuggacugguuugagaacaaccgcgaaauggugaaaauaugggacacggaauacggaaaacucagaacagaaguacccuccccagaacaacuacucggauaccagagagcggcccugaaauggagaaaggacacgaaauacggcaucaacaagaacacggccgcacucgcagccgcgaucgcaaccgaguacaaagucccgggaucgcuagucgucaacguaaaagacaugcuaucggacaugaucaggcgcagaaacaagauccugaaccgagacggcagcgaagacguacccaaacgagggcccguaagcaaggagcacaucgauugggcccgcgaccuagcccaagggaaauuccugguagucuucaacccgcccuggggcgauaucaauaaagcggguaaguccgggaucgcccuagcggccacaggcauggccaaacucauagagcuggacgggccaaagauagcagaagaccucaaggagucacuaaagagccuggucgcauggauaaacgcgcacaaggacgaggucgaaaacgggaaagaaguaguggacucgcucacaaaauaccuccaaaaagcgcucgagcucgcaaaacagagcagcgccaugcgcgcacaaggugcacagaucgacacagucuucagcagcuacuacuggcucuggaaagccggcguaacagcagaaauguucccgaccgugagccaguuccuauucgagcucgggaaaguaccccggggcaacaagaaaaugaagaaagcacucucaagcaugccccuaaaauggggcaagaaacugcucgcacucuuugccgacgauucauucacagccaaccgaauauacaugcacccaggcguacuaacggccggacgaaugagcgaacuaggcgucugcuucggugcaauaccaguagccaauccagacgacgcagccgacggcucaggacacaucaaaagcauacucaacuacaaaaccgacacgcaggccggcaacccaugcgcacaaaauaucguagcccucuucaacauccagaaagccggauucgacauagaaucgauggacaucguggcaucagaacaccuccugcaccaaagccuaguagggaaaagaucccccuuccagaacgccuacaacaucagaggcaacgccacgagcauacaaauaaucuaa

SEQ ID NO: 8131 - RNA, 702 nt, Artificial Sequence
  derived and/or modified CDS sequence (opt11) from BUNV__NC_001927.1__N
augaucgaacucgaauuccacgacgucgccgccaacaccuccuccaccuucgaccccgaagucgccuacgccaacuucaaacgcguccacaccaccggccucuccuacgaccacauccgcaucuucuacaucaaaggccgagaaaucaaaaccucacuagccaaacgcuccgaaugggaagucacccucaaccucggaggcuggaaaaucaccgucuacaacaccaacuuccccggcaaccgcaacaaccccguccccgacgacggccucacccuccaccgacuauccggcuuccucgcacgcuaccuccucgaaaaaaugcucaaagucuccgaacccgaaaaacucaucaucaaaagcaaaaucauaaacccccucgccgaaaaaaauggcaucaccuggaacgacggcgaagaagucuaccucuccuucuuccccggcuccgaaauguuccuaggcaccuuccgcuucuacccccucgccaucggcaucuacaaaguccaacgcaaagaaauggaacccaaauaccucgaaaaaaccaugcgacaacgcuacaugggccucgaagccgccacauggaccgucuccaaacucaccgaaguccaauccgcccucaccguagucuccucccucggcuggaaaaaaaccaacgucucagcagccgcccgagacuuccucgccaaauucggcaucaacauguaa

SEQ ID NO: 8132 - RNA, 702 nt, Artificial Sequence
  derived and/or modified CDS sequence (opt11) from BUNV(SFCrEq231)__KP063894.1__N
augaucgaacucgaauucaacgacgucgccgccaacaccuccucaaccuucgaccccgaagucgccuacaucaacuucaaacgcaucuacaccaccggacucuccuacgaccacauccgcaucuucuacaucaaaggccgcgaaaucaaaaccucccucaccaaacgauccgaaugggaagucacacucaaccucggcggcuggaaaguaaccgucuucaacaccaacuuccccggcaaccgcaacucccccguccccgacgacggccuaacccuccaccgccuauccggcuuccucgcccgcuaccuccucgaaaaaauccucaaagucuccgaacccgaaaaacucaucaucaaauccaaaaucaucaacccccucgccgaaaagaacggcaucaccugguccgacggcgaagaagucuaccucuccuucuucccaggcuccgaaauguuccucggcaccuucaaauucuacccccuagccaucggcaucuacaaaguccaacgcaaagaaauggaacccaaauaccucgaaaaaaccaugcgacaacgcuacaugggacucgaagccuccaccuggaccgucuccaaagucaacgaaguccaaucagcccucaccgucgucuccggacucggcuggaaaaaaaccaacgucuccgccgccgcccgcgaauuccucgcaaaauucggcauaaacauguaa

SEQ ID NO: 8133 - RNA, 702 nt, Artificial Sequence
  derived and/or modified CDS sequence (opt11) from BUNV(AMH001130)__JF961342.1__N
augauagaacucgaauuccacgacgucgccgccaacaccuccuccaccuucgaccccgaagucgccuacgcaaacuucaaacgcguccacaccaccggacucucauacgaccacauccgcaucuucuacaucaaaggacgcgaagucaaaaccucccucgccaaacgcuccgaaugggaagucacccucaaccucggcggcuggaaaaucaccgucuacaacaccaacuuccccggcaaccgaaacaaccccguccccgacgacggacucacacuccaccgccuaucaggcuuccuagcccgcuaccuccucgaaaaaaugcuaaaagucucagaacccgaaaaacucaucaucaaaagcaaaaucaucaacccacucgccgaaaaaaacggcaucaccuggaacgacggcgaagaagucuaccucuccuucuucccaggcuccgaaauguuccucggcaccuuccgcuucuacccccucgccauaggcaucuacaaaguccaacgaaaagaaauggaacccaaauaccuagaaaaaaccaugcgacaacgcuacaugggccucgaagccgccaccuggaccguauccaaacuaaccgaaguccaauccgcccuuaccgucgucuccucacucggcuggaaaaaaaccaacgucucugccgccgcccgcgacuuccucgcaaaauucggcauaaacauguaa

SEQ ID NO: 8134 - RNA, 702 nt, Artificial Sequence
  derived and/or modified CDS sequence (opt11) from BUNV(ArB29051)__AM709778.1__N
augaucgaacuagaauuccacgacgucgcagccaacaccuccagcaccuucgaccccgaagucgccuacgccaacuucaaacgcguccacaccaccggccucucauacgaccacaucagaaucuucuacaucaaaggccgagaaaucaaaaccucccuagccaaacgauccgaaugggaagucacccuaaaccucggcggcuggaaaaucaccgucuacaacaccaacuuccccggcaaccgcaacaaccccguccccgacgacggccuaacccuccaccgccucuccggcuuccucgcccgcuaccuccucgaaaaaaugcucaaacucuccgaaccugaaaaacuaauuaucaaaucaaaaauaaucaacccccucgccgaaaaaaacggaaucaccuggaacgacggcgaagaagucuaccucucauucuuccccggcuccgaaauguuccucggaaccuuccgcuucuacccccucgccaucggcaucuacaaaguccaacgcaaagaaauggaacccaaauaccucgaaaaaaccaugcgccaacgauacaugggccuugaagccgcaaccuggaccgucuccaaacucaccgaaguccaauccgcccucaccgucguauccagccuaggcuggaaaaaaaccaacgucuccgccgccgcccgagacuuccuagccaaauucggcaucaacauguga

SEQ ID NO: 8135 - RNA, 702 nt, Artificial Sequence
  derived and/or modified CDS sequence (opt11) from BUNV(ArB28215)__AM711130.1__N
augaucgaacucgaauucaacgacgucgccgucaacaccuccuccucauucgaccccgaagcggccuacgccaacuucaaaagaguccacacaaccggccucuccuacgaccacauccgcauauucuacaucaaaggccgcgaaaucaaagucucccuauccaaacgcuccgagugggaaguaaccaucaaccucggcggcuggaaaauagccguauacaacacaaacuuccccggcaaccgcaacucccccgucccugacgacggccucacccuacaccgccucuccggcuuccucgcccgcuuccuccucgaaaaaaugcucaaaauguccgaacccgaaaaacucaucaucaaagccaaaaucaucaacccacucgccgaaaaaaaccgcaucaccuggaacgacggcgaagaagucuaccuauccuucuuccccggcagcgaaauguuccucggcaccuucaaauucuacccccuagccaucggcauauacaaaguccaacgaaaagaaauggaaccaaaauacuucgaaaaaaccaugcgccaacgcuacaugggccucgaagccucauccuggaccgucuccaaacuaaccgauguccaauccgcccucaccguagucuccggccuaggcuggaaaaaaaccaacgucuccgccgccgcccgagacuuccucgccaaauucggcaucaacauguaa

SEQ ID NO: 8136 - RNA, 702 nt, Artificial Sequence
  derived and/or modified CDS sequence (opt11) from BUNV(Peurto Almendras)__AJ697960.1__N
auguccgaaaucgcauucgacgacauaggccaaaucgccgccucaaccuucaaccccgacaaccaauacaucggauucaaaaaagucuucacaaucggccucacauacgaccaaauccgcaucuucuuccucaacggcaaaaaagcaaaagaaacccuauccaaacgcuccgaagaaaccgucacccucaacuucggcggauggcgaauccccaucguaaacacacacuuccccggaaaccgcaacauagaccuagcagacgacgcccucacccuccaccgcguuagcggcuaccuagcacgcuaccuacucgaaaaaguccucuccgcccaagaacccgaaaaagucaucaucaaaacccgcaucaucaaccccaucgccgccucaaacggcaucaccugggacgacggcuacgaagucuaccuauccuucuuccccggcucagaaugcuuccucgaagccuucaaauucuacccccucgccaucggcaucuacaaaguccaaaaaggcaugauggacgucaaauuccucgaaaaaaccaugcgccaaaaauacgccggccucgacgcaacagucuggacccaacaaaaauauaccgacgucaucaacgcccuccucguagucaacggccucggcuggaaaaaauccaacgucuccgccgccgccaaagacuuccucucaaaauucggcauccaaauauga

SEQ ID NO: 8137 - RNA, 702 nt, Artificial Sequence
  derived and/or modified CDS sequence (opt11) from BUNV__AF325122.1__N
augaucgaacucgaauucaacgacgucgccgcaaacaccuccuccaccuucgaccccgaagucgccuacaucaacuucaaacgccucuacaccacaggccuaucauacgaccacauacgcaucuucuacaucaaaggacgcgaaaucaaaaccucccucgccaaacgcuccgaaugggaagucacccucaaccucggcggcuggaaagucaccgucuucaacaccaacuucccaggcaaccgcaacucccccguccccgacgacggccucacccuacaccgccucagcggauaccuagcccgcuaccuccuagaaaaaauccucaaagucuccgaccccgaaaaacucaucaucaaauccaaaaucaucaacccccuagccgaaaaaaacggaaucaccugguccgacggcgaagaaguauaccucucauucuuccccggcuccgaaauguuccucggcaccuuccgcuucuacccccuagccaucggcaucuacaaaguacaacgaaaagaaauggaacccaaauaccucgaaaaaaccaugcgccaacgcuacaugggccuagaagccucaaccuggaccgucuccaaacucaacgaaguccaauccgcccucaccgucguauccggccucggcuggaaaaaaaccaacgucuccuccgccgcccgcgaauuccucgccaaauucggaauaagcauguaa

SEQ ID NO: 8138 - RNA, 702 nt, Artificial Sequence
  derived and/or modified CDS sequence (opt11) from Ab-BUNV(Cu20-XJ)__KJ710424.1__N
augcucgaacucgaauucgaagacguccccaccaacauaggauccaccuucgaccccgaauccggauacauaaacuuccaacgaaacuaccuccccggcgucacccucgaccaaauccgcaucuucuacaucaaaggccgcgaaaucaaaaacucccucgccaaacgcuccgaaugggaaguuacccugaaccuuggcggauggaaaguccccguccucaacaccaacuuccccggcaacagauccaacgcaguccccgacuacggccucaccuuccaccgcaucucaggcuaccucgcccgcuaccuccucggcaaauaccucgccgaaaccgaacccgaaaaacucauaaugcgcaccaaaaucaucaacccccucgccgaaaaaaacggcaucacaugggaauccggccccgaagucuaccucucauucuuccccggcgccgaaauguuccucggcaccuucaaauucuacccccuagcaaucggaaucuacaaaguucaacgcaaagaaauggaccccaaauuccucgaaaaaaccaugcgucaacgcuaccuaggccucgacgcccaaaccuggaccaccaccaaacucgacgaagucgaacgcgcccucaaaguagucuccggccucggcuggaaaaaaacaaacgucuccaacgccgcccgcgaauuccucuccaaauucggcauccgaauguaa

SEQ ID NO: 8139 - RNA, 702 nt, Artificial Sequence
  derived and/or modified CDS sequence (opt11) from ANADV(2513 Irkutsk)__KT313716.1__N
augaucgaacucgaauucaacgacgucgccgccaacaccuccuccaccuucgaccccgaagucgccuacaucaacuucaaacgaaucuacaccacaggccucagcuacgaccacauccgaaucuucuacaucaaaggccgcgaaaucaaaaccucccucgccaaacguuccgaaugggaagucacccucaaccucggcggcuggaaagucaccgucuucaacaccaacuuccccggcaaccgcaacucccccgucccagacgacggucucacccuccaccgccucuccggcuuccucgcccgauaccuacucgaaaaaauccucaaagucagcgaccccgaaaaacucaucaucaaauccaaaaucaucaacccccucgccgaaaaaaacggcauaaccugggccgacggcgaagaagucuaccucuccuucuuccccggcucugaaauguuucucggcaccuuccgcuucuacccccucgcaaucggcaucuacaaaguccaacgcaaagaaauggaacccaaauaccucgaaaaaaccaugcgccaacgauacauggggcucgaagccagcaccuggacagucuccaaacucaacgaaguccaauccgcccucacagucgucuccggccuaggcuggaaaaaaaccaacgucuccuccgccgcccgcgaauuccucgcccgcuucggcaucaacauguaa

SEQ ID NO: 8140 - RNA, 702 nt, Artificial Sequence
  derived and/or modified CDS sequence (opt11) from ANADV(EIV-23263Tyum)__KT313761.1__N
augaucgaacucgaauucaacgacguagccgccaacaccucauccaccuucgaccccgaagucgccuacaucaacuucaaacgcaucuacaccaccggacucuccuacgaccacauccgcaucuucuacaucaaaggccgagaaauaaaaaccucacucgccaaacgcuccgaaugggaagucacacucaaccuaggcggguggaaaaucaccgucuucaacaccaacuuccccggaaaccgcaacucccccguccccgacgacggacucacccuccaccgccucuccggauuccucgcacgauaccuccucgaaaaaauacucaaagucuccgaccccgaaaaacucaucaucaaauccaaaaucaucaacccccucgccgaaaaaaacggcaucaccugggcagacggagaagaggucuaccucuccuucuuccccggcuccgaaauguuccucggcacauuccgcuucuacccacucgccauaggcaucuacaaaguccaacgcaaagaaauggagcccaaauaccucgaaaaaaccaugcgccaacgcuacaugggacucgaagccuccaccuggaccgucagcaaacucaacgaaguccaauccgcccuaacagucgucucaggccucggcuggaaaaaaaccaacgucuccuccgcagcccgcgaauuccucgcccgcuucggcaucaacauguaa

SEQ ID NO: 8141 - RNA, 702 nt, Artificial Sequence
  derived and/or modified CDS sequence (opt11) from BATV__X73464.1__N
augaucgaacucgaauucaacgacguagccgccaacaccagcuccaccuucgaccccgaagucgccuacaucaacuucaaacgaaucuacacaaccggccucuccuacgacaacaucagaauauucuacaucaaaggccgcgaaaucaaaacaucccucuccaaacgcucagaaugggaaguaacacucaaccucggcggcuggaaagucaccgucuucaacaccaacuuccccggcaaccgaaacucucccguacccgacgacggacucacacuccaccgacucuccggcuuccuagcccgauacuuacucgaaaaaauccucaaagucuccgacccagaaaaacucaucauaaaauccaaaaucgucaacccccucgcagaaaaaaacggaauaaccugggcagacggcgaagaagucuaccucucauucuuccccggcuccgaaauguuccucggcacauuccgauucuacccccucgccaucggcaucuacaaaguccaacgaaaagaaauggaacccaaauaccucgaaaaaaccaugcgccaacgauacaugggccucgaagccagcaccuggaccgucuccaaacucaacgaaguacaauccgcccucaccgucgucagcggccucggcuggaaaaaaaccaacgucuccagcgccgcccgagaauuccucgccaaauucggcaucucaauguaa

SEQ ID NO: 8142 - RNA, 702 nt, Artificial Sequence
  derived and/or modified CDS sequence (opt11) from BATV(668)__KT313687.1__N
augaucgaacucgaauucaacgacgucgcagcaaacaccuccuccaccuucgaccccgaagucgccuaccucaacuucaaacgcauauacaccaccggccucuccuacgacaacauccgcaucuucuacauaaaaggccgcgaaaucaaagucucccucgccaaacgcuccgaaugggaaguaacacucaaucucggcggcuggaaagucaccguauucaacaccaacuuccccggcaaccgcaacucccccgucccagacgacggccucacccuccaccgccuauccggcuuccucgcacgauaccuccuagaaaaaauccuuaaagucuccgaccccgaaaaacucaucaucaaauccaaaaucaucaacccccuagccgaaaaaaacggcaucaccugguccgacggcgaagaagucuaccucuccuucuuccccggcuccgaaauguuccucggcaccuuccgcuucuacccccucgccaucggcaucuacaaaguccaacgcaaagaaauggaaccaaaauaccuagaaaaaacaaugcgccagcgcuacaugggccucgaagccagcaccuggaccgucuccaaacucaacgaaguccaaucagcccucaccgucgucuccggccuaggcuggaaaaaaaccaacgucuccuccgcagcccgcgaauuccucgccaaauucggcaucaacauguaa

SEQ ID NO: 8143 - RNA, 702 nt, Artificial Sequence
  derived and/or modified CDS sequence (opt11) from BATV(804922)__FJ436805.1__N
augaucgaacuagaauucaacgacgucgccgccaacaccuccuccaccuucgaccccgaagucgccuacaucaacuucaaacgcaucuacaccaccggacucucauacgacaacauccgaaucuucuacaucaaaggccgagaaaucaaaacaagccucgccaaacgcuccgaaugggaagucacccucaaccucggcggauggaaagucaccguauucaacaccaacuuccccggcaaccgcaacucccccguccccgacgacggccucacccuccaccgccucuccggcuuccucgcccgcuaccuccucgaaaaaauccucaaagucuccgaccccgagaaacucaucauaaaaucaaaaaucgucaacccccucgccgaaaaaaacggcaucaccugggccgacggagaagaagucuaccucuccuucuuccccggcuccgaaauguuccucggaaccuuccgcuucuacccccucgccaucggcaucuacaaaguccaacgcaaagaaauggaacccaaauaccucgaaaaaacaaugcgacaacgcuacaugggccucgaagccucaacauggaccguaagcaaacucaacgaaguccaauccgcacucaccgucgucuccggccucggcuggaaaaaaaccaacgucuccuccgccgcacgcgaauuccuagccaaauucggcauauccauguaa

SEQ ID NO: 8144 - RNA, 702 nt, Artificial Sequence
  derived and/or modified CDS sequence (opt11) from BATV(8627-11)__FJ436802.1__N
augaucgaacucgaauucaacgacguagccgcaaacaccuccuccaccuucgaccccgaaguagcauacaucaacuucaaacgcaucuacaccaccggccucuccuacgacaacauccgcaucuucuacaucaaaggccgagaaaucaaaaccucccucgccaaacgauccgaaugggaagucacccucaaccucggcggcuggaaagucaccgucuucaacaccaacuuccccggcaaccgcaacucucccguccccgacgacggccucacacuccaccgccucuccggcuuccucgcccgcuaccuccucgaaaaaauccucaaagucucugaccccgaaaaacucaucaucaaauccaaaaucgucaacccccucgccgaaaaaaacggcaucaccugggccgacggcgaagaaguauaccucucauucuuccccggcuccgaaauguuccucggcaccuuccgcuucuacccccucgccaucggcaucuacaaaguccaacgcaaagaaauggaacccaaauaccuagaaaaaacaaugagacaccgcuacaugggccucgaagccuccaccuggaccgucuccaaacucaacgaaguccaauccgcccucaccgucgucuccggccuuggcuggaaaaaaacaaacguauccucagccgcacgcgaauuccucgccaaauucggcaucuccauguaa

SEQ ID NO: 8145 - RNA, 702 nt, Artificial Sequence
  derived and/or modified CDS sequence (opt11) from BATV(G-20217)__FJ436806.1__N
augaucgaacucgaauucaacgacgucgccgccaacaccucaucuaccuucgaccccgaaguagccuacauaaacuucaaacgcauauacaccacuggccucuccuacgacaacauccgcauauucuacaucaaaggucgcgaaaucaaaaccucccuagcaaaacgcuccgaaugggaagucacacucaaccuuggcggcuggaaagucaccgucuucaacaccaacuuccccggcaaucgcaacucccccguaccagacgacggccucacccuacaccgccucuccggcuuccucgcccgcuaccuccuagaaaaaauccucaaagucuccgaccccgaaaaacucaucaucaaauccaaaaucgucaacccccucgccgaaaaaaacggcaucaccugggcagacggcgaagaagucuaccucuccuucuuccccggcuccgaaauguuccucggcaccuuccgcuucuacccccucuccaucggcaucuacaaaguccaacgcaaagaaauggaaccaaaauaccucgaaaaaaccaugcgacaacgcuacaugggccucgaagccuccaccuggaccgucucaaaacucaacgaaguccaaucagcccucaccguagucagcggccucggcuggaagaagaccaacgucuccucggccgcccgcgaauuccucgccaaauucggaaucuccauguga

SEQ ID NO: 8146 - RNA, 702 nt, Artificial Sequence
  derived and/or modified CDS sequence (opt11) from BATV(MS50)__JX846604.1__N
augaucgaacuagaauucaacgacgucgccgccaacaccuccuccaccuucgaccccgaagucgcauacgccaacuucaaacgcguccacaccaccggccucuccuacgaccacguccgcauauucuacaucaaaggccgagaaauaaaaaccucacuauccaaacgcagcgaaugggaagucacccucaaccucggcggcuggaagaucgccgucuacaacacaaacuuccccuccaaccgcaacaaccccguccccgacgacggacucacccuccaccgccucuccggcuaccucgcccgcuaccucuucgaaaaaaucgucaaagucucagaacccgaaaaacuccuaaucaaauccaaaaucaucaacccccucgccgaaaaaaacggcaucaccugggccgacggcgaagaaaucuaccucuccuucuuccccggcuccgaaauguuccucggcaccuucaaauucuacccacucgccaucggcaucuacaaaguccaaagaaaagaaauggaacccaaauaccucgaaaaaaccaugcgccaacgauacaugggccucgaagccggaaccuggaccgucuccaaagucaacgaaguccaagcggccgucaacguagucuccacccucggcuggaaaaaaaccaacgucucagccgccgcccgagaauuccuugcaaaauucggcaucgcuauguaa

SEQ ID NO: 8147 - RNA, 702 nt, Artificial Sequence
  derived and/or modified CDS sequence (opt11) from BATV(ON-1/E/94)__AB257761.1__N
augaucgaacucgaauucaacgacgucgccgccaacaccuccuccaccuucgaccccgaagucgccuacaucaacuucaaacgcgucuacaccacaggacuauccuacgacaacauacgcaucuucuacaucaaaggccgagaaaucaaaaccucccuagccaaacgcuccgaaugggaagucacccucaaccucggcggcuggaaagucaccgucuucaacaccaacuuccccggaaaccgcaacucccccguccccgacgacggccucacccuccaccgccuuuccggcuuccuagcccgcuaccuacuagaaaaaauacucaaagucuccgaccccgaaaaacucauaaucaaaucaaaaaucgucaacccacuagccgaaaaaaacggcaucaccugggccgacggagaagaaguauaccucuccuucuuccccggauccgaaauguuccucggcaccuuccgcuucuacccgcucgccaucggcaucuacaaaguccaacgcaaagaaauggaacccaaauaccucgaaaaaacaaugcgccaacgcuacaugggacucgaagccucaaccuggaccgucuccaaacucaacgaaguccaauccgcccucaccgucgucuccggccucggcuggaagaaaaccaacgucuccucagccgcccgagaauuccucgccaaauucggcaucagcauguaa

SEQ ID NO: 8148 - RNA, 702 nt, Artificial Sequence
  derived and/or modified CDS sequence (opt11) from BATV(UgMP-6830)__JX846601.1__N
augaucgaacucgaauucaacgacgucgccgccaacaccuccuccaccuucgaccccgaagucgcauacaucaacuucaaacgcaucuacaccaccggccuguccuacgacaacauccgcaucuucuacaucaaaggacgugaaaucaaaaccucccucgccaaacgaucagaaugggaagucacccucaaccucggcggauggaaagucaccgucuucaacaccaacuuccccggcaaccgcaacucccccguccccgacgacggccucacccuccaccgccucucaggcuuccucgcacgcuaccuccuagaaaaaauacucaaaguauccgaccccgaaaaacucaucaucaaaucuaaaaucaucaacccccucgccgaaaagaacggcaucaccugggccgacggcgaagaagucuaccucagcuucuuccccggcuccgaaauguuccucggcaccuuccgcuucuacccccucgccaucggcaucuacaaaguccaacgcaaagaaauggaacccaaauaccuagaaaaaaccaugcgccaaagauacaugggccucgaagccuccaccuggacagucuccaaacucaacgaaguccaguccgcccucaccgucgucuccggccucggcuggaaaaaaaccaacgucuccucagccgcccgcgaauuccucgccaaauucggcaucuccauguaa

SEQ ID NO: 8149 - RNA, 702 nt, Artificial Sequence
  derived and/or modified CDS sequence (opt11) from BIRV(ArB2198)__AM711131.1__N
augaucgaacucgaauuccaccacgucgccgccaacaccuccuccaccuucgaccccgaagucgccuacgccaacuucaaacgaauccacaccaacggccucuccuacgacaacauccgcaucuucuacaucaaaggcagagaaaucaaaaccucccucgccaaacgcuccgaaugggaaguaacccucaaccucggcggauggaaagucgcaguauacaacaccaacuuccccggcaaccgcaacaacccaguccccgacgacggccucacacuccaccgccuaagcggcuuccucgcccgauaccuccucgaaaaaaugcuaaaagucuccgaacccgaaaaacucauaaucaaaaccaaaaucauaaacccacucgccgaaaaaaacggcaucaccuggaaagacggcgaagaagucuaccucuccuucuuccccggcucagaaauguuccucggcaccuucaaauucuacccccuugccaucggcauauacaaaguccaaaaaaaagaaauggaccccaaauaccucgaaaagaccaugcgacaacgcuacaugggccuagaggccuccaccuggacagucucaaaagucuccgaaguccaauccgcccucaccgucgucuccucccucggcuggaaaaaaaccaacgucacagccgccgcccgagacuucuucgccaaauucggcaucaacauguaa

SEQ ID NO: 8150 - RNA, 702 nt, Artificial Sequence
  derived and/or modified CDS sequence (opt11) from BOZOV(ArB13529)__AM711132.1__N
augaucgaacucgaauucaacgacgucgccgccaacaccuccuccaccuucgaccccgaagccgccuacgccaacuucaaacgcguccacaccacaggccucaccuacgaccacauccgcaucuucuacaucaaaggcuccgaaaucaaaaccucccuagccaaacgcuccgaaugggaagucacccucaaccucggcggcuggaaaaucaccgucuacaacaccaacuuccccggcaaccgcaacaaccccucccccgacgacggccucacccuccacuucuucugcggcuuccuagccaaaucccuccucgaaaaaaugcucaaagucuccgcccccgaaaaacucauaaucaaauccaaaaucacauccccacucgccgaaaaaaacggcaucacauggaacgacggcgaagaagucuaccucuccuucuuccccggauccgaaauguuccuuggcaccuuccacuucuacccccuacccaucggaaucuaccaaggccuccgccgcgaccucgagcccaaauacuucggcaaaacacuccgccuaauguacaugggccucgaagccuccuccuggaccgucucaaaacucaccgaaggccaauccgcccucaccgucgucuccggccucggauggaaaaaaaccaacgucucagccgcagcccgcgacuuccucgccaaauucggcaucaacauguaa

SEQ ID NO: 8151 - RNA, 702 nt, Artificial Sequence
  derived and/or modified CDS sequence (opt11) from CVV__X73465.1__N
augaucgagcucgaauucaacgacgucgccgccaacaccuccuccaccuucgaccccgaaaucgccuacguaaacuucaaacgcauccacaccaccggccucuccuacgaccacauccgcaucuucuacaucaaaggccgcgaaaucaaaaccucccucacaaaacgcuccgaaugggaagucacccucaaccucggcggauggaaaguaaccgucuucaacaccaacuuccccggcaaccgaaacucccccguacccgacgacggccucacacuccaccgccucuccggcuaccucgcccgcuaccuccucgaaaaaauccucaaaguauccgaccccgaaaaagucaucaucaaauccaaaaucauaaacccccucgccgaaaaaaacggcauaaccugguccgacggcgaagaagucuaccucucauucuuccccggcuccgaaauguuccuaggcaccuucaaauucuacccccuagccaucggcauauacaaaguacaacgcaaagaaauggaaccaaaauaccuugaaaaaacaaugcgccaacgauacaugggccuagaagccuccaccuggacaaucuccaaagucaacgaaguacaagccgcccucaccgucgucuccggccucggcuggaaaaaaacaaacgucuccgccgccgcccgcgaauuccuagccaaauucggcaucuccauguaa

SEQ ID NO: 8152 - RNA, 702 nt, Artificial Sequence
  derived and/or modified CDS sequence (opt11) from CVV(10081)__KP835932.1__N
augaucgaacucgaauucaacgacgucgcagccaacacauccuccaccuucgaccccgaaaucgccuacgucaacuucaaaagaaucuacaccaccggccucuccuacgaccacauccgcaucuucuacaucaaaggccgcgaaaucaaaaccucccucacaaaacgauccgaaugggaagucacccucaaccucggcggcuggaaaaucaccguauucaacaccaacuuccccggcaaccgaaacuccccaguccccgacgauggccucacccuccaccgccucucaggcuaccuagcccgcuaccuucuagaaaaaauacucaaagucuccgacccugaaaaagucaucaucaaauccaaaaucaucaauccacuagcagaaaaaaacggcaucaccugguccgacggcgaagaagucuaccucuccuucuuccccggcucagaaauguuccucggcaccuucaaauucuacccccuagcaaucggcauuuacaaaguccaacgaaaagaaauggaacccaaauaccuagaaaaaaccaugcgacaacgcuacaugggccucgaagccuccaccuggacaaucuccaaagucaacgaaguccaagccgcccucaccgucguaagcggccucggcuggaaaaaaaccaacgucuccgccgccgcccgcgaauuccucgccaaauucggcaucuccauguaa

SEQ ID NO: 8153 - RNA, 702 nt, Artificial Sequence
  derived and/or modified CDS sequence (opt11) from CHLV(CHLV-Mex07)__EU879062.3__N
augauagaacucgaauucaacgacgucgccgccaacacaucaucaaccuucgaccccgaaaucgccuacguaaacuucaaacgaaucuacaccaccggccucagcuacgaccacauccgaaucuucuacaucaaaggcagagaaaucaaaacaucacuaacaaaacgaagcgaaugggaagucacccucaaccuaggcggcuggaaaguaaccgucuucaacaccaacuuccccggcaaccgcaacucccccguccccgacgacggccucacccuacaccgccucuccggcuaccucgcccgcuaccuccuggaaaaaauacucaaagucuccgaccccgaaaaagucaucauaaaaucaaaaaucaucaacccccuagccgaaaaaaacggcaucacaugguccgacggcgaagaagucuaccucuccuucuucccgggcuccgaaauguuccucggcaccuucaaauucuacccccucgccaucggcaucuacaaaguccaacgcaaagaaauggaacccaaauaccucgaaaagacaaugcgccaacgcuacaugggccucgaagcauccaccuggacagucucaaaagucaacgaaguccaagccgcccucaccgucgucuccggccucggcuggaaaaaaaccaacgucuccgcagccgcccgcgaauuccuagccaaauucggcaucuccauguaa

SEQ ID NO: 8154 - RNA, 702 nt, Artificial Sequence
  derived and/or modified CDS sequence (opt11) from GERV__M19420.1__N
augcucgaacucgaauucgaagacgucccaaacaacaucggcucaaccuucgaccccgaauccggcuacaccaacuuccaacgcaacuaccuccccggcguaacccucgaccaaauccgcaucuucuacaucaaaggccgcgaaaucaaaaacucacucucaaaacgcuccgaaugggaaguaacccucaaccucggcggcuggaaaguacccguacucaacaccaauuuccccggcaaccgcaacaacgccguccccgacuacggccuaaccuuccaccgaaucuccggcuaccucgcccgcuaccuccuaggcaaauaccuagccgaaaccgaacccgaaaaacugaucaugcgcaccaaaaucgucaacccccucgccgaaaaaaacggcaucaccugggaauccggccccgaagucuaccuuagcuucuucccaggcgccgaaauguuccuaggcaccuuccgcuucuacccccuagccaucggcaucuacaagguccaacgcaaagaaauggacccaaaauuccucgaaaaaaccaugagacaacgcuaccucggcaucgacgcacaaacauggaccaccaccaaacucggcgaagucgaagccgcacucaaagucgucucaggacucggcuggaaaaaaaccaacguauccuccgccgcccgcgaauuccucagcaaauucggcauccgaauguaa

SEQ ID NO: 8155 - RNA, 702 nt, Artificial Sequence
  derived and/or modified CDS sequence (opt11) from IACOV(BeAn314206)__JN572067.1__N
auguccgaaaucaucuucgacgacgucggccaaaucaccucaucaaccuucaaccccgacguccaauacaucaacuucaaaaaaaaccacaccaccggccucaacuacgaccaaauccgcgucuucuuccuaaacggcaaaaaagccaaagaaacccuagccaaacgauccgaagaaucacuccaacucaacuucggcggauggcgcgucgucgucaugaacacccacuuccccggcaaccgcaacaugcucauacccgacgaagccaugacccuccaccgccucuccggcuaccucgcccgcuaccuccuagaaagaauccucucaggcccagaacacgagaaagucgucaucaccagcaaaaucgucaacccaaucgccgccuccaacggaaucaccuggaccgacggccccgaagucuaccuauccuucuuccccggcaccgaaauguuccucgaaucauucaaauucuacccacucgccaucggaaucuacaaaguccaaaaaaaaaugauggaaagcaaauaccucgaaaaagccaugcgccaaaaauacagcggaauggacgccacccucuggacccaacaaaaguacgccgaagucaccaacgcccucgccgucgucuccaaccucggcuggaaaaaauccaacgucuccgccgccgcccgcgacuuccuagccaaauucggcauccaacucuaa

SEQ ID NO: 8156 - RNA, 702 nt, Artificial Sequence
  derived and/or modified CDS sequence (opt11) from ILEV(ArB16282)__AM709780.1__N
augaucgaacuagaauuccacgacgucaccgccaacaccucuagcaccuucgaccccgaagucgccuacgcaaacuucaaacgcauccacacaaacggccucaacuacgaccacauccgcaucuucuacaucaaaggccgcgaaaucaaaacaagccucgccaaacgcuccgaaugggaagucacccuaaaccuaggcggcuggaaaauaagcgucuacaacaccaaauuccccggcaaccgcaacaacccaguccccgacgacggccucacccuccaccgccucucaggcuuccuagcccgcuaccuccuagaaaaaaugcucaaagucuccgagcccgaaaaacuaaucaucaaaucaaaaaucauaaacccccucgccgaaaaaaacggcauaaccugguacgacggcgaagaagucuaccuauccuucuucccaggcucagaaaugugccuaggcacccaagacuucuaccccauggccaucgaauucuaccaaguccaacgcaaagaaauggaacccaaauuccucgaaaaaacccuaaaacaacgcagccucggccucgaacccuccaccuggaccaucucccaacucgucaaacuccaauccgcccucaccgucgucuccggacucggcuggaaaaaaaccaacgucggagccgccgcccgaaacuuccucgccaaauucggcaucaacauguaa

SEQ ID NO: 8157 - RNA, 702 nt, Artificial Sequence
  derived and/or modified CDS sequence (opt11) from ILEV(HB80P125)__AM709779.1__N
augaucgaacucgaauuccacgacgucaccgccaacaccuccucaaccuucgaccccgaagucgccuacgcaaacuucaagcgcauccacaccaacggccucaacuacgaccacauccgcaucuucuacaucaaaggccgagaaaucaaaaccucccucgccaaacgcuccgagugggaagucacacuuaaccucggcggcuggaaaauagccgucuacaacaccaacuucccaggcaaccgcaacaaccccguccccgacgacggccucacccuacaccgccucuccggcuaccucgcccgcugccuucucgaaaaaaugcucaaagucuccgaacccgaaaaacaaaucaucaaaucaaaaaucaucaacccccucgccgaaaaaaacggcaucaccugggacgacggcgaagaagucuaccucagcuucuuccccggauccgaaauguuccucggaaccuuccgcuucuacccccucgccaucggaauauacaaaguccaacgcaaagaaauggaacccaaauaccuagaaaaaaccaugcgccaacgcuacaugggccucgaagccuccaccuggaccaucuccaaacucgccgaaguccaauccgcccucaccgucgucuccggccucggcuggaaaaaaaccaacgucuccgccgccgcucgcgacuuccucgccaaauucggcaucaacauguga

SEQ ID NO: 8158 - RNA, 702 nt, Artificial Sequence
  derived and/or modified CDS sequence (opt11) from ILEV(ILESHA/8e)__KC608151.1__N
augaucgaacucgaauuccacgacguuaccgccaacacaucaagcaccuucgaccccgaagucgccuacgcaaacuucaaacgaauccacacaaacggccuaaacuaugaccacauccgcaucuucuacaucaaaggacgcgaaaucaaaaccucccucgccaaacgauccgaaugggaagucacccucaaccucggcggauggaaaaucgcagucuacaacacaaacuuccccggcaaccgcaacaaccccauccccgacgacggccucacccuccaccgccucuccggcuaccuagcccgcuaccuccuugaaaaaaugcucaaaguaucagaacccgaaaaacaaaucaucaaauccaaaaucaucaacccccucgccgaaaaaaacggaaucaccugggacgacggcgaagaagucuaccucuccuucuuccccggcuccgaaauguuccucggcaccuuccgcuucuacccccucgccaucggcaucuacaaaguccaacgcaaagaaauggaaccaaaauaccucgaaaaaacaaugcgccaaagauacaugggccucgaagccuccaccuggaccaucuccaaacucgccgaaguacaaucagcccuaaccgucgucuccggccucggcuggaaaaaaacaaacgucuccgccgccgcccgcgacuuccucgcaaaauucggcaucaacauguaa

SEQ ID NO: 8159 - RNA, 702 nt, Artificial Sequence
  derived and/or modified CDS sequence (opt11) from ILEV(R5964)__AY729651.1__N
augaucgaacucgaauuccacgacgucaccgccaacaccuccuccacauucgaccccgaagucgccuacgccaacuucaaacgcauccacaccaacggccucaacuacgaccacauccguaucuucuacaucaaaggccgcgaaaucaaaaccagccuagccaaacgcuccgaaugggaagucacccuaaaccucggcggcuggaaaaucgccgucuacaacacaaauuuccccggcaaccgcaacaaccccauacccgacgacggccuaacccuccaccgccucuccggcuaccuagcccgcuaccuccucgaaaaaaugcucaaagucuccgaacccgaaaaacaaaucaucaaaucaaaaauaauaaacccccucgcagaaaaaaacggaaucaccugggacgacggcgaagaagucuaccucuccuucuucccaggcucagaaauguuccucggcaccuuccgcuucuacccccuagccaucggcauauacaaaguccaacgcaaagaaauggaacccaaauaccucgaaaaaaccaugcgccaacgcuacaugggccucgaagcaucaaccuggacaaucucaaaacucgccgaaguccaauccgcccuaaccgucgucucaggccucggcuggaaaaaaaccaacgucucagcccccgcccgcgacuuccucgcaaaauucggaaucaacauguaa

SEQ ID NO: 8160 - RNA, 702 nt, Artificial Sequence
  derived and/or modified CDS sequence (opt11) from MAGV__D13783.1__N
augauugaacucgaauucaacgacguagccgccaacaccuccuccaccuucgaccccgaaaucgccuacgucaacuucaaacgcauccacacaaccggccuauccuacgaccacauccgcguccucuacaucaaaggccgagaaaucaaaaccucacucacaaaacgcuccgaaugggaagucacccucaaccucggcggcuggaaagucgccgucuucaacaccaacuuccccggcaaccgcaacucccccguccccgacgacggccucacccuccaccgccucuccggcuuccuagcccguuaccuacuagaaaaaauacuaaaaguauccgaccccgaaaaacuaaucaucaaaagcaaaaucaucaacccccucgcagaaaaaaacggcaucaccugggccgacggcgaagaagucuaccucuccuucuuccccggcuccgaaauguuccucggcaccuucaaauucuacccccucgccauaggcaucuacaaaguccaaaaaaaagaaauggaaccaaaguaccucgaaaaaaccaugcgccaacgcuacaugggccucgaagcagcaaccuggaccgucuccaaagucaacgaaguacaagccgcacucaccguagucuccggacucggcuggaaaaaaaccaacgucuccgccgccgcccgcgaauuccuagccaaauucggaaucaacauguaa

SEQ ID NO: 8161 - RNA, 702 nt, Artificial Sequence
  derived and/or modified CDS sequence (opt11) from MAGV(7272)__KX100103.1__N
augaucgaacucgaauucaacgaugucgccgccaacaccagcuccaccuucgaccccgagaucgccuauguaaacuucaaacgcauccacaccaccggccuuagcuacgaccacauccgaguccucuacaucaaaggccgcgaaaucaaaaccagccucaccaaacgaagcgaaugggaagucacccucaaccucggcggcuggaaaguagcagucuucaacaccaacuuccccggaaaccgcaacagcccaguccccgacgacggacuaacacuccaccgccucuccggcuuccucgcccgcuaccuacucgaaaaaauccucaaagucagcgaccccgaaaaacuaaucauaaaauccaagauaaucaacccccucgccgaaaaaaacggcaucaccugggccgacggcgaagaagucuaccucuccuucuuccccggaagcgaaauguuccucggcaccuucaaguucuacccccucgccaucggcaucuacaaaguccagcgcaaagaaauggaacccaaauaccucgaaaaaaccaugcgccaacgauacaugggccucgaagccgcaacauggaccgucucaaaagucaacgaaguccaagccgcccuaaccguagucuccggccuaggcuggaaaaagacaaacgucagcgccgcagcccgagaauuccucgccaaauucggcaucaacauguaa

SEQ ID NO: 8162 - RNA, 702 nt, Artificial Sequence
  derived and/or modified CDS sequence (opt11) from MAGV(3363)__KX100106.1__N
augaucgaacucgaauucaacgacgucgccgccaacaccuccuccaccuucgaccccgaaaucgccuacgucaacuucaaacgcaucuacaccaccggccuaucauacgaccacauccgcauauucuacaucaaaggccgcgaaaucaaaaccucacucacaaaacgcuccgaaugggaaguaacccucaaccucggcggauggaaaguaaccguauucaacaccaacuuccccggcaaccgcaacucccccgucccagacgacggccuaacccuccaccgccucuccggcuaccucgcccgauaccuccuagaaaaaauccucaaagucuccgaccccgaaaaagucaucaucaaauccaaaauaaucaacccccucgccgaaaaaaacggcauaaccugguccgacggcgaagaagucuaccucuccuucuuccccggcuccgaaauguuccucggcaccuucaaauucuacccccucgccaucggaaucuacaaaguccaaagaaaagaaauggaacccaaauaccucgaaaaaaccaugcgccaacgauacaugggccucgaagccuccaccuggaccaucuccaaagucaacgaaguccaagccgcccucacagucgucuccggccucggcuggaaaaaaaccaacguauccgcugccgcccgagaauuccucgccaaguucggcaucagcauguaa

SEQ ID NO: 8163 - RNA, 702 nt, Artificial Sequence
  derived and/or modified CDS sequence (opt11) from NRIV(DakArY357/6e)__AY593727.1__N
augaucgaacuagaauuccacgauguaaccgccaacaccuccagcaccuucgaccccgaagucgccuacgccaacuucaaacgcauccacaccaacggccucaacuacgacuacauacgcaucuucuacaucaaaggccgcgaaaucaaaacaucccucgccaaacguuccgaaugggaagucacccuaaaccucggcggcuggaagaucgccguauacaacaccaacuuccccggcaaccgcaacaaccccauaccagacgacggacucacacuccaccgccucuccggcuaccucgcccgcuaccuccucgaaaaaaugcucaaagucuccgaacccgaaaaacaaaucaucaaauccaaaaucaucaacccacucgccgaaaaaaacggaaucaccugggacgacggcgaagaagucuaccucuccuucuuccccggcuccgaaauguuccucggcaccuuccgcuucuacccccucgccauaggaaucuacaaaguccaacgcaaagaaauggaaccaaaauaccuagaaaaaaccaugcgccaacgcuacaugggccucgaagccucaaccuggaccaucuccaaacucgccgaaguccaauccgcccuaaccgucgucuccggccucggcuggaaaaaaaccaacgucucagcagccgcccgcgacuuccucgccaaauucggcaucaacauguaa

SEQ ID NO: 8164 - RNA, 702 nt, Artificial Sequence
  derived and/or modified CDS sequence (opt11) from NORV__X73470.1__N
augaucgaacuagaauucaacgacgucgccgccaacaccucaagcacuuucgaccccgaagucgccuacaucaacuucaaacgcgucuacaccaccggccucucuuacgaccacauccgaaucuucuacauaaaaggccgcgagaucaaaaccucgcucaccaaacgcucagaaugggaagucacccucaaccuaggcggcuggaaagucaccguauucaacaccaacuuccccggcaaccgcaacucccccguccccgacgacggccucacccuccaccgccucuccggcuuccucgcccgauaccuccucgaaaaaauccuaaaagucuccgaacccgaaaaacucaucaucaaauccaaaaucauaaacccccucgccgagaaaaacggcaucaccuggaccgacggcgaagaagucuaccucuccuucuuccccggcucagaaauguuccucggcaccuucaaauucuacccccucgccaucggcaucuacaaaguccaacgcaaagaaauggaacccaaauaccuagaaaaaaccaugcgacaacgcuacaugggccuagaagccagcaccuggacaaucuccaaaguaaacgaaguccaagcagcccucaccgucgucuccggccucggcuggaaaaaaacaaacgucuccgccgccgcacgcgaauuccuagccaaauucggaaucaacauguaa

SEQ ID NO: 8165 - RNA, 702 nt, Artificial Sequence
  derived and/or modified CDS sequence (opt11) from POTV(89-3380)__AY729652.1__N
augaucgaacuagaauucaacgacgucgccgccgacaccuccucaaccuucgaccccgaaaucgcauacgucaacuucaaacgcauccacaccaccggccucucauacgaccacauccguaucuucuacauaaaaggccgcgaaaucaaaaccucacucaccaaacgcuccgaaugggaagucacccucaaccucggaggcuggaaaauaaccgucuucaacacaaacuuccccggcaaccgaaacucccccguccccgacgacggccucacacuccaccgccucuccggcuaccucgcccgcuaccuccucgaaaaaauccuaaaaguauccgaccccgaaaaagucaucaucaaauccaaaaucaucaacccccucgccgaaaaaaacggaaucaccugguccgacggcgaagaagucuaccucuccuucuuccccggcuccgaaauguuccucggcaccuucaaauucuacccccucgccaucggcaucuacaaaguccagcgcaaagaaauggaaccaaaauaccuagaaaaaacuaugcgccaacgcuacaugggccucgaagccuccacauggaccgucuccaaagucaacgaaguccaagccgcacucacagucguaucaggccucggcuggaaaaaaaccaacguauccgccgccgcccgcgaauuccucgcaaaauucggcaucucaauguaa

SEQ ID NO: 8166 - RNA, 702 nt, Artificial Sequence
  derived and/or modified CDS sequence (opt11) from SHOV(4042)__EU564831.1__N
augaucgaacucgaauuccacgacguagccgccaacaccucauccaccuucgaccccgaagucgccuacgccaacuucaaacgcguccacacaacaggccuguccuacgaccacauccgcaucuucuacaucaaaggccgcgaaaucaaaaccucccucgccaaacgaagcgaaugggaaguaacacuaaaccucggcggcuggaaaaucaccgucuacaacaccaacuucccaggcaaccgaaacaaccccguccccgacgacggacucacccuacacagacuauccggcuuccucgcccgcuaccuccucgaaaaaaugcuaaaaguauccgaacccgaaaaacucaucaucaaauccaaaaucaucaacccccucgccgaaaaaaacggcaucaccuggaccgacggcgaagaagucuaccucuccuucuucccaggcgccgaaauguuccucggcacauucaaauucuacccccucgccaucggcaucuacaaaguccaacgcaaagaaauggaacccaaauaccucgaaaaaaccaugcgacaacgauacaugggacuagaagcagccacauggaccguauccaaacucaccgaaguccaagccgcccucacagucguauccggccucggcuggaaaaaaaccaacgucuccgccgcagcaagagacuuccucgccaaauucggcaucucaauguaa

SEQ ID NO: 8167 - RNA, 702 nt, Artificial Sequence
  derived and/or modified CDS sequence (opt11) from TENV(TSV-FE3-66FB)__FJ943505.1__N
augaucgaacucgaauucaacgacgucgccgccaacacaagcuccaccuucgaccccgaagucggcuacgucaacuucaaacgaguccacacaaccggccuauccuacgaccacauccgcaucuucuacaucaaaggacgagaaaucaaaaccucacucaccaagcgaucagaaugggaagucacccucaaccucggcggauggaaagucaccguauucaacaccaacuucccaggcaaccgcaacucacccguccccgaugacggacucacccuccaccgccuaucaggcuuccucgcccgcuaccuccucgaaaaaauccuaaaagucucagaccccgaaaaacuaaucaucaaauccaaaauaauaaacccccucgccgaaaaaaacggcaucacgugggccgacggcgaagaagucuaccucuccuucuuccccggcuccgaaauguuccucggcaccuucaaauucuacccccucgccaucggcaucuacaaaguccaacgcaaagaaauggaacccaaauaccucgaaaaaaccaugcgacaacgcuacaugggacucgaagccgccaccuggaccauauccaaagucaacgaaguccaaucagcccucaccgucgucuccggucucggcuggaaaaaaaccaacguauccgccgccgcccgagaauuccucgcaaaauucggcaucaacauguaa

SEQ ID NO: 8168 - RNA, 702 nt, Artificial Sequence
  derived and/or modified CDS sequence (opt11) from XINV(BeH388464)__EU564830.1__N
augcucgaacucgaauucaacgacgucgccgccaacaccagcuccaccuucgaccccgaagucggcuacgccaacuucaaacgcauccacaccaacggccucuccuacgacaacauacgcaucuucuacaucaaaggccgagaaaucaaaaccucccucgccaaacgcuccgaaugggaaguaacccucaaccucggcggcuggaaaaucaccgucuacaacaccaacuuccccggcaaccgcaaccaccccauccccgacgacggccucaccauccaccgacuauccggcuaccucgcccgcuaccuccuagaaaaaauacuuaaaguaucagaccccgaaaaacuccucaucaaaaccaaaauaaucaacccccucgccgaaaaaaacggcaucaccuggaacgacggcgaagaagucuaccucuccuucuuccccggcuccgagauguuccucggcaccuucaaauucuacccccucgccaucggaaucuacaaaguccaacgcaaagaaauggaacccaaauaccucgaaaaagccaugcgacaacgcuacaugggccuagagucagccaccuggacagucuccaaacucaacgaaguccaauccgcccucacagucguaagcggacucggcuggaaaaaaaccaacgucuccgccgccgcccgcgaauuccucgccaaauucggcauaaacauguaa

SEQ ID NO: 8169 - RNA, 702 nt, Artificial Sequence
  derived and/or modified CDS sequence (opt11) from NRIV(9800535)__JX857328.1__N
augaucgaacuagaauuccacgacgucgccgcaaacacauccuccacauucgaccccgaaguagccuacgccaacuucaaacgcguccacacaaccggccucuccuacgaccacauccgcaucuucuacaucaaaggccgagaaauaaaaaccucccucgccaaacgcuccgaaugggaagucacccuaaaccucggaggcuggaaaaucaccgucuacaacaccaacuuccccggcaaccgcaacaaccccgucccagacgacggccucacccuccaccgccucuccggcuuccucgcccgcuaccuccuagaaaaaaugcucaaagucuccgaacccgaaaaacucaucaucaaauccaaaaucaucaacccccucgccgaaaaaaacgguaucaccuggaacgacggcgaagaagucuaccuauccuucuuccccggcuccgaaauguuccuaggaaccuuccgcuucuacccccucgccaucggcaucuacaaaguccaacgcaaagagauggaacccaaauaccuugaaaaaacaaugcgccaacgcuacaugggccucgaagccgccaccuggaccgucuccaaacucacagaaguccaauccgcccucaccgucguauccucccucggauggaaaaagaccaacgucucagccgccgccagagacuuccucgcaaaauucggcaucaacauguaa

SEQ ID NO: 8170 - RNA, 702 nt, Artificial Sequence
  derived and/or modified CDS sequence (opt11) from NRIV(Adrar)__KJ716848.1__N
augaucgaacucgaauuccacgacguugccgccaacacaucauccaccuucgaccccgaagucgccuacgccaacuucaaacgcaucuacaccaccggccuuuccuacgaccacauccgaauauucuacaucaaaggccgcgaaauaaaaaccucccuagccaaacgcuccgaaugggaagucacccucaaccucggcggcuggaaaaucaccgucuacaacaccaacuuccccggcaaccgaaacaaccccguccccgacgacggccuuacacuccaccgccucucaggcuuccucgcccgcuaccuccucgaaaaaaugcucaaaguaucagaacccgaaaaacucaucaucaaauccaaaaucaucaacccccucgccgaaaaaaacggcaucaccuggaacgacggcgaagaagucuaccucuccuucuuccccggcuccgaaauguuccucggcaccuuccgcuucuacccacucgccaucggcaucuacaaaguccaacgcaaagaaauggagccuaaauaccucgaaaaaacaaugcgccaacgcuacaugggacucgaagccgccaccuggaccguuucaaaacucaccgaaguccaauccgcacucaccgucgucuccucacucggcuggaaaaaaaccaacgucuccgccgccgcccgcgacuuccucgccaaauucggcaucaacauguaa

SEQ ID NO: 8171 - RNA, 702 nt, Artificial Sequence
  derived and/or modified CDS sequence (opt11) from NRIV(D28542/4e)__KC608154.1__N
augaucgaacucgaauuccacgacgucgccgccaacaccucauccaccuucgaccccgaagucgccuacgccaacuucaaacgagucuacaccaccggccucuccuacgaccacauccgaaucuucuacaucaaaggccgcgaaauaaaaaccucccuagccaaaagauccgaaugggaagucacccucaaccucggcggcuggaaaaucaccgucuacaacacaaacuuccccggaaaccgcaacaaccccguccccgacgacggccucacccuccaccgccucucaggcuuccucgcccgcuaccuacucgaaaaaaugcuaaaagucuccgaacccgaaaaacucaucaucaaauccaaaaucaucaacccccucgccgaaaaaaacggcaucacauggaacgacggcgaagaagucuaccuauccuucuuccccggaucagaaauguuccucggcaccuuccgcuucuacccacucgccaucggcaucuacaaaguccaacgcaaagaaauggaaccaaaauaccucgaaaaaaccaugcgccaacgauacaugggccucgaagccgccaccuggaccgucuccaaacucaccgaaguccaaucagcccucaccgucgucuccucccucggcuggaaaaaaaccaacgucuccgccgccgcccgcgacuuccuagccaaauucggcaucaacauguaa

SEQ ID NO: 8172 - RNA, 702 nt, Artificial Sequence
  derived and/or modified CDS sequence (opt11) from NRIV(SUD-HKV141)__JX857322.1__N
augaucgaacucgaauuccacgacgucgcagccaacaccuccucaaccuucgaccccgaagucgccuacgccaacuucaaacgcguccacacaaccggccucuccuacgaccacauccgcaucuucuacaucaaaggccgcgaaaucaaaaccucacucgccaaacgcucagaaugggaagucacccuuaaccucggcggcuggaaagucaccgucuacaacaccaacuuucccggcaaccgcaacaaccccguccccgacgacggccuaacccuccaccgacucuccggcuuccucgcccgcuaccuacucgaaaaaaugcucaaagucuccgaacccgaaaaacuaaucaucaaaucaaaaaucaucaacccccucgccgaaaaaaacggcaucaccuggaacgacggcgaagaagucuaccucucauucuuccccggcuccgaaauguuccuaggcacauuccgcuucuacccccucgccaucggcaucuacaaaguccaacgcaaagaaauggaacccaaauaccucgaaaagaccaugcgccaacgcuacaugggccucgaagccgcuaccuggacagucuccaaacuaacugaaguccaauccgcccucaccgucgucucuucacuaggcuggaaaaaaaccaacguauccgccgccgcccgcgacuuccucgccaaauucggcaucaacauguaa

SEQ ID NO: 8173 - RNA, 705 nt, Artificial Sequence
  derived and/or modified CDS sequence (opt11) from BWAV(M459)__NC_034480.1__N
auguccgaccucaucuucuacgacgucgacuccgucaacgccaacgaauucgaccccgacaccggcuaccucgacuucaaaaacaacuaccccggagcccucaacaccaacacagcccgcaccuucuuccucaacgccgccaaagccaaaaacguccuccgcaacaaaccagacaaaaaagucaacccaaaauucggaaacugggaagucgaagucgucaacaaccacuuccccggaaaccguaacaaccccaucggcaaagacgaccucacccuccacagaauauccggcuaccucgcccgcuggauccucgaagaauacaaacgugacgacgaauccgaaaaagaaaucaucgaauccacagucaucaaccccaucgcagaauccaacggcauccgcuggucagacggcgccgaaaucuaccuauccuucuucccaggcaccgaaauguuccucgaacccuucaaauucuacccccuagcaaucggcaucuacagagucaaacacaaaaugauggacgcccaauuccucaaaaaagcccuccgccaacgcuacggcaaaaugaccgccgaaaaauggauguccaccaaggucaaaaccaucggcgaagcaguccgaaacgucgaaaaacucaaauggggcaaaggcggccucuccgacgccgcccgcaacuuccuaaaaaaauucgacaucgccaugaucuaa

SEQ ID NO: 8174 - RNA, 705 nt, Artificial Sequence
  derived and/or modified CDS sequence (opt11) from BWAV(M459)__EU564827.1__N
auguccgaccucauauucuacgacgucgacuccguaaacgccaacgaauucgacccggacaccggcuaccuagacuucaaaaacaacuacccaggcgcccucaacacaaacaccgcccgaacauucuuccucaacgcagccaaagccaaaaacguacucagaaacaaacccgacaaaaaagucaaccccaaauucggaaacugggaagucgaagucgucaacaaccacuuccccggcaaccgaaacaaccccaucggcaaagacgaccucacccuccaccgcaucuccggcuaccucgcccgcuggauccuagaagaauacaaacgcgacgacgaaucagaaaaagaaaucaucgaaagcaccgucaucaaccccaucgccgaauccaacggcauccgcugguccgacggagccgaaaucuaccucuccuucuuccccggcaccgaaauguuccucgaacccuucaaauucuacccccucgcaaucggcaucuaccgagucaaacacaaaaugauggacgcccaauuccucaaaaaagcccuccgacaacgcuacggcaaaaugaccgcagaaaaauggauguccaccaaagucaaagcaaucggcgaagccguacgcaacgucgaaaaacucaaauggggaaaaggcggacucagcgacgccgccagaaacuuccuaaaaaaguucgacaucgccaugaucuaa

SEQ ID NO: 8175 - RNA, 705 nt, Artificial Sequence
  derived and/or modified CDS sequence (opt11) from BWAV(UgAr1888)__KJ867185.1__N
auguccgaccucaucuucuacgacgucgacagcgucaacgcaaacgaauucgaccccgacaccggcuaccucgacuucaaaaacaacuaccccggcgcccucaacacaaacacagcccgaaccuucuuccuaaacgccgccaaggccaaaaacguccuccgcaacaaacccgacaaaaaagucaaccccaaauucggcaacugggaagucgaaaucguaaacaaccacuuccccggcaaccgcaacaaccccaucggcaaagacgaccucacccuccaccgcaucuccggcuaccuagcccgcuggauccuagaagaauacaaacgcgacgacgaauccgaaaaagaaauaaucgaaucaaccgugaucaacccaaucgccgaaagcaacggcauccgcugguccgacggcgcagaaauauaccuaagcuucuucccaggcaccgaaauguuccucgaacccuucaaauucuacccccucgccauaggcaucuaccgagucaaacacaaaaugauggacgcccaauuccucaagaaagcccuccgccaacgcuacggcaaaaugaccgccgaaaaauggaugagcacaaaaguaaaagccaucggcgaagccguccgcaacgucgaaaaacucaaauggggaaaaggaggccucagcgacgccgcccgcaacuuccuaaaaaaauucgacaucgccaugauauaa

SEQ ID NO: 8176 - RNA, 708 nt, Artificial Sequence
  derived and/or modified CDS sequence (opt11) from BWAV/PGAV(SAAr1)__EU564828.1__N
auguccggcgaccuagucuucuacgacgucgacucagucaacagcaacgccuucgacccagacgccggcuacgucgccuucuccaacaaccaccccggcgcccuaaacaucaccaccgcccgaaccuucuuccucaacgccgccaaagccaaaggcguccuccgaaacaaacccgacaaaaaagucaaacccaaauucggagacugggaagucgaaaucgucaacaaccacuuccccggcaaccgcaacaacaccaucggcgaagacgaccucacacuacaccgaaucuccggauaccucgccagauggguacucgaggaacacuccaaagacgacgaauccgaaaaagaacucaucgaaagcaccaucgucaaccccaucgccgaauccaacggcauaaaauggagcgacggagccgccaucuaccucucauucuuccccggaaccgaaauguuccucgaacccuucaaauucuucccacucgccauaggcaucuaccgcgucaaacacaaaaugauggacgcccaauuccuaaaaaaagcccuccgccagcgcuacggcaaacuaaccgccgaaaaauggauggccaccaaggucaaaucaaucggcgaagccguacgcgccgucgaaaaacucaaauggggcaaaggcggcaucucagacgccgcacgcaccuuccucaagaaauucgacaucgcccuaaucuaa

SEQ ID NO: 8177 - RNA, 708 nt, Artificial Sequence
  derived and/or modified CDS sequence (opt11) from BWAV/PGAV(191B-07)__KJ867179.1__N
augagcggcgaccucguauucuacgacgucgacucagucaacagcaacgccuucgaccccgacgcaggcuacgucgcauucuccaacaaccacccaggcgcacucaacaucaccaccgcccgcaccuucuuccucaacgccgccaaagccaaaggcguccuccgaaacaaacccgacaagaaagucaaacccaaauucggcgacugggaagucgaaaucguaaacaaccacuuccccggcaaccgcaacaacaccaucggcgaagacgaccuaacccuccaccgcaucuccggauaccucgcccgauggguccucgaagaacacagcaaagacgacgaauccgaaaaagaacucaucgaaagcacaaucgucaaccccaucgccgaauccaacggcauaaaaugguccgacggagccgcaaucuaccucucauucuucccaggcaccgaaauguuccucgaacccuucaaauucuucccccucgccaucggaaucuacagagucaaacacaaaaugauggacgcccaauuccugaaaaaagcccuccgacaacgcuacgguaaacucaccgccgaaaaauggauggcaaccaaagucaaaagcauaggagaagcaguccgcgcagucgaaaaacugaaauggggcaaaggcggcaucucagacgccgcccgcacauuucuaaaaaaauucgacaucgcccucaucuaa

SEQ ID NO: 8178 - RNA, 708 nt, Artificial Sequence
  derived and/or modified CDS sequence (opt11) from CEV(283)__KX817314.1__N
auguccgaccucgucuucuacgacgucgcauccaccggcgccaacggcuucgaccccgacgccggcuacgucgacuucugcgccaaauacggcgaaucaaucaaccuagccgccguacgcaucuucuuccucaacgccgccaaagccaaagccgcccugucccgcaaaccagaacgaaaagcaaaccccaaauucggcgaauggcaagucgaagucguaaacaaccacuuccccgccaacagaaacaaccccaucggcaacaacgaccuaaccauccaccgcaucagcggauaccucgcccgcuggguccucgaacaauacaaagaaaacgaagacgaaucccaacgagaacucgucaaaaccacaguaaucaacccaaucgccgaaagcaacggcauccgcugggaaaacggcgccgaaaucuaccucgccuucuuccccggaaccgaaauguuccucgaaacauucaaauucuacccccuaacaaucggcaucuaccgagucaaaaacggcaugauggacucacaauaccucaaaaaagcacuccgccaacgcuacggcucccucaccgccgaaaaauggaugucccaaaaaacaggcaugaucgccaaaucccucaaagaagucgaacaacuaaaauggggccgcggcggccucucagacacagccagaaccuuccuccaaaaauucggaaucaaacuccccuaa

SEQ ID NO: 8179 - RNA, 708 nt, Artificial Sequence
  derived and/or modified CDS sequence (opt11) from CEV(BFS-283)__U12797.1__N
augagcgaccucgucuucuacgaugucgccucaaccggagccaacggcuucgaccccgacgcagguuacgucgacuucugcgccaaacacggggaauccaucaaccucgccgccguccgcauauucuuccucaacgccgccaaagccaaagccgcccucucccgcaaacccgaacgcaaagccaaccccaaauucggcgaauggcaagucgaagucgucaacaaccacuuccccgccaaccgcaacaaccccaucggaaacaacgaccucacgauccaccgcaucagcggcuaccuagccagauggguccucgaacaauacaaagaaaacgaagacgaaucccaacgcgaacucguaaaaaccaccguaaucaaccccaucgccgaauccaacggcauacgcugggaaaacggcgccgaaaucuaccucgccuucuucccaggcaccgaaauguuccuagaaaccuucaaauucuacccccucaccaucggcauauaccgcgucaaaaacggaaugauggacucacaauaccucaaaaaagcacuccgccaacgcuacggaagccucacagcagaaaaauggaugagccaaaaaaccggcaugaucgcaaaaucccucaaagaaguagaacaacucaaauggggacgcggcggccucagcgacaccgcacgcaccuuccugcaaaaauucggaaucaaacuccccuga

SEQ ID NO: 8180 - RNA, 708 nt, Artificial Sequence
  derived and/or modified CDS sequence (opt11) from CHATV(Mohko ILO8-3)__KF719221.1__N
auguccgaccucgucuucuacgacgucgccucaaccggcgccaauggcuucgaccccgacgaaggcuacauggccuucugcgucaaacacgcagaaucaaucucccucgcagccguacgcaucuucuuccuaaacgccgcgaaagccaaagcagcacucgccagaaaacccgaaaaaaaagccucccccaaauucggcgaauggcaagucgaaaucgucaacaaccacuucccaggcaacagaaacaaccccaucggcaacaacgaccucaccguccaccgccucuccggcuaccucgcccgcuggguccucgagcaauacaaagaaaacgaagacgaaagccaacgagaacucaucaaaacaaccgucaucaaccccaucgccgaauccaacggcguacgcugggacucaggccccgaaauauaccuauccuucuucccaggcaccgaaauguuccuagaaaccuucaaauucuacccccucaccaucggcauauaccgcgucaaacaaggcaugauggacccacaauaccucaaaaaagcccucagacaacgauacggcacccucaccgccgacaaauggaugucccaaaaaguaaccgccauagccaaaucccucaaagaagucgaacaacucaaauggggccgcggcggccuauccgacaccgcccgcaccuuccuccaaaaauucggcauccgacucccauaa

SEQ ID NO: 8181 - RNA, 708 nt, Artificial Sequence
  derived and/or modified CDS sequence (opt11) from CHATV(Mohko M07-1)__KF719224.1__N
auguccgaccucgucuucuacgacgucgccucaaccggcgccaacggcuucgaccccgacgaaggcuacauggccuucugcguaaaacacgccgaauccaucaaccuugccgccgugcgcaucuucuuccucaacgccgccaaagccaaagcagcccuggcccgcaaacccgaaaagaaagcaagccccaaauucggcgaauggcaagucgaaaucgucaacaaccacuuccccggcaacagaaacaaccccaucggcaacaacgaccucacaguccaccgccucagcggcuaccucgcccgauggguccucgaacaauacaaagaaaacgaagacgaaagccaacgcgaacucaucaaaaccaccgucauaaaccccaucgccgaaucaaacggaguccgaugggacucgggccccgaaaucuaccucuccuucuuccccggcaccgaaauguuccuagaaaccuucaaauucuacccccucaccaucggcaucuaccgcgucaaacaaggcaugauggacccccaauaccucaagaaagcccuccgccaacgcuacggcacccuaaccgccgacaaauggaugucccaaaaagucaccgcaaucgccaaaucccucaaagaagucgaacaacucaaauggggacgcggaggccucagcgacaccgcacgcacauuccuccaaaaauucggaauacgacuccccuaa

SEQ ID NO: 8182 - RNA, 708 nt, Artificial Sequence
  derived and/or modified CDS sequence (opt11) from CHATV(Mohko S07-2)__KF719233.1__N
augagcgaccucguauucuacgacgucgccucaaccggcgccaacggcuucgacccagacgaaggcuacauggcauucugcguaaaacacgcagaauccaucaaccucgccgccguacgcauauucuuccucaacgccgccaaagcgaaagccgcccuagccagaaaacccgaaaaaaaagccagcccaaaauucggagaauggcaagucgaaaucguaaacaaccacuuccccgggaaccgaaacaaccccaucggcaacaacgaccucacgguccaccgccuauccggauaccucgcccgauggguccucgaacaauacaaagaaaacgaagacgaaagccaacgcgaacucauaaaaaccaccguaaucaacccaaucgccgaaagcaacggcguacgaugggacagcggcccagaaauauaccucagcuucuuccccggcaccgaaauguuccucgaaacauucaaagucuacccccugaccacaggcaucuaccgagucaaacaagggaugauggacccacaauaccucaaaaaagcgcucagacaacgcuacggaacccuaaccgcggacaaauggaugagccaaaaagugaccgccaucgccaaaucccucaaagaaguagaacaacucaaauggggacgcggaggccucagcgacaccgcacgcaccuuccuacaaaaauucggaauacgacucccauaa

SEQ ID NO: 8183 - RNA, 708 nt, Artificial Sequence
  derived and/or modified CDS sequence (opt11) from CHATV(LEIV-11483)__FJ853592.1__N
augagcgaccucgucuucuacgacgucgcaucuaccggagccaacggcuucgaccccgacgaaggcuacauggccuucugcgucaaacacggccaaagcgucaaccucgccgccguccgcauauucuuccucaacgccgcaaaagccaaagcagcccuagccagaaaacccgaaaaaaaagccuccccaaaauucggcgaauggcaagucgaaaucgucaacaaccacuuccccggcaaccgcaacaaccccaucggcaacaacgaccucaccauccaccgccuauccggcuaccuagcccgcuggguccucgaacaauacaaagaaaacgaagacgaaagccaacgcgaacucauaaaaacaaccgucauaaaccccauagcagaauccaacggcguacgcugggacucaggcgccgaaauauaccucuccuucuuccccggcacagaaauguuccuagaaacauucaaauucuacccccucaccaucggcaucuacagagucaaacaaggcaugauggacccccaauaccuaaaaaaagcccucagacaacgcuacggcacccucaccgccgacaaauggaugucccaaaaaguaaccgccauagccaaaucccuaaaagaagucgaacagcucaaauggggccgaggcggccucagcgacaccgcccgcaccuuccuccaaaaauucggaauccgacucccauaa

SEQ ID NO: 8184 - RNA, 708 nt, Artificial Sequence
  derived and/or modified CDS sequence (opt11) from CHATV(LEIV-11552)__EU479702.1__N
auguccgaccucgucuucuacgacgucgccuccaccggagccaacggcuucgaccccgacgaaggcuacauggccuucugcgucaaacacggccaauccgucaaccucgccgccguaagaaucuucuuccucaacgccgccaaagcaaaagccgcacucgcccgaaaacccgaaaaaaaagccucccccaaauucggcgaauggcaagucgaaauagucaacaaccacuuccccggcaacagaaacaaccccauaggcaacaacgaccucaccauccaccgccucagcggcuaccuggcccgcuggauccucgaacaauacaaagaaaacgaagacgaaucccaacgcgaacucaucaaaaccaccguaaucaaccccaucgccgaauccaacggcguacgaugggacucaggcgccgaaaucuaccuguccuucuucccaggaaccgaaauguuccucgaaaccuucaaauucuacccccucaccaucggcaucuaccgcgucaaacaaggcaugauggacccccaauaccucaaaaaagcccuccgccaacgauacggcacccucaccgccgacaaauggaugucccaaaaagucaccgccaucgccaaaucccucaaagaagucgaacagcuaaaauggggacgcggaggacucuccgacaccgcccgcaccuuccuccaaaaguucggcauaagacucccauaa

SEQ ID NO: 8185 - RNA, 708 nt, Artificial Sequence
  derived and/or modified CDS sequence (opt11) from CHATV(LEIV-13107)__FJ946829.1__N
augagcgaccucguguucuacgacguggccucgaccggggccaacggcuucgacccggacgagggcuacauggcguucugcgucaagcacgggcaaucagucaaccucgcggccgugcgcauauucuuccucaacgccgccaaagcgaaagcggcccuagccaggaaaccggaaaagaaagcgaacccgaaauucggagaauggcaggucgagaucgugaacaaccacuucccagggaacaggaacaaccccauaggcaacaacgaccucacaauccaccgcuuaagcggauaccuggcccggugggugcuagagcaauacaaagagaacgaggacgagagccagcgagagcucauaaaaacaaccgugaucaaccccauagccgagagcaacggcguacgcugggacucgggagcagaaguguaccugagcuucuucccgggcacagaaauguuccuagaaacguucaaguucuacccccuaaccauaggcauauacagagucaagcaagggaugauggacccgcaauaccucaagaaagcacucaggcaacgguacgggacccugaccgcggacaaguggaugagccagaaagugaccgcgaucgcgaaaucacucaaggaaguagaacagcucaagugggggcgcgggggccugagcgacaccgcgcgcacguuccugcaaaaguucgggaucagacucccguga

SEQ ID NO: 8186 - RNA, 708 nt, Artificial Sequence
  derived and/or modified CDS sequence (opt11) from CHATV(LEIV-17794)__FJ913879.1__N
augagcgaccucguauucuacgacguagccucaaccggcgccaacggcuucgacccggacgaagguuacauggcguucugcgucaagcacggacaaucgguaaaccucgcagccguccgcauauucuuccucaacgccgcaaaagcgaaagcggcccuggccaggaaaccggaacggaaagcaagcccgaaauucggcgaguggcaaguagagaucgugaacaaccacuuccccgggaacaggaacaacccaauaggcaacaacgaccucacgauccaccgccuaagcggauaccuggccaggugggugcucgagcaauacaaagaaaacgaagacgagagccaacgcgagcucauaaaaacaaccguaaucaaccccauagccgagagcaacggcgugcgcugggacucgggcgcagaaauauaccugagcuucuucccaggcacggaaauguuccuagaaacguucaaauucuacccccugaccauaggcauauacagggucaaacaaggaaugauggacccacaauaccucaagaaagcgcucagacaaagauacgggacccuaaccgcagacaaauggaugagccagaaagugaccgcgaucgcaaaaucacucaaagaaguggaacagcucaagugggggcgaggaggccuaagcgacacagcgcgaacauuccugcaaaaguucgggaucagacuuccguga

SEQ ID NO: 8187 - RNA, 708 nt, Artificial Sequence
  derived and/or modified CDS sequence (opt11) from CHATV(LEIV-17827)__GQ330475.1__N
augagcgaccuagucuucuacgacguagccucaaccggagccaacggcuucgacccagacgaaggcuacauggccuucugcgucaaauacggggaaucaaucaaccuagccgccguacgcauauucuuccucaacgccgcaaaagcaaaagcagcccuagcccgcaaaccggaaaaaaaagccaaccccaaauucggcgaauggcaagucgaaaucgucaacaaccacuuccccgggaacaggaacaaccccaucggcaacaacgaccucaccauacaccgccucagcggcuaccuagccagauggguacucgaacaauacaaagaaaacgaagacgaaagccaacgcgaacuaaucaaaaccaccaucaucaaccccaucgccgagagcaacggcguacgaugggaaucaggcgccgaagucuaccuaagcuucuucccaggcacagaaauguuccucgaaauuuucaaauucuacccccucaccaucggcaucuaccgcgucaaacaaggcaugauggacccacaauaccucaaaaaagcacuccgacaaagauacggcacccuaaccgccgacaaauggaugagccaaaaaguaaccgcaaucgccaaaucacuaaaagaagucgaacaacucaaauggggccgcggaggccuaagcgacaccgcccgcacuuuccuacaaaaauucggcaucaggcuccccuga

SEQ ID NO: 8188 - RNA, 708 nt, Artificial Sequence
  derived and/or modified CDS sequence (opt11) from CHATV(LEIV-17829)__GQ330476.1__N
augagcgaccucguauucuacgacguagccuccaccggcgccaacggcuucgacccagacgagggcuacauggccuucugcgucaaauacggcgaaucaaucaaccucgcagccguacgcaucuucuuccucaacgccgcaaaagccaaagcagcccuagccagaaaacccgaaaaaaaagccaacccaaaauucggcgaauggcaaguagaaaucgucaacaaccacuuccccggaaacagaaacaaccccaucggaaacaacgaccucacgauccaccgccuaagcggcuaccuggcccgauggguacucgaacaauacaaagaaaacgaagacgaaagccaacgagaacucauaaaaacaaccaucaucaaccccauagccgaaagcaacggcguacgcugggacuccggcgcagaagucuaccuaagcuucuucccaggcacggaaauguuccucgaaaucuucaaauucuacccccuaaccaucggcauauacagagucaaacaagggaugauggacccacaauaccucaaaaaagcccucagacaaagauacgggacccuaaccgccgacaaauggaugagccaaaaagucaccgcaaucgcaaaaucccucaaagaaguagaacaacucaaaugggggcgcggaggccugagcgacaccgcacgcaccuuccuucaaaaauucggaauccgccuacccuaa

SEQ ID NO: 8189 - RNA, 708 nt, Artificial Sequence
  derived and/or modified CDS sequence (opt11) from CHATV(LEIV-18733)__HQ734824.1__N
augagcgaccucguguucuacgacguggccucaaccggggccaacggcuucgacccagacgaaggcuacauggcguucugcgucaaauacggggaaucaaucaaccucgcggccguacgcauauucuuccucaacgccgcaaaagcgaaagcggcccuggccaggaaaccggaaaagaaagcgaacccgaaauucggcgaguggcaggucgagaucauaaacaaccacuuccccggaaacaggaacaaccccauaggcaacaacgaccucacgauccaccgcuugagcggguaccuagccagguggguacucgaacaauacaaagagaacgaggacgaaagccagcgcgagcucauaaaaacaacaauaauaaaccccauagccgagagcaacggcgugcgcugggacucgggcgcggaaguguaccugagcuucuucccgggcacggaaauguuccuagaaauauucaaguucuacccacugaccauaggcauauacagggucaaacaagggaugauggacccacaauaccuaaagaaagcgcucaggcaaagauacgggacccugaccgcggacaaguggaugagccagaaaguaacagcgaucgcgaaaucacucaaggaaguagaacagcucaagugggggcgcgggggccugagcgacaccgcgcgcacguuccugcaaaaguucgggaucaggcucccguga

SEQ ID NO: 8190 - RNA, 708 nt, Artificial Sequence
  derived and/or modified CDS sequence (opt11) from CHATV(LEIV-18895)__GQ330482.1__N
augagcgaccucgucuucuacgacguagccuccaccggagccaacggcuucgaccccgacgaaggcuacauggccuucugcgucaaguacggcgaauccaucaaccucgccgccguacgcaucuucuuccuaaacgccgcaaaagcaaaagcagcacuagcccgcaaacccgaacgaaaagccaaccccaaauucggcgaauggcaagucgaaaucgucaacaaccacuucccaggcaaccgcaacaaccccaucggcaacaacgaccuaaccauccaccgacucuccggcuaccuagcccgauggguccuagaacaauacaaagaaaacgaagacgaaucccaacgagaacucaucaaaaccaccaucaucaaccccaucgccgaauccaacggcguccgcugggacucaggcgccgaagucuaccucagcuucuuccccggcacagaaauguuccuagaaaucuucaaauucuacccccuaacaaucggcaucuaccgagucaaacaaggccucauggacccccaauaccucaagaaagcacuccgacaacgauacggcacacucaccgccgacaaauggaugagccaaaaaguaaccgccaucgccaaaucacucaaagaaguagaacaacuaaaauggggccgcggcggccuaagcgacaccgcacgcaccuuccuacaaaaauucggaauccgccuccccuga

SEQ ID NO: 8191 - RNA, 708 nt, Artificial Sequence
  derived and/or modified CDS sequence (opt11) from CHATV(LEIV-22712)__HQ734825.1__N
augagcgaccuaguauucuacgacguggccucgaccggggccaacggauucgacccggacgagggcuacauggcauucugcgucaagcacggggaaucgaucaaccuagcagccguccgcauauucuuccuaaacgccgcgaaagcgaaagcggcccuggccaggaagccggaaaagaaagcaagcccgaaauucggcgaguggcaggucgagaucauaaacaaccacuuccccgggaaccggaacaaccccauaggcaacaacgaucucacaauccaccgccugagcggguaccuggccagauggguacucgagcaauacaaagagaacgaggacgagagccagcgcgagcucauaaaaacgacagugaucaaccccauagccgagagcaacggcgugcgcugggacucgggagcggaaauauaccugaguuucuucccggguacggaaauguuccuggaaacauucaaguucuacccccugaccauaggcauauacagagucaagcaagggaugauggacccacaauaccucaagaaagcgcucaggcaaagauacgggacccuaaccgcggacaaguggaugagccagaaagugaccgcgaucgcaaaaucgcuaaaggaaguggaacagcuaaaguggggacgagggggccugagcgacaccgcacgcacguuccugcaaaaauucgggaucagacuccccuga

SEQ ID NO: 8192 - RNA, 708 nt, Artificial Sequence
  derived and/or modified CDS sequence (opt11) from CHATV(LEIV-23500)__EU479701.1__N
augagcgaccucgucuucuacgacgucgccuccaccggcgccaacggcuucgaccccgacgcgggcuacauggccuucugcgucaaacacggagaaucaaucaaccucgccgccguacgcauauucuuccuaaacgccgcaaaagcaaaagccgcacucgcccgaaaacccgaaaaaaaagcaaacccaaaauucggcgaauggcaagucgaaaucgucaacaaccacuuccccggaaaccgaaacaaccccaucggcaacaacgaccucacgauccaccgccuaagcggauaccuagcccgauggguccuagaacaauacaaagaaaacgaagacgagagccaacgcgaacucaucaaaaccaccgucaucaaccccaucgccgaaagcaacggcguccgaugggaaaacggcgccgaagucuaccucagcuucuucccaggcacagaaauguuccucgaaaccuucaaauucuacccccuaacaauaggcauauaccgcgucaaacaaggaaugauggacccacaauaccucaaaaaagcacucagacaacgauacggaacccucaccgcagacaaauggaugagccaaaaaguaacagccaucgccaaaucccuaaaagaaguagaacaacucaaauggggccgcggaggacuaagcgacaccgcccgcacauuccuacaaaaauucgggauccgacuccccuaa

SEQ ID NO: 8193 - RNA, 708 nt, Artificial Sequence
  derived and/or modified CDS sequence (opt11) from INKV__Z68496.1__N
augggcgaccucguauucuacgacgaagccuccaccggcgccaacggauucgacccagacgcaggcuucgucgccuucauggcagaccacggcgaaucuaucaaccucgccgccguccgcaucuucuuccucaacgccgccaaagccaaagccgcccucgcccgcaaacccgaaagaaaagccacccccaaauucggcgaauggcaagucgaaaucgucaacaaccacuuccccggcaaccgcaacaacccuaucggcaacaacgaccuaaccauccaccgccucuccggcuaccucgcccgcuggguccucgaacacuucaccgaagacgacgacgaaucccaaagagaacucauccgcuccaccaucaucaacccaauagccgaauccaacgguauccacuggaacaacggccccgaaauauaccuauccuucuuccccggcaccgaaauguuccucgaagucuucaaauucuacccccucacaaucggcaucuaccgcgucaaacacggcaugauggacccccaauaccucaaaaaagcccuacgccaaagauacggaacccucaccgccgaaaaauggauggcccaaaaaaccguccucaucgcaaaaucccucaaagacgucgaacaacucaaauggggccgcggcggccucagcgacgccgcccgcacauuccucaucaaauucggcgucaaacuccccuaa

SEQ ID NO: 8194 - RNA, 708 nt, Artificial Sequence
  derived and/or modified CDS sequence (opt11) from INKV(KN3641)__U47137.1__N
augggcgaccucgucuucuacgacgucgcaagcaccggcgcaaacgguuucgacccagacgcuggcuucgucgccuucauggccgaccacggcgaauccauaaaccucgcagccguccgcauauucuuccuaaacgccgccaaagccaaagccgcccucgcccgcaaacccgaacgaaaagccaccccaaaauucggcgaauggcaagucgaaaucguaaacaaccacuuccccggcaaccgaaacaaccccaucggcaacaaugaccucaccauccaccgccucuccggcuaccucgcccgcuggguccucgaacacuucacggaagacgacgacgaaucccaacgcgagcucauccgcucaaccaucaucaacccaaucgccgaauccaacggcauccacuggaacaacggccccgaaaucuaucuauccuucuuccccggcaccgaaauguuccucgaagucuucaaauucuacccccucaccaucggcaucuaccgagucaaacacggcaugauggacccccaauaccuaaaaaaagcacuccgccaacgcuacggcacccucaccgccgaaaaauggauggcccaaaaaaccguccucaucgccaaaucccucaaagacgucgaacaacuaaaauggggccgaggcggccucuccgacgcagcccgcaccuuccucaucaaauucggagucaaacuccccuaa

SEQ ID NO: 8195 - RNA, 708 nt, Artificial Sequence
  derived and/or modified CDS sequence (opt11) from INKV(Lovanger)__KU302751.1__N
augggcgaccucgucuucuacgacgucgccucaacaggcgccaacggcuucgaccccgacgccggauucgucgccuucauggccgaccacggcgaauccaucaaccucgccgccguccgcaucuucuuccuaaacgccgccaaagccaaagccgcccuagcccgcaaacccgaacgcaaagcaaccccaaaauucggcgaauggcaagucgaaaucgucaacaaccacuuccccgguaaccgaaacaaccccaucggcaacaacgaccucaccauccaccgccucuccggauaccucgcccgcuggguccuagaacacuucaccgaagacgacgacgaaagccaacgagaacucauccgauccaccaucaucaacccaaucgccgaaucaaacggcauccacuggaacaacggccccgaaaucuaccucuccuucuucccaggaaccgaaauguuccucgaagucuucaaauucuacccccucaccauaggcaucuaccgugucaaacacggcaugauggacccccaauaccuaaaaaaagcccuccgacaacgcuacggcacccuaaccgccgaaaaauggaugacccaaaaaaccguccucaucgccaaaucccuaaaagacgucgaacaacucaaauggggccgaggaggccuaucagacgccgcccgcacauuccucaucaaauucggcgucaaacuacccuga

SEQ ID NO: 8196 - RNA, 708 nt, Artificial Sequence
  derived and/or modified CDS sequence (opt11) from INKV(SW AR 83-161)__U47138.1__N
augggugaccucgucuucuacgacgucgccuccacaggagccaacggcuucgaccccgacgccggcuucgucgcauucauggccgaccacggagaaucaaucaaccucgccgccguacgcaucuucuuccucaacgccgcaaaagccaaagccgcacucgcccgaaaacccgaacgcaaagccacccccaaauucggcgaauggcaagucgaaaucgucaacaaccacuuccccggaaaccgaaacaaccccaucggcaacaacgaccucaccauccacagacucuccggauaccuggcccgcuggguacucgaacacuucaccgaagacgacgacgaaucccaacgagaacucauccgcuccaccaucaucaaccccaucgccgaauccaacggcauccacuggaacaacggcccagaaauauaccucucauuccucccaggcaccgaaauguuccuagaagucuucaaauucuacccccucaccaucggcaucuaccgcgucaaacacggcaugauggacccccaauaccuaaaaaaagcccuccgccaacgauacggcacccucaccgccgaaaaauggauggcccaaaaaaccguccucaucgccaaaucccucaaagacgucgaacaacucaaauggggacgcggcggccuaucagacgccgcccgcacauuccucauaaaauucggcgucaaacuccccuaa

SEQ ID NO: 8197 - RNA, 708 nt, Artificial Sequence
  derived and/or modified CDS sequence (opt11) from LUMV__X73468.1__N
auguccgaccucgucuucuacgacgucgcauccaccggcgccaacggcuucgaccccgacgccggcuacgucgacuucugcgucaaacacggcgaauccaucaaccuccacuccguccgcaucuucuuccucaacgccgccaaagccaaagccgcccuagcccgaaaacccgaacgcaaagccucacccaaauucggcgaauggcaagucgaaaucgucaacaaccacuucccaggcaaccgcaacaaccccaucgacaacaacgaccucaccauccaccgccucuccggauaccuagcccgcuggguccuagaacaauucaaagaaaacgaagacgccgcccaacgcgaacucaucaaaaccacagucaucaaccccaucgccgaaucaaacggcauacgcugggacaacggcgcagaaaucuaccucgccuucuuccccggcacagaaauguuccucgaaaccuucaacuucuauccccucaccaucggcaucuacagagucaaacacggcaugauggacccacaauaccucaaaaaagcccucagacgccgauacggcagccucaccgcagacaaauggaugucccaaaaaaccgucgccaucgccaaaucccucaaagacguagaacaacucaaauggggccguggcggccucuccgacacagcccgcgucuuccuacaaaaauucggcaucaaacuccccuaa

SEQ ID NO: 8198 - RNA, 708 nt, Artificial Sequence
  derived and/or modified CDS sequence (opt11) from LUMV(SAAr 1881)__KX817326.1__N
auguccgaccucgucuucuacgacgucgccucaaccggagccaacggcuucgaccccgacgccggcuacgucgacuucugcgucaaacacggagaauccaucaaccuccacuccguccgcauauucuuccucaacgccgccaaagccaaagccgcacucgcccgcaaacccgaacgcaaagccucacccaaauucggcgaauggcaagucgaaaucgucaacaaccacuuccccggcaaccgcaacaaccccaucgacaacaacgaccucacaauccaccgacuguccggcuaccucgcccgcugggugcuagaacaauucaaagaaaacgaagacgccgcccaacgcgaacucauaaaaaccaccgucaucaaccccaucgcagaauccaacggaauccgcugggacaacggcgccgaaaucuaccucgccuucuuccccggcaccgaaauguuccucgaaaccuucaacuucuacccccucaccaucggcaucuaccgagucaaacacggcaugauggacccccaauaccucaaaaaagcccuccgacaacgcuacggcagccucaccgccgacaaauggaugucccaaaaaaccgucgccaucgcaaaaagccucaaagacgucgaacaacucaaauggggccgaggcggccucuccgacaccgcacgcgucuuccuccaaaaauucggcaucaaacucccauaa

SEQ ID NO: 8199 - RNA, 708 nt, Artificial Sequence
  derived and/or modified CDS sequence (opt11) from MELV(TRVL 9375)__KX817329.1__N
augggcgaccucaucuucuacgacgucgccucaaccggcgccaacggcuucgaccccgacgcaggcuaccucgccuucaccauagcccacggcgaagccaucaaccucucagccguccgcauauucuuccucaacgcagccaaagcaaaagccgcacuaucccgaaaacccgagcgcaaagcaacccccaaauucggcgacuggcaagucgaaaucgucaacaaccacuucccaggcaaccgcaacaaccccaucggcaacaacgaccucaccauacaccgccucuccggcuaccucgcccgcuggguccucgaccucuucaaagaaaacgaagacgaaucccaaaaagaacucauccaauccaccaucaucaaccccauagccgaauccaacggcauccacugggcaaacggcgucgaaaucuaccucuccuucuuccccggcaccgaaauguuccucgaagccuuccgauucuacccccucaccaucggcaucuaccgggucaaacacggccucauggacccccaauaccucaaaaaagcccuaagacaacgcuacggcacccucaccgccgacaaauggauggcccaaaaaaccaccaugaucgccaaaucccuaaaagacgucgaacaacucaaauggggcaaaggcggccuauccgacgccgcccgaaccuuccuccaaaaauucggcguccgacuacccuaa

SEQ ID NO: 8200 - RNA, 708 nt, Artificial Sequence
  derived and/or modified CDS sequence (opt11) from MBV__U31989.1__N
augagcgaccucgucuucuacgacgucgcaucaaccggcgccaacggcuucgaccccgacgccggcuacgucgacuucugcgccaaacacggcgaaucaaucaaccucgccgccguccgcaucuucuuccucaacgccgcaaaagccaaagccgcccucucccgcaaacccgaacgcaaagcaaacccaaaauucggcgaauggcaagucgaaaucgucaacaaccacuuccccgccaaccgaaauaaccccauaggaaacaacgaccucacaauccaccgcaucuccggauaccuagcccgcuggguccucgaacaauaccgagaaaacgaagacgaaagccaacgagaacucgucaaaaccaccgucauaaaccccaucgccgaauccaacggcauccgcugggaaaacggccccgaaaucuaccucgccuucuucccaggcacagaaauguuccuagaaaccuucaaauucuacccccucaccauaggcauauaccgaguaaaacacggcaugauggacccccaguaccucaagaaagcccuccgccaacgcuacggcagccuaaccgccgaaaaauggaugucccagaaaacaggcaugaucgccaaaucccucaaagaaguagaacaacucaaaugggggcgcggaggacuaagcgacaccgcccgaaccuuccuccaaaaauucggaauccgccucccauaa

SEQ ID NO: 8201 - RNA, 708 nt, Artificial Sequence
  derived and/or modified CDS sequence (opt11) from SAV(VR723)__U47139.1__N
auguccgaacucguauucuacgacgucgccuccaccggcgccaauggcuucgacccagacgccggcuaccucgccuucugcgucaaacacggcgaauccaucucccucuccucaguccgcaucuucuuccucaacgccgccaaagccaaagccgcccucucccgcaaaccagaacgaaaagccaaccccaaauucggagaauggcaagucgaaaucgucaacaaccacuuccccggaaaccgcaacaaccccauagacaaccuagaccucaccauccaccgccucuccggcuaccuagcccgauggguccucgaacaauucaucgagaacgaagacgaaucccaacgagaacuuauaaaaacaaccguaaucaaccccauagccgagagcaacggcaucaaaugggaaaacggcgccgaaaucuaccucuccuucuucccaggcaccgaaauguuccuagaaaucuucaaauucuacccccugaccaucggcaucuaccgcgucaaacaaggcaugauggacccacaauaccucaagaaagcccuccgccaacgcuacggaucacucaccgccgacaaauggaugucccaaaaagucggcgccauagccaaaucccucaaagacaucgaacaacucaaauggggcaaaggaggccucuccgacaccgcccgcaccuuccuccaaaaauucggcaucaaacucccauaa

SEQ ID NO: 8202 - RNA, 708 nt, Artificial Sequence
  derived and/or modified CDS sequence (opt11) from SDNV(BeAr 103645)__U47140.1__N
augggcgaccucguauucuacgacgucgcaucaacaggagccaacggcuucgaccccgacgccggcuucgucgccuucauggccggacacggcgaauccaucaaccucaccgccguccgaaucuucuuccucaacgccgccaaagccaaagccgcccucagccgcaaaccagaacgaaaagccacccccaaauucggcgacuggcaagucgagaucgucaacaaccacuuccccggcaaccgaaacaacccaaucggcaacaacgaccucacgauccaccgcaucucaggcuaccucgcccgcuggacccucgagcacuuccgagaaggcggagacgaagcccaaaaagaacucauccgcaccaccaucaucaaccccaucgcagaaagcaacggcauccacugggccaacggcgccgaaaucuaccucuccuucuuccccggcacagaaauguuccucgaagccuucaaauucuacccccuaaccaucggcauauaccgcgucaaacacggaaugauggacgcccaauaccuaaaaaaagcccuccgccaaagauacggcacccuuaccgccgacgaauggauggcccaaaaaaccguacuaaucaccaaaucccucaaagacguagaacaacucaaauggggccgcggcggccucuccgacgccgcccgcaccuuccucuccaaauucggagucaaacucccauga

SEQ ID NO: 8203 - RNA, 708 nt, Artificial Sequence
  derived and/or modified CDS sequence (opt11) from SDNV(BeAr 103645)__KX817335.1__N
augggcgaccucgucuucuacgacgucgccuccaccggcgccaacggcuucgaccccgacgcaggcuucgucgcauucauggccggccacggcgaaucaaucaaccucaccgccguccgcaucuucuuccucaacgccgccaaagccaaagccgcccucucacgcaaacccgaacgcaaagcaacccccaaauucggcgacuggcaagucgaaaucgucaacaaccacuuccccggaaaccgcaacaaccccaucggcaacaacgaccucaccauccaccgaaucuccggcuaccuagcccgcuggacacuagaacacuuccgcgaaggcgaagacgaagcccaaaaagaacucauccgcacgaccaucaucaaccccaucgccgaauccaacggcauccacugggccaacggcgcagaaaucuaccucucauucuuccccggcaccgaaauguuccucgaagccuucaaauucuacccucucaccaucggcaucuaccgagucaaacacggaaugauggacgcacaauaccucaaaaaagcccuacgccaacgcuacggcacccucaccgccgacaaauggauggcccaaaaaaccguccucaucaccaaaucacucaaagacgucgaacaacucaaauggggccgaggcggccucuccgacgccgccagaaccuuccucuccaaauucggcgucaaacuccccuaa

SEQ ID NO: 8204 - RNA, 708 nt, Artificial Sequence
  derived and/or modified CDS sequence (opt11) from SSHV__EU294510.1__N
augagcgaccuaguguucuacgacguggccucgaccggggccaacggcuucgaccccgacgcgggcuacauggcguucugcgucaaauacgcggaaucggucaaccucgcggccgugcgcauauucuuccucaacgccgcaaaagcgaaagcggcacuaagcaggaaaccggaaagaaaagcgaacccgaaauucggcgaguggcaggucgaagucgugaacaaccacuuccccgggaacagaaacaaccccauaaacucagacgaccucacgauccaccgccugagcggguaccuggccagaugggugcucgagcaauacaaagagaacgaggacgagagcaggcgcgagcucauaaaaacgaccauaaucaaucccauagccgaaagcaacggcguacgcugggacucaggcgcggaaauauaccugagcuucuucccgggcacagaaauguucuuagaaacguucaaauucuacccccugaccauaggcauauacagggucaaacaaggaaugauggacccgcaauaccucaagaaagcgcucaggcaaagguacgggagcuuaaccgcagacaaauggaugagccagaaagugaccgcgaucgcaaaaucgcucaaggaaguagaacagcuaaagugggggcgcgggggccugagcgacaccgcgcgaucguuccugcaaaaguucgggaucaggcuaccguga

SEQ ID NO: 8205 - RNA, 708 nt, Artificial Sequence
  derived and/or modified CDS sequence (opt11) from SSHV(F10838)__KM215563.1__N
augagcgaccucguguucuacgacguagccucaaccggggccaacggcuucgacccggacgcgggcuacauggcguucugcgucaaguacgcggaaucggucaaccucgcggccgugcgcauauucuuccucaacgccgcaaaagcgaaagcggcccugagcagaaaaccggaaaggaaagcaaacccgaaauucggcgaauggcaggucgaggucgugaacaaccacuuccccgggaacagaaacaaccccauaaacucagacgaccucacgauacaccgccuaagcggguaccuagccagguggguacucgagcaauacaaagaaaacgaggacgagagcaggcgcgagcucauaaaaacgaccauaaucaaccccaucgccgagagcaacggcgugagaugggacucgggcgcggaaauauaccugagcuucuucccaggcacggaaauguuccuagaaacguucaaguucuacccccuaaccauaggcauauacagggucaagcaaggaaugauggacccgcaauaccucaagaaagcgcucaggcaaagauacggaagccugaccgcggacaaguggaugagccaaaaagugaccgcaaucgcgaaaucgcucaaggaaguggaacagcucaaguggggacgcggaggccuaagcgacaccgcgcgaucgcuccuacaaaaauucgggaucaggcucccauga

SEQ ID NO: 8206 - RNA, 708 nt, Artificial Sequence
  derived and/or modified CDS sequence (opt11) from SORV(SORV-252)__GU018050.2__N
augggcgaccuuguauucuacgacgucgccuccaccggcgccaacggcuucgaccccgacgcaggcuucgucgccuucauggcagaccacggcgaauccauuucccucucagccguccgcauauucuuccucaacgccgccaaagccaaagccgcacucgcccgaaaacccgaacgcaaagcaaaccccaaauucggagaauggcaagucgaaaucguaaacaaccacuuccccggcaaccgcaacaaccccauaggcaacaacgaccucaccauccaccgccucuccggcuaccucgcccgcuggguccucgaacacuucaccgaagacgaagacgaaucccaacgcgaacuaauacgcuccaccaucaucaacccaaucgccgaauccaacggcauccgcuggaacaacggcccagaaaucuaccucuccuucuuccccggcaccgaaauguuccuagaagccuucaaauucuacccccucaccaucggcaucuaccgcgucaaacacggacucauggacccccaauaccucaaaaaagcccuacgccaaagauacggcacccucaccgccgaaaaauggauggcccaaaaaaccguccugaucgccaaaucccuaaaagacgucgaacaacucaaauggggccgcggaggccucuccgacgccgcccgcaccuuccuaauaaaauucggagucaaacuccccuaa

SEQ ID NO: 8207 - RNA, 708 nt, Artificial Sequence
  derived and/or modified CDS sequence (opt11) from SORV(NJO 94F)__U47141.1__N
augggcgaccuaguauucuacgacguagcaucaaccggagccaacggcuucgaccccgacgccggcuucguagccuucauggccgaccacggcgaaucaaucaaccucagcgcaguccgcaucuucuuccucaacgcagccaaagccaaagccgcccucgcccgcaaaccagaacgaaaagccaacccaaaauucggcgaauggcaagucgaaaucgucaacaaccacuuccccggcaaccgcaacaacccaaucggaaacaacgaccucaccauccaccgccucuccggcuaccucgcacgcuggguccuagaacacuucaccgaagacgaagacgaaucccaacgcgaacucauccgcagcaccaucauaaaccccaucgccgaauccaacggcauccacuggaacaacggccccgaaaucuaccucagcuucuuccccggcaccgaaauguuccucgaagccuucaaauucuacccccuaaccaucggcaucuaccgcgucaaacacggaaugauggacccacaauaccucaaaaaagcacuacgacaacgauacggcacccucaccgccgaaaaauggauggcccaaaaaaccguccuaaucgccaaaucacucaaagacgucgaacaacucaaauggggacgcggaggccuauccgacgccgcccgcacauuccuaaucaaauucggagucaaacuccccuaa

SEQ ID NO: 8208 - RNA, 708 nt, Artificial Sequence
  derived and/or modified CDS sequence (opt11) from SORV(NJO-94F)__KX817338.1__N
augggcgaccucgucuucuacgacgucgccucaaccggcgcgaacggcuucgaccccgacgccggcuucgucgcauucauggccgaccacggcgaauccaucaaccucuccgcaguccgcaucuucuuccucaacgccgccaaagccaaagccgcccucgcccgcaaacccgaacgcaaagccaaccccaaauucggcgaauggcaagucgaaaucguaaacaaccacuuccccggcaaccgcaacaaccccaucggcaacaacgaccucacaauccaccgacucuccggcuaccuagcccgauggguacucgagcacuucaccgaagacgaagacgaaagccaacgcgaacuaaucagauccaccaucaucaacccaaucgcugaauccaacggcauccacuggaacaacggccccgaaaucuaccuaucauucuuccccggcaccgaaauguuccucgaagccuucaaauucuacccccuaaccaucggcaucuaccgcgucaaacacggccucauggacccacaauaccucaaaaaagcccuccgacaacgcuacggaacccuaacagccgaaaaauggauggcacaaaaaaccguccuaaucgccaaaucccucaaagacgucgaacaacuaaaauggggccgaggcggccuauccgacgccgcccgcaccuuccucauaaaauucggcgucaaacuccccuaa

SEQ ID NO: 8209 - RNA, 708 nt, Artificial Sequence
  derived and/or modified CDS sequence (opt11) from TAHV__Z68497.1__N
augagcgaccucgucuucuaugacgucgccuccaccggagccaacggcuucgaccccgacgccggcuacgucgacuucugcaucaaacacggggaagccauaaaccuccacuccguacgcaucuucuuccuaaacgccgccaaagcaaaagccgcccucgcccgcaaacccgaacgcaaagccagccccaaauucggcgaauggcaagucgaagucguaaacuaccacuuccccggaaaccgcaacaaccccaucgacaacaacgaccucaccauccaccgacucuacggcuaccucgcacgauggguccucgaacaauucaaagaaaacgaagacgccgcccaacgcgaacucaucaaaaccaccgucaucaaccccaucgccgaauccaacggcauccgcugggacaacggcgccgaaaucuaccuagccuucuuccccggcaccgaaauguuccuagaaaccuucaacuucuacccccucaccaucggcaucuaccgcgucaaacaaggcaugauggacccacaauaccucaaaaaagcccuacgccaacgcuacggcucccuaaccgccgacaaauggaugucccaaaaaaccaccgccaucgcaaaaucccucaaagacgucgaacaacucaaauggggccgcggcggccuuagcgacaccgcccgaaccuuccuccaaaaauucggcauccgccuccccuaa

SEQ ID NO: 8210 - RNA, 708 nt, Artificial Sequence
  derived and/or modified CDS sequence (opt11) from TAHV(22595-6)__HM036217.1__N
auguccgaccucgucuucuacgacgucgcauccacuggcgccaacggcuucgaccccgacgccggcuacgucgacuucugcaucaaacacggcgaagccaucaaccuccacuccguccgcaucuucuuccucaacgccgccaaagcaaaagccgcccucgcccgcaaacccgaacgcaaagccucccccaaauucggcgaauggcaagucgaagucguaaacaaccacuuccccggcaaccgaaacaaccccaucgacaacaacgaccucaccauccaccgccucagcggcuaccuagcccgcuggguccucgaacaauucaaagaaaacgaagacgccgcccaacgagaacuaaucaaaaccaccgucaucaaccccaucgccgaauccaacggcauccgcugggacaacggcgccgaaauauaccucgccuucuucccaggcaccgaaauguuccucgaaaccuucaacuucuacccccuaaccauaggcaucuaccgcgucaaacaaggaaugauggacccucaauaccucaaaaaagcccuccgccaacgauacggcucccuaaccgccgacaaauggaugucccaaaaaaccaccgccaucgccaaaucccucaaagacgucgaacaacucaaauggggacgcggaggccucuccgacaccgcccgaaccuuccuccaaaaauucggcauccgccucccauaa

SEQ ID NO: 8211 - RNA, 708 nt, Artificial Sequence
  derived and/or modified CDS sequence (opt11) from TAHV(NM08003)__HQ541823.1__N
augucagaccuagucuucuacgacguagccuccaccggagccaacggcuucgaccccgacgcaggcuacgucgacuucugcaucaaacacggcgaagccaucaaccuccacucaguacgcaucuucuuccucaacgccgccaaagccaaggccgcccucgcccgcaaaccagaacgcaaagccagccccaaauucggagaauggcaagucgaagucgucaacaaccacuuccccggcaacagaaacaaccccaucgacaacaacgaccuaaccauccaccgccucuccggauaccuagcccgcuggguccuagaacaauucaaagaaaacgacgacgccgcccaacgcgaacucaucaaaaccaccguaaucaaccccauagcagaauccaacggaauccgcugggacaacggcgccgaaaucuaccucgccuucuuccccggcaccgaaauguuccucgaaacauucaacuucuacccccucacaaucggcaucuaccgcgucaaacaaggcaugauggacccccaauaccucaaaaaagcccuccgccaacgcuacggcucacucaccgccgacaaauggaugucacaaaaaaccaccgccaucgccaaaucccucaaagacgucgaacaacucaaauggggccgcggcggccucuccgacaccgccagaacauuccuccaaaaauucggcauacgccuccccuag

SEQ ID NO: 8212 - RNA, 708 nt, Artificial Sequence
  derived and/or modified CDS sequence (opt11) from TAHV(XJ0625)__EU622820.2__N
auguccgaccucgucuucuacgacguagccuccaccggagccaacggcuucgacccagacgccggcuacguagacuucugcgucaaauacggcgaagccaucaaccuccacuccguccgcaucuucuuccuaaacgccgccaaagccaaagccgcccucgcccgcaaacccgaacgcaaagccucccccaaauucggagaauggcaagucgaagucgucaacaaccacuuccccggcaaccgcaacaaccccaucgacaacaacgaccucaccauccaccgacuauccggcuaccucgcacgcuggguccucgaacaauucaaagaaaacgaagacgccgcccaacgugaacucaucaaaacaaccguaaucaaccccaucgccgaauccaacggcauccgcugggacaacggcgccgagaucuaccucgccuucuuccccggcaccgaaauguuccucgaaaccuucaacuucuacccccucaccaucggcaucuaccgagucaaacaaggcaugauggacccccaauaccucaaaaaagcccuccgacaacgcuacggcccccuaaccgcagacaaauggaugucccaaaaaaccgucgccaucgccaaaucccuaaaagacgucgaacaacucaaauggggcagaggaggccuauccgacaccgcacgaaccuuccuccaaaaauucggcauacgccuccccuaa

SEQ ID NO: 8213 - RNA, 708 nt, Artificial Sequence
  derived and/or modified CDS sequence (opt11) from TAHV(XJ0708)__HM243139.1__N
auguccgaccucgucuucuacgacgucgccuccacaggcgccaacggcuucgaccccgacgccggcuacgucgacuucugcgccaaauacggcgaagccaucaaccuccacucaguccgcaucuucuuccuaaacgcagcaaaagccaaagccgcccuagcccgcaaaccagaacgcaaagccucccccaaauucggcgaauggcaagucgaagucgucaacaaccacuuccccggcaaccgcaacaaccccaucgacaacaacgaccucacaauccaccgccucucaggcuaccuagcccgcuggguccucgaacaauucaaagaaaacgaagacgccgcacaacgcgaacucauaaaaacaaccgucaucaaccccaucgccgaauccaacggcauccgaugggacaacggcgccgaaaucuaccucgccuucuuccccggcaccgaaauguuccucgaaaccuucaacuucuacccccucaccaucggcaucuaccgcguaaaacaaggcaugauggacccccaauaccucaaaaaagcccuccgccaacgcuacggcccccucacagccgacaaauggaugucucaaaaaacugucgccaucgccaaaucccucaaagacguagaacaacucaaauggggccgcggcggccucuccgacacagcccgcaccuuccuccaaaaauucggaauccgcuuacccuaa

SEQ ID NO: 8214 - RNA, 708 nt, Artificial Sequence
  derived and/or modified CDS sequence (opt11) from TVTV(AR42)__KX891323.1__N
augagcgaacucguauucuacgacgcccccuccaccggggccaacggauucgaccccgacgccggcuacgucgccuucaucgccgcacacgcaggcucauacgaccucucagccguccgcauauucuuccucaacgccgcaaaagcaaaaaacgcccucagccgcaaacccgaaggcaaagucagcaucaaauucggcgaauggucagucgaagucguaaacaaccacuuccccggcaaccgaaacaaccccaucggcaacaacgaccucaccauccaccgaaucuccggcuaccucgccagauggguccucgaagaauucaaaggacaagacgacgaagcacaaaaagacaucauccgcucaaccaucgucaaccccaucgccgaaagcaacggcauacacugggacuccggcgcggacgcauaccuauccuucuucccgggcaccgaaauguuccucgaauccuucgacuuccucccccuagccaucggcaucuacagagucaaaaacggcaugauggacgugcaauaccucaaaaaagcgcucagacaacgcuacggcaccaugaccgccgacaaauggaugagcacaaaaacaaccgucaucgccaaaacccucaaacgcguagaaucauucaaauggggaaaaggcggccucagcgaagccgcacgcgccuuccucuccaaauucaacgucaaaaucccauaa

SEQ ID NO: 8215 - RNA, 708 nt, Artificial Sequence
  derived and/or modified CDS sequence (opt11) from TVTV(ND3374)__KM215564.1__N
augagcgaacucguauucuacgacgcacccucgacaggggcaaacggcuucgacccggacgccggcuacgucgcguucauagccgcacacgcgggcucauacgaccucucggccgugcgcauauucuuccucaacgccgcaaaagccaaaaacgcacuaagcagacgcccagaaggaaaaguaagcauaaaauucggcgaauggucagucgaagucguaaacaaccacuuccccggcaacagaaacaaccccauaggcaacaacgaccucaccauacaccgaaucagcggauaccuagcaaggugggugcucgaagaguucaaaggacaagacgacgaagcccaaaaagacaucauacgcucaaccauagucaacccaauagcagaaagcaacggcauacacugggacucgggcgcggacgcauaccucagcuucuuccccggcaccgaaauguuccuagaaucguucgacuuccuaccccuagccaucggcauauacagagucaagaacggaaugauggacgugcaauaccuaaagaaagcacucagacaaagguacggcaccaugaccgcggacaaauggaugagcacaaaaaccaccguaaucgcgaaaacacuaaagcgcguagaaucauucaaauggggcaaagggggccuaagcgaagccgcacgagcauuccugagcaaguucaacgucaaaaucccauaa

SEQ ID NO: 8216 - RNA, 708 nt, Artificial Sequence
  derived and/or modified CDS sequence (opt11) from JCV(3324-04)__HM007356.1__N
augggcgaccucguauucuacgacgucgccuccaccggcgccaacggcuucgaccccgacgccggcuucgucgccuucauggccgaccacggcgaauccgucucccucucagccguacgaaucuucuuccucaacgccgccaaagcaaaagccgcccucgcccgcaaacccgaacgcaaagccacccccaaauucggcgaauggcaaguagaaauagucaacaaccacuuccccggcaaccgaaacaaccccaucggaaacaacgaccucaccauccaccgccuauccggcuaccucgcccgcuggguccucgaacacuucaccacagacgacgacgaaucacaacgcgaacucauacgauccaccaucaucaaccccaucgccgaaucaaacggcauccacuggaacaacggccccgaaaucuaccucucauucuuccccggcaccgaaauguuccuggaaaucuucaaauucuacccccucaccauaggcauauaccgcgucaaacacggcaugauggacccccaauaccucaaaaaagcccuacgccaacgcuacggcacccucaccgccgaaaaauggauggcccaaaaaaccguccucaucgccaaaucccucaaagacgucgaacaacucaaauggggccgaggcggccucuccgacgccgcccgcaccuuccuaaucaaauucggcgucaaacuacccuaa

SEQ ID NO: 8217 - RNA, 708 nt, Artificial Sequence
  derived and/or modified CDS sequence (opt11) from JCV(61v2235)__U12796.1__N
augggcgaccuaguauucuacgacguagccuccaccggcgcaaacggcuucgacccagacgccggcuucgucgccuucauggccgaccacggcgaauccaucaaccucagcgcaguccgaauauucuuccuaaacgccgccaaagccaaagccgcccuagcccgcaaacccgaacgaaaagcaacccccaaauucggcgaauggcaagucgaaaucgucaacaaccacuucucaggcaaccgcaacaaccccaucggcaacaacgaccucaccauccaccgacucuccggcuaccucgcacgcuggguccucgaacacuucaacuccgacgacgacgaaucccaacgcgaacuaauccgcuccaccaucaucaaccccaucgcagaauccaacggcauccacuggaacaacggcccagaaaucuaccucucauucuuccccggcaccgaaauguuccucgaaaucuucaaauucuacccccucaccaucggcaucuaccgcgucaaacacggcaugauggacccccaauaccucaaaaaagcacuccgucaacgcuacggcacccucaccgcagaaaaauggauggcccaaaaaaccguccuaaucgccaaaucacucaaagacgucgaacaacucaaauggggacgcggcggacucagcgacgccgcccgaacauuccucaucaaauucggcgucaaacuaccauaa

SEQ ID NO: 8218 - RNA, 708 nt, Artificial Sequence
  derived and/or modified CDS sequence (opt11) from JCV(1064-03)__EF681816.1__N
augggcgaccucgucuucuacgacgucgccuccaccggagccaacggcuucgaccccgacgcaggcuucgucgccuucauggccgaccacggcgaagccauaaaccucgcagcaguacgcaucuucuuccucaacgccgcaaaagccaaagccgcccucgcacgcaaacccgaacgaaaagccaccccaaaauucggagaauggcaagucgaaaucgucaacaaccacuucccaggcaaccgaaacaaccccaucggcaacaacgaccucaccauccaccgccuauccggcuaccucgcccgcuggguccucgaacacuucaccgaagacgacgacgaaucccaacgcgaacucauccgcagcaccaucaucaaccccaucgccgaguccaacggcauacacuggaacaacggccccgaaaucuaccuauccuucuuccccggcaccgaaauguuccucgaagucuucaaauucuacccccuaaccaucggcaucuaccgagucaaacacggaaugauggacccccaauaccucaaaaaagcccuacgccaacgauacggcacccucaccgcagaaaaauggauggcccaaaaaaccguccucaucgccaaaucacucaaagacguagaacaacucaaauggggacgcggaggccucuccgacgccgcccgcaccuuccucaucaaauucggcgucaaacucccauaa

SEQ ID NO: 8219 - RNA, 708 nt, Artificial Sequence
  derived and/or modified CDS sequence (opt11) from JCV(33909)__EF681853.1__N
augggcgaccuaguauucuacgacgucgccuccaccggcgccaacggcuucgaccccgacgccggcuucgucgcauucauggccgaccacggagaagucaucaaccuagccgccguacgcaucuucuuccucaacgcagccaaagccaaagcagcccucgcccgcaaacccgaacgcaaagcaaccccaaaauucggagaauggcaagucgaaaucgucaacaaccacuuccccggcaaccgaaacaaccccaucggcaacaacgaccucaccauccaccgucuauccggcuaccuagcccgauggguccucgaacacuucaccgaagacgacgacgagucccaacgcgaacuaauccgcuccaccaucaucaacccaaucgccgaauccaacggcauccacuggaacaacggcccagaaaucuaccucuccuucuuccccggcaccgaaauguuccuagaggucuucaaauucuacccccucacaaucggcaucuaccgcgucaaacacggcaugauggacccccaauaccucaaaaaagcccuccgacaacgcuacggcacccucacagccgaaaaauggauggcccaaaaaacaguccucaucgccaaaucccucaaagacgucgaacaacucaaauggggccgcggcggacucuccgacgcagcccgcaccuuccuaaucaaauucggggucaaacucccauaa

SEQ ID NO: 8220 - RNA, 708 nt, Artificial Sequence
  derived and/or modified CDS sequence (opt11) from JCV(2179-00)__EF681808.1__N
augggcgaccuugucuucuacgacgucgccuccaccggagcaaacggcuucgacccagacgccggcuucgucgcauucauggccgaccacggcgaauccgucucccucuccgccguccgcaucuucuuccucaacgcagccaaagccaaagccgcccuagcccgcaaacccgaacgcaaagcaacucccaaauucggcgaauggcaagucgaaaucgucaacaaccacuuccccggcaacagaaacaaccccaucggcaacaacgaccucaccauccaccgccuauccggauaccucgcccgauggguccucgaacacuucaccaccgacgacgacgaaucccaacgcgaacucauccgauccaccauaaucaaccccaucgccgaaucaaacggcauccacuggaacaacggccccgaaaucuaccucuccuucuuccccggcacagaaauguuccucgaaauauucaaauucuacccucucaccaucggcauuuaccgcguaaaacacggcaugauggacccccaauaccuaaaaaaagcccuccgacaacgcuacggcauccuaaccgccgaaaaauggauggcccaaaaaaccguacucaucgccaaaucccucaaagacgucgaacaacucaaauggggccgcggcggacuauccgacgcagccagaaccuuccuaaucaaauucggaguaaaacuccccuaa

SEQ ID NO: 8221 - RNA, 708 nt, Artificial Sequence
  derived and/or modified CDS sequence (opt11) from JCV(2989-06)__EF681849.1__N
augggcgaccucaucuucuacgacgucgccagcaccggcgccaacggcuucgacccagacgccggcuucgucgccuucauggccgaccacggagaauccgucucccucuccgccguccgaaucuucuuccucaacgccgccaaagcaaaagccgcccucgccagaaaacccgaacgaaaagcaaccccaaaauucggcgaauggcaagucgaaaucgucaacaaccacuucccgggcaaccgcaacaaccccaucggcaacaacgaccucaccauccaccgccuauccggcuaccuagcccgcuggguccucgaacauuucaccaccgacgacgacgaaucccaaagagagcuuauccgaucaaccaucaucaaccccaucgccgaaucaaacggaauccacuggaacaacggcccagaaaucuaccuaagcuucuuccccggcaccgaaauguuccucgaaaucuucaaauucuacccccuaaccauaggcaucuacagagucaaacacggcaugauggacccccaauaccucaaaaaagcccuccgacaacgcuacggcacccucaccgccgaaaaauggauggcccaaaaaacaguacucaucgcaaaaucccucaaagacgucgaacaacucaaauggggccgaggcggccucuccgacgccgcccgcaccuuccuuauaaaauucggcgucaaacuccccuaa

SEQ ID NO: 8222 - RNA, 708 nt, Artificial Sequence
  derived and/or modified CDS sequence (opt11) from JCV(5592-02)__EF681804.1__N
augggcgaccucgucuucuacgacgucgccuccaccggcgccaacggcuucgaccccgacgcaggauucguagccuucauggccgaccacggcgaauccgucagccucucagccguccgcaucuucuuccuaaacgcugcaaaagccaaagccgcccuagcccgcaaacccgaacgcaaagccacccccaaauucggcgaauggcaagucgaaauagucaacaaccacuucccaggcaaccgcaacucccccaucggcaacaacgaccucaccauccaccgccucuccggcuaccucgcccgcuggguccucgaacacuucaccaccgacgacgacgaaucccaacgcgaauuaauccgcuccaccaucaucaaccccaucgccgaaucaaacggaauacacuggaacaacggccccgaaaucuaccucucauucuuccccggcaccgaaauguuccucgaaaucuucaaauucuacccccucaccauaggaaucuaccgcgucaaacacggcaugauggacccacaauaccucaaaaaagcccucagacaacgcuacggaacccucaccgccgaaaaauggauggcccaaaaaaccguccucauagccaaaucccucaaagacgucgaacaacucaaauggggccgcggcggccucuccgacgccgcccgcaccuuccucaucaaauucggagucaaacucccauaa

SEQ ID NO: 8223 - RNA, 708 nt, Artificial Sequence
  derived and/or modified CDS sequence (opt11) from JCV(F5609)__KM215546.1__N
augggcgaccuagucuucuacgacgucgccuccaccggcgccaacggcuucgaccccgacgccggcuucgucgcauucauggccgaccacggagaaucagucucccucuccgccguccgcaucuucuuccucaacgccgccaaagccaaagcagcccuagcacgcaaacccgaacgcaaagccacacccaaauucggcgaauggcaagucgaaauagucaacaaccacuuccccggcaaccgcaacaaccccaucggcaacaacgaccucaccauccaccgccucuccggcuaccucgcccgcuggguccucgaacacuucaccaccgacgacgacgaaucucaacgcgaacuuauccgcagcaccauaaucaacccaaucgccgaauccaacggcauccacuggaacaacggccccgaaaucuaccuaagcuucuuccccggaaccgaaauguuccuagaaaucuucaaauucuacccccucaccaucggcaucuaccgcgucaaacacggcaugauggacccccaauaccucaaaaaagcccuccgacaacgcuacggcacccucacagccgaaaaauggauggcccaaaaaaccguccucaucgccaaaucacucaaagacgucgaacaacuaaaauggggccgcggaggucucuccgacgccgcccgcacauuccucaccaaauucggcgucaaacucccauaa

SEQ ID NO: 8224 - RNA, 708 nt, Artificial Sequence
  derived and/or modified CDS sequence (opt11) from JCV(F6577)__KM215557.1__N
augggcgaccucgucuucuacgacgucgcauccaccggcgccaacggauucgaccccgacgccggcuucgucgccuucauggccgaccacggcgaauccgucucccuaucagccguccgcaucuucuuccucaacgccgccaaggccaaagccgcccucucccgcaaacccgaacgcaaagccacaccaaaauucggagaauggcaagucgaaauugucaacaaccacuuccccggcaacagaaacaaccccaucggcaacaacgaccucaccauccaccgacucuccggcuaccucgcccgcuggguccucgaacacuucaccaccgacgacgacgaaucacaacgcgaacuaauccgcucaaccaucaucaaccccaucgccgaauccaacggcauccacuggaacaacggccccgaaaucuaccucuccuucuuccccggcaccgaaauguuccucgaaaucuucaaauucuacccacucacuaucggaaucuaccgcgucaaacacggcaugauggacccccaauaccucaaaaaagcacuacgccaacgauacggcacacucaccgcagaaaaauggauggcccaaaaaacaguccuaauagccaaaucccucaaagacgucgaacaacucaaauggggccgaggcggccucucagacgccgcccgcaccuuccucaucaaauucggcguaaaacugcccuaa

SEQ ID NO: 8225 - RNA, 708 nt, Artificial Sequence
  derived and/or modified CDS sequence (opt11) from JCV(W13135)__KM215552.1__N
augggcgaccucguauucuacgacgucgccuccacaggcgccaacggcuucgaccccgacgccggcuucgucgccuucauggcagaccacggagaauccgucaaccucuccgcaguaagaaucuucuuccucaacgccgccaaagccaaagccgcacucgcccgaaaacccgaaagaaaagcaacccccaaauucggcgaauggcaagucgaaaucguaaacaaccacuuccccggcaaccgcaacaaccccaucggcaacaacgaccucaccauccaccgccucuccggcuaccucgcccgauggguccucgaacacuucaccaccgacgacgacgaaucccaacgcgaacucauccgcucaaccaucaucaacccaaucgccgaauccaacggcauccacuggaacaacggcccagaaaucuaccucuccuucuuccccggaaccgaaauguuccucgaaaucuucaaauucuacccccucaccaucggaaucuaccgcgucaaacacggcaugauggacccccaauaccucaaaaaagcccuacgccaacgcuacggaacccucaccgccgaaaaauggauggcacaaaaaaccguccucaucgcaaaaucccucaaagacgucgaacaacucaaauggggccgcggcggccucuccgacgccgcccgcacauuccucaucaaauucggcgucaaacucccauaa

SEQ ID NO: 8226 - RNA, 708 nt, Artificial Sequence
  derived and/or modified CDS sequence (opt11) from JCV(W18393)__KM215559.1__N
augggcgaccucgucuucuacgacgucgccuccaccggagccaacggauucgaccccgacgccggcuucgucgcauucauggccgaccacggcgaauccauaaaccucuccgcaguccgcaucuucuuccucaacgccgccaaagcaaaagccgcccucgcccgcaaacccgaacgcaaagccaccccaaaauucggcgaauggcaagucgaaaucaucaacaaccacuuccccggcaaccgcaacaaccccaucggcaacaacgaccuaaccauccaccgccucucuggcuaccucgcccgcuggguccucgaacacuucaccgccgacgacgacgaaucccaacgcgaacucauccgcuccaccaucaucaaccccaucgccgaauccaacggcauacacuggaacaacggccccgaaaucuaccucuccuucuucccaggcaccgaaauguuccucgaaaucuucaaauucuacccccucaccaucggaaucuaccgcguaaaacacggaaugauggacccacaauaccucaaaaaagcccucagacaacgcuacggcacacucaccgccgaaaaauggauggcccaaaaaaccguccucauagccaaaucccucaaagacgucgaacaacucaaauggggccgcggcggccuauccgacgccgccagaaccuuccuaaucaaauucggcgucaaacuccccuaa

SEQ ID NO: 8227 - RNA, 708 nt, Artificial Sequence
  derived and/or modified CDS sequence (opt11) from KEYV(KEYV/Ochlerotatus atlanticus/USA/KEYVLK01/2005)__KT630290.1__N
augggcgaccucguauucuacgacgucgccuccaccggcgccaacggcuucgaccccgacgccggcuacgucgccuucauggccaaccacggcgaaucaaucucccuauccaccguacgcaucuucuuccuaaacgccgccaaagccaaagcagcccucacccgcaaacccgaacgcaaagccaccccaaaauucggagaauggcaaguagaaaucgucaacaaccacuuccccggcaaccgaaacaaccccaucggcaacaacgaccuaacucuccaccgaaucuccggcuaccuagcccgcuggguccuagaacacuucggcgaaggcgaagacgaaucccaaaaagagcucaucaaauccaccgucaucaaccccauagccgaaagcaacggcauccgauggggcaacggcgucgaaaucuaccucuccuucuucccaggcacagaaauguuccucgaacucuucaaauucuacccccuuacaauaggcaucuacagagucaagcacggcaugauggacgcacaauaccuaaaaaaagcccuccgccaacgcuacggcacccucacagccgacaaauggauggcccaaaaaaccagcaugaucaccaaaucccuaaaagacgucgaacaacucaaauggggaaaaggcggccuaagcgacaccgcccgcgccuuccucgccaaauucggcguccgccuccccuaa

SEQ ID NO: 8228 - RNA, 708 nt, Artificial Sequence
  derived and/or modified CDS sequence (opt11) from KEYV(KEYV/Ochlerotatus atlanticus/USA/KEYVLK02/2005)__KT630293.1__N
augggagaccucgucuucuacgacgucgcaucaaccggcgcaaacggauucgacccugacgccggcuacgucgccuucauggccaaccacggcgaauccaucucccucuccaccguccgcaucuucuuccucaacgccgccaaagccaaagccgcccucacccgaaaauccgaacgcaaagcaacccccaaauucggcgaauggcaagucgaaaucgucaacaaccacuuccccggcaaccgcaacaaccccaucggaaacaacgaccuuacccuccaccgcaucuccggauaccucgcccgcuggguccucgaacacuucggcgaaggcgaagacgaaucccaaaaagaacuaaucaaauccaccgucaucaaccccaucgccgaauccaacggcauccgcuggggcaacggcgucgaaaucuaccuauccuucuucccaggcaccgaaauguuccucgaacucuucaaauucuacccccucaccaucggcaucuaccgagucaaacacggcaugauggacgcacaauaccucaaaaaagcccuccgccaacgcuacggcacccucaccgccgacaaauggauggcccaaaaaaccucaaugaucaccaaaucacuaaaagacgucgaacaacucaaauggggcaaaggcggacucuccgacacagccagagccuuccuagccaaauucggcguccgccuccccuaa

SEQ ID NO: 8229 - RNA, 708 nt, Artificial Sequence
  derived and/or modified CDS sequence (opt11) from KEYV(C14031-33)__U12801.1__N
augggcgaccucguauucuacgacgucgccagcaccggagccaacggcuucgaccccgacgccggcuacgucgcauucauggccaaccacggcgaauccaucucccucucaacaguccgcaucuucuuccuaaacgccgccaaagccaaagccgcccucacucgcaaacccgaacgcaaagccacccccaaauucggagaauggcaagucgaaaucguaaacaaccacuuccccggcaaccgcaacaaccccaucggcaacaacgaccucacacuccaccgcaucagcggcuaccucgcccgcuggguccuagaacacuucggcgaaggcgaagacgaaucccaaaaagaacucauaaaauccaccguaaucaaccccaucgccgaauccaacggaauccgcuggggcaacggcgucgaaaucuaccucucauucuuccccggcaccgaaauguuccucgaacucuucaaauucuacccccucaccauaggcaucuaccgcgucaaacacggaaugauggacgcccaauaccucaaaaaagcccuacgacaacgcuacggcacacucaccgccgacaaauggauggcccaaaaaaccagcaugaucacaaaaucacucaaagacgucgaacaacucaaauggggcaaaggaggccucuccgacaccgcccgagccuuccuagccaaauucggcguccgacuccccuaa

SEQ ID NO: 8230 - RNA, 708 nt, Artificial Sequence
  derived and/or modified CDS sequence (opt11) from LACV(Human/78)__NC_004110.1__N
auguccgaccucguauucuacgacguagccucaacaggcgccaacggauucgacccagacgccggauacauggacuucugcgucaaaaacgccgaacuccucaaccucgccgccguccgcaucuucuuccucaacgccgccaaagccaaagcagcccuaucccgcaaacccgaacgaaaagccaaccccaaauucggcgaauggcaagucgaagucaucaacaaccacuuccccggcaaccgcaacaacccaaucggcaacaacgaccucaccauacaccgacuuuccggcuaccucgcccgauggguccucgaccaauacaacgaaaacgacgacgaaucccaacacgaacuaauacgcacaaccaucaucaaccccaucgccgaguccaacggcgucggcugggacuccggacccgaaauauaccucuccuucuuccccggcacagaaauguuccuagaaaccuucaaauucuacccacucacuaucggcauccacagaguaaaacaaggaaugauggacccccaauaccucaaaaaagcccuacgacaacgcuacggaacccuuaccgccgacaaauggaugucacaaaaagucgccgccaucgccaaaucccucaaagacguagaacaacucaaauggggaaaaggcggccucucagacaccgccaaaaccuuccuccaaaaauucggcauccgacucccauaa

SEQ ID NO: 8231 - RNA, 708 nt, Artificial Sequence
  derived and/or modified CDS sequence (opt11) from LACV__KP271107.1__N
auguccgaccuagucuucuacgacgucgccuccacuggcgcaaacggcuucgacccagacaccggcuacauggacuucugcgucaaaaacgccgaaucccucaaccucgcagccguacgcaucuucuuccucaacgccgccaaagcaaaagccgcccucucccgcaaacccgaacgcaaagccaaccccaaauucggcgaauggcaagucgaagucaucaacaaccacuucccaggcaaccgcaacaaccccauaggaaacaacgaccucaccauccaccgccuauccggcuaccucgcccgcuggguccucgaccaauacaacgaaaacgacgacgaaucccaacacgaacucauccgcaccaccaucaucaaccccaucgccgaauccaacggcgucggcugggacucaggcccagaaaucuaccucucuuucuucccaggcaccgaaauguuccucgaaaccuucaaauucuacccccuaacaaucggcauccaccgaguaaaacaaggaaugauggacccccaauaccucaaaaaagcccuacgccaacgcuacggcacccucaccgccgacaaauggaugucccaaaaagucgccgccaucgcaaaaucccucaaagacgucgaacaacuaaaauggggcaaaggcggccucuccgacaccgcaaaaaccuuccuacaaaaauucggcauccgacuacccuaa

SEQ ID NO: 8232 - RNA, 708 nt, Artificial Sequence
  derived and/or modified CDS sequence (opt11) from LACV(BEN2_Lafayette_WI_2007)__GU596386.1__N
augucagaccucgucuucuacgacgucgccuccacaggcgcaaauggcuucgaccccgacgccggauacauggacuucugcgucaaaaacgcagaaucacucaaccucgccgcaguccgcaucuucuuccucaacgccgccaaagccaaagccgcccucucacgcaaacccgaacgcaaagccaaccccaaauucggcgaauggcaagucgaagucaucaacaaccacuucccuggcaacagaaacaacccaaucggcaacaacgaccuaacaauccaccgccucuccggcuaccucgcccgauggguccucgaccaauacaacgaaaacgacgacgaaagccaacacgaacuaauacgcaccaccaucaucaaccccaucgccgaauccaacggcguaggcugggacuccggccccgaaaucuaccucuccuucuuucccggcaccgaaauguuccucgaaaccuucaaauucuacccucucaccaucggcauacaccgagucaaacaaggcaugauggacccccaauaccucaaaaaagcccuccgucaacgauacggcacccucaccgccgacaaauggaugucccaaaaagucgccgccaucgcaaaaucccucaaagacgucgaacagcucaaauggggaaaaggcggccucuccgacaccgccaaaaccuuccuccaaaaauucggcauccgccuccccuaa

SEQ ID NO: 8233 - RNA, 708 nt, Artificial Sequence
  derived and/or modified CDS sequence (opt11) from LACV(Dallas/TX/2009)__GU591164.1__N
auguccgaccucgucuucuacgacguagccuccaccggcgccaacggcuucgacccagacgccggcuacauggacuucugcgucaaaaacgccgaaucacuaaaccucgccgccguccgcaucuucuuccucaacgccgccaaagccaaagcagcacucucccgcaaacccgaacgcaaagccaaccccaaauucggcgaauggcaaguagaagucgucaacaaccacuuccccggcaaccgcaacaaccccaucggcaacaacgaccucaccauccaccgccuauccggauaccuggccagauggguccucgaccaauacaacgaaaacgacgacgaaucacaacgcgaacucauccgaaccaccaucaucaaccccaucgcagaauccaacggcguccgcugggacuccggaccagaaaucuaccucuccuucuucccaggcaccgaaauguuccucgaaaccuucaaauucuacccccucaccaucggcauccaccgcgucaaacaaggcaugauggacccccaauaccucaagaaagcccuccgccaacgauacggcacccucaccgccgacaaauggaugucccaaaaagucgccgccaucgccaaaucccucaaagacgucgaacaacuaaaauggggaaaaggcggccucuccgacaccgccaaaaccuuccuccaaaaauucggcauccgccuacccuaa

SEQ ID NO: 8234 - RNA, 708 nt, Artificial Sequence
  derived and/or modified CDS sequence (opt11) from LACV(Fort Bend County/TX/2009)__GU591167.1__N
augucagaccucgucuucuacgacgucgccuccaccggcgccaacggauucgaccccgacgccggcuacauggacuucugcgucaaaaacgcagaaucacucaaccuagcagccguccgcaucuucuuccucaacgccgcaaaagccaaagcagcacucagccgaaaaccagaacgaaaagccaaccccaaauucggcgaauggcaaguagaagucaucaacaaccacuuccccggcaaccgcaacaaccccaucggcaacaacgaucucaccauccaccgccucuccggcuaccuagcccgauggguccucgaccaauacaacgaaaacgacgacgaaucccaacgagaacucauacgcaccaccaucaucaaccccaucgcagaaucaaacggaguccgaugggacuccggccccgaaaucuaccucuccuucuucccaggcaccgaaauguuccucgaaacauucaaauucuacccccucaccauaggcauccaccgagucaagcaaggcaugauggacccccaauaccucaagaaagcccucagacaacgcuacggcacacucaccgccgacaaauggaugucacaaaaagucgccgccaucgccaaaucccucaaagacgucgaacaacucaaauggggcaaaggcggccuauccgacaccgcaaaaaccuuccuacaaaaauucggcauccgacuccccuaa

SEQ ID NO: 8235 - RNA, 708 nt, Artificial Sequence
  derived and/or modified CDS sequence (opt11) from LACV(LACV/95/OH-H (CCH-MB96))__GU206135.1__N
auguccgaccucgucuucuacgacgucgccuccaccggcgccaacggcuucgacccagacgccggcuacauggacuucugcgucaaaaacgcagaaucccucaaccucgccgcaguacgcaucuucuuccucaacgccgccaaagccaaagccgcccucucaagaaaacccgaacgaaaagccaaccccaaauucggagaauggcaagucgaagucgucaacaaccacuuccccggcaaccgcaacaaccccaucggcaacaacgaccucaccauccaccgccucucaggcuaccucgcccgcuggguccucgaccaauacaacgagaacgacgacgaaucccaacacgaacucaucaaaacaaccauaaucaaccccauagcagaauccaacggcgucggcugggacuccggccccgaaaucuaccucuccuucuuccccggcaccgaaauguuccucgaaaccuucaaauucuacccccucaccaucggcauccaccgcgucaaacaaggcaugauggacccccaauaccucaagaaagcacuccgacaacgauacggcacccuaaccgccgacaaauggaugagccaaaaagucgcagccaucgccaaaucccucaaagacgucgaacaacucaaauggggaaaaggcggccucuccgacacagccaaaacauuccuacaaaaauucggcauccgccuccccuaa

SEQ ID NO: 8236 - RNA, 696 nt, Artificial Sequence
  derived and/or modified CDS sequence (opt11) from OROV(BeAn19991)__NC_005777.1__N
augucagaauucauauucaacgacgucccucaacgaaccaccuccaccuucgaccccgaagccgccuacgucgccuucgaagcccgcuacggccaaguccucaacgccggcguaguccgcgucuucuuccucaaccaaaaaaaagccaaagacguccuccgcaaaaccucccgcccaaugguagaccucaccuucggcggcguccaauucgcaauggucaacaaccacuucccacaauuccaaagcaaccccgucccagacaacggccucacccuacaccgccucuccggauaccuagcccgcugggccuucacccaaaugcgcucccccaucaaacaagcagaauuccgcgcaaccgucgucgucccccuagccgaaguaaaaggcugcaccuggaaugacggcgacgccauguaccucggcuucgccgccggcgccgaaauguuccuccaaaccuucaccuucuucccccucgucaucgaaaugcaccgcguccuaaaagacggcauggacgucaacuucaugaaaaaaguccucagacaacgcuacggccaaaaaacagccgaacaauggaugcgagaagaaaucgucgccguccgagccgccuucgaagccgucggcacccucgccugggcccgcaccggcuucucccccgccgcccgcgacuuccuccgccaauucggcaucgacaucuaa

SEQ ID NO: 8237 - RNA, 696 nt, Artificial Sequence
  derived and/or modified CDS sequence (opt11) from OROV(AR136921)__HQ830443.1__N
auguccgaauucaucuucaacgacgucccacaacgcacaaccucaaccuucgaccccgaagcagccuacguugccuucgaagcccgcuacggccaaguccucaacgccggcgucguccgcgucuucuuccucaaccaaaaaaaagcaaaagacguacuacgcaaaaccucccgccccauggucgaccucaccuucggcggaguccaauucgccauggucaacaaccacuucccacaauuccaauccaaccccguccccgacaacggccucacccuacaccgccucuccggcuaccucgcccgcugggccuucacccaaaugcgcucccccaucaaacaagccgaauuccgagccaccgucgucgucccccucgccgaagucaagggcugcaccuggaacgacggcgacgccauguaccuaggcuucgccgcgggcgccgaaauguuccuccaaaccuucaccuucuucccccuagucaucgaaaugcaccgcguccucaaagacggcauggacguaaacuuuaugaaaaaaguccuccgccaacgcuacggccaaaaaaccgccgaacaauggaugagagaagaaaucgucgccguccgcgccgccuucgaagccgucggcacccucgccugggcccgcaccggcuucucccccgccgcccgcgacuuccuccgccaauucggcauaggcaucuaa

SEQ ID NO: 8238 - RNA, 696 nt, Artificial Sequence
  derived and/or modified CDS sequence (opt11) from OROV(AR366927)__HQ830448.1__N
auguccgaauucuucuucaacgacgucccccaacgcaccaccuccaccuucgaccccgaagcagccuacgucgcauucgaagcccgcuacggccaaguccucaacgcaggcgucguccgaguauucuuccucaaucaaaaaaaagccaaagacguccuccgcaaaaccucacgucccauggucgaccuuaccuucggcggcguccaauucgccauggucaacaaccacuucccccaauuucaguccaaccccguccccgacaacggccucacccuccaccgccucuccggcuaccuagcccgcugggccuucacacaaaugcgcucccccauaaaacaagccgaauuccgcgccacagucgucgucccccucgccgaagucaaaggcugcaccuggaacgacggcgacgccauguaccucggcuucgccgccggcgccgaaauguuccuccaaaccuucaccuucuucccccucgucaucgaaaugcaccgaguccucaaagacggcauggacgucaacuucaugaaaaaaguacuccgccaaaaauacggccaaaaaaccgccgaacaauggaugcgcgaagaaaucgucgccguccgcgccgcauucgaagccgucggcacccucgccugggcccgaacaggcuucucccccgccgcccgcgacuuccuacgccaauucggcaucggcaucuaa

SEQ ID NO: 8239 - RNA, 696 nt, Artificial Sequence
  derived and/or modified CDS sequence (opt11) from OROV(BeAn 206119)__AY993909.1__N
auguccgaauucauuuucaacgacgucccccaacgaaccacauccaccuucgaccccgaagccgccuacgucgccuucgaagcccgcuacggccaaguacuaaacgccggcgucguccgcgucuucuuccucaaccaaaaaaaagccaaagacguacuccgcaaaaccucacgcccaauggucgaccucaccuucggcggcguccaauucgccauggucaacaaccacuucccccaauuccaauccaaccccguacccgacaacggccucacccuccaccgccucucaggcuaccucgcccgcugggccuucacccaaaugcgcucccccaucaaacaagccgaauuccgcgccgccgucguagucccacucgucgaagucaagggcugcaccuggaacgacggcgacgccauguaccucggcuucgccgcaggcgccgaaauguuccuccaaaccuucaccuucuucccccucgucaucgaaaugcaccgaguccuaaaagacggcauggacguaaacuucaugaaaaaaguccuccgccaacgcuacggccaaaaaacagcagaacaauggaugcgcgaagaaaucgucgccguccgagccgccuucgaaaccguaggaaccuucgcaugggcccgcaccggcuucucccccgccgcacgagacuuccuacgccaauucggcaucggcaucuaa

SEQ ID NO: 8240 - RNA, 696 nt, Artificial Sequence
  derived and/or modified CDS sequence (opt11) from OROV(BeAn 208819)__AY993911.1__N
auguccgaauucaucuucaacgacgucccacaacgcaccaccucaaccuucgaccccgaagccgccuacguagccuucgaagcccgcuacggccaaguccucaacgccggcgucguacgcgucuucuuccucaaccaaaaaaaagccaaagacguccuccgcaaaaccucacgccccaugguagaccucaccuucggaggcguccaauucgccauggucaacaaccacuucccccaauuccaauccaaccccgucccagacaacggccucacccuccaccgccucucugguuaccucgcccgaugggccuucacccagaugcgcucacccauaaaacaagccgaauuccgcgccaccgucgucgucccccucgucgaagucaaaggcugcaccuggaacgacggcgacgccauguaccuaggcuucgccgccggcgcagaaauguuccuccaaaccuucaccuucuucccccucgucaucgaaaugcaccgcguccucaaagacggcauggacgucaacuucaugaaaaaaguccuccgccaacgcuacggccaaaaaaccgccgaacaauggaugcgagaagaaaucgucgccguccgcgccgcauucgaagccgucggcacacucgccugggcccgcaccggcuucuccccugccgcccgcgacuuccuccgccaauucggcauaggcaucuaa

SEQ ID NO: 8241 - RNA, 696 nt, Artificial Sequence
  derived and/or modified CDS sequence (opt11) from OROV(BeAn 208823)__AY993912.1__N
auguccgaauucaucuucaacgacgucccccaacgaaccaccucaaccuucgacccagaagcagccuacgucgccuucgaagcccgcuacggccaaguccuaaacgcaggcgucguccgagucuucuuccuaaaccaaaaaaaagccaaagacguccuccgaaaaaccucccgccccauggucgaccuuaccuucggcggcguccaauucgccauggucaacaaccauuucccacaauuccaauccaaccccguccccgacaacggccuaacccuccaccgccucuccggcuaccucgcccgcugggcauucacccaaaugcgcuccccaaucaaacaagccgaauuccgcgcaaccgucguagucccccuagucgaaguaaaaggcugcaccuggaacgacggcgacgccauguaccuaggcuucgccgccggcgccgaaauguuccuccaaaccuucaccuucuucccccucgucaucgaaaugcaccgcguccucaaagacggcauggacgucaacuucaugaaaaaaguccuccgccaacgcuacggccaaaaaaccgccgaacgcuggaugcgugaagaaaucgucgccguacgcgccgccuucgaagccgucggcacccuagccugggcccgaaccggcuucucccccgccgccagagacuuccuacgccaauucggcaucggcaucuaa

SEQ ID NO: 8242 - RNA, 696 nt, Artificial Sequence
  derived and/or modified CDS sequence (opt11) from OROV(H244576)__HQ830444.1__N
augagcgaauucuucuucaacgacgucccccaacgcaccaccuccaccuucgaccccgaagccgccuacgucgccuucgaagcacgauacggccaaguccucaacgccggagucguccgcgucuucuuccucaaccaaaaaaaagccaaagacguacuacgcaaaaccucccgacccauggucgaccucaccuucggcggcguccaauucgccauggucaacaaccacuucccccaauuccaaucaaaccccguccccgacaacggccucaccuuccaccgccucuccggcuaccucgcacgcugggccuucacacaaaugcgcucccccaucaaacaagccgaauuccgcgccacagucguagucccccuagcagaagucaaaggaugcaccuggaacgacggcgacgccauguaccucggcuucgccgccggcgccgaaauguuccuacaaaccuucaccuucuucccccucgucaucgaaaugcaccgcguccucaaagacggcauggacgucaacuucaugaaaaaaguccuccgccaaaaauacggacaaaaaaccgccgaacaauggaugcgcgaagaaaucgucgccguccgcgccgccuucgaagccgucggaacccuagcuugggcccgaaccggcuucuccccagcagcccgcgacuuccuccgccaauucggcaucggcaucuag

SEQ ID NO: 8243 - RNA, 696 nt, Artificial Sequence
  derived and/or modified CDS sequence (opt11) from OROV(H355186)__HQ830446.1__N
auguccgaauucaucuucuccgacgucccacaacgcaccaccuccaccuucgaccccgaagccgcauacgucgccuucgaagcccgcuacggccaaguccucaacgccggcgucguacgcguauucuuccucaaccaaaaaaaagcaaaagacguacuccgcaagaccucccgccccauggucgaccucacauucggcggcguacaauucgcaauggucaacaaccacuucccccaauuccaauccaaccccguccccgacaacggccucacccuacaccgccucuccggcuaccucgcacgaugggccuucacacaaaugcgcucccccaucaaacaagcagaauuccgcgccaccguugucgucccccuagcagaaguaaaaggcugcaccuggaacgacggcgacgccauguaccucggcuucgccgccggcgccgaaauguuccuccaaaccuucaccuucuucccccuagucauagaaaugcaccgaguccucaaagacggaauggacgucaacuucaugaaaaaaguccuccgacaacgcuacggccaaaaaaccgccgaacaauggaugcgcgaagaaaucguagccguccgagccgccuucgaagccgucggaacccuagcaugggcccgcaccggcuucagccccgccgcccgagacuuccuacgccaauucggcaucggaauauaa

SEQ ID NO: 8244 - RNA, 696 nt, Artificial Sequence
  derived and/or modified CDS sequence (opt11) from OROV(H356898)__HQ830447.1__N
augucagaauucaucuucaacgacgucccccaacgcacaacauccaccuucgaccccgaagccgcauacguauccuucgaagcccgcuacggccaaguccucaacgccggcgucguccgcgucuucuuccucaaccaaaaaaaagccaaagacguccuccgcaaaaccagccgccccauggucgaccucaccuucggcggcguccaauucgccaugguuaacaaccacuucccccaauuccaaucaaaccccguccccgacaacggccuaacccuacaccgacucuccggcuaccuagcccgcugggccuucacucaaaugcgcucacccaucaaacaagccgaauuccgcgcaaccgucgucgucccccuagcagaagucaaaggcugcaccuggaacgacggcgacgccauguaccucggcuucgccgccggcgccgaaauguuccuccaaaccuucaccuucuucccccucgucaucgaaaugcaccgaguccucaaagacggcauggacgucaacuucaugaaaaaaguacuccgccaacgcuacggccaaaagaccgccgaacaauggaugcgcgaagaaaucgucgccguccgcgccgccuucgaagccgucggcacacucgccugggcccgaaccggcuucucacccgccgcacgcgacuuccuccgccaauucggcaucggaaucuaa

SEQ ID NO: 8245 - RNA, 696 nt, Artificial Sequence
  derived and/or modified CDS sequence (opt11) from OROV(H389865)__HQ830453.1__N
augagcgaauucaucuucaacgacgucccccaacgcaccaccucaaccuucgaucccgaagcagccuacgucgccuucgaagcccgcuacggccaaguccucaacgcaggcgucguccgcgucuucuuccucaaccaaaaaaaagccaaagacguccuccgcaaaaccucccgccccauggucgaccucaccuucggcggcguccaauucgccaugguaaacaaccacuucccccaauuccaaucaaaccccguccccgacaacggccucacccuucaccgccuauccggcuaccucgcccgaugggcauucacccacaugcgaucccccaucaaacaagccgaauuccgagccacagucgucguuccccucgccgaagucaaaggcugcaccuggaacgacggcgacgccauguaccucggcuucgcagccggcgccgaaauguuccuccaaaccuucaccuucuucccccucgucaucgaaaugcaccgaguccuaaaagacggcauggacguaaacuucaugaaaaaauuucuccgccaacgcuacggccaaaaaaccgccgaacaauggaugcgcgaagaaauccucgccgucaaagccgccuucgaauccgucggcacccucgccugggcccgcaccggauucucccccgcagcacgcgacuuccuccgccaauucgccaucggcaucuaa

SEQ ID NO: 8246 - RNA, 696 nt, Artificial Sequence
  derived and/or modified CDS sequence (opt11) from OROV(H472433)__HQ830455.1__N
augucagaauucaucuucaacgacgucccgcaacgcaccaccuccacauucgaccccgaagccgccuacgucgccuucgaagcccgcuacggacaaguacucaacgccggcgucguccgcgucuucuuccucaaccaaaaaaaagccaaagacguacuccgcaaaaccucacgacccaugguagaccuaaccuucucaggcguccaauucgcuauggucaacaaccacuucccccaauuccaauccaacccagucccagacaacggccucacccuccaccgccuauccggcuaccucgcccgcugggccuucacccaaaugcgcucccccaucaaacaagccgaauuccgagccaccgucgucguaccacucgccgaaguaaaaggcugcaccuggaacgacggcgacgccauguaccucggcuucgccgcaggcgcagaaauguuccuccaaacauucaccuucuucccccuagucaucgaaaugcaccgcguccucaaagacggcauggacgucaacuucaugaaaaaaguccuccgccaacgauacggccaaaaaacagccgaacaauggaugcgcgaagaaauagucgcaguccgcgccgccuucgaagccguaggcacccuagccugggcccgcaccggcuucucccccgccgcccgcgauuuccuccgacaauucggcaucggaauauaa

SEQ ID NO: 8247 - RNA, 696 nt, Artificial Sequence
  derived and/or modified CDS sequence (opt11) from OROV(H532490)__HQ830463.1__N
auguccgaauucauauucaacgacguaccccaacgcaccacauccaccuucgaccccgaagccgcuuacguauccuucgaagcacguuacggacaaguccucaacgccggcgucguccgcguauucuuccuaaaccaaaaaaaagccaaagacguccuccgcaaaaccucaucacccauggucgaucucaccuucggcggaguccaauucgccauggucaacaaccacuucccacaauuccaauccaaccccguccccgacaacggccucacccuccaccgacucuccggcuaccuagcccgcugggccuucacccaaaugcgcagccccaucaaacaagccgaauuccgcgccaccgucgucgucccccucgccgaagucaaaggcugcacauggaacgacggcgacgccauguaccucggcuucgcagccggcgccgaaauguuccuccaaaccuucacauucuucccccucgucaucgaaaugcaccgaguccucaaagacggcauggacgucaacuucaugaaaaaaguccuccgccaacgcuacggccaaaaaaccgccgaacaauggaugcgcgaagaaaucgucgcagucagagccgccuucgaagccgucggcacccucgccugggcucgcaccggcuucucccccgccgcccgugacuuccuccgccaauucggcaucggcaucuaa

SEQ ID NO: 8248 - RNA, 696 nt, Artificial Sequence
  derived and/or modified CDS sequence (opt11) from OROV(H543629)__HQ830467.1__N
auguccgaauuccucuucaacgacgucccccaacgaaccacauccaccuucgaccccgaagccgccuacgucgccuucgaagcacgcuacggccaaguccuaaacgccggagucguccgcgucuucuuccucaaccaaaaaaaagcaaaagacguccuccgcaaaaccucccgcccuauggucgaccucaccuucggcggaguccaauucgccauggucaacaaccacuucccccaauuccaauccaaccccguccccgacaacggccucacacuccaccgccucucaggcuaccucgcccgcugggccuucacccaaaugcgcuccccaaucaaacaagcagaauuccgcgcaaccgucgucgucccccucgcagaagucaaaggcugcaccuggaacgacggcgacgccauguaccucggcuucgccgcaggagccgaaauguuccuccaaaccuucaccuucuucccccucgucaucgaaaugcaccgcguacuaaaagacggaauggacgucaacuucaugaaaaaaguccuccgacaacgcuacggccaaaaaaccgccgaacaauggaugcgcgaagaaaucgucgccguucgagccgccuucgaagccgucggcacccucgccugggcccgcaccgguuucucaccagccggccgcgacuuccuccgccaauucggcaucggcaucuag

SEQ ID NO: 8249 - RNA, 696 nt, Artificial Sequence
  derived and/or modified CDS sequence (opt11) from OROV(H543638)__HQ830468.1__N
auguccgaauuccucuucaacgacgucccccaacgcaccaccucaaccuucgaccccgaagccgccuacguagccuucgaagcacgcuacggacaaguccucaacgccggcgucguccgaguauucuuccucaaccaaaaaaaagcaaaaaacguccuccgcaaaaccucccgccccauggucgaccucaccuucggcggaguccaauucgccaugguaaacaaccacuucccccaauuccaguccaaccccguccccgacaacggccuaacccuccaccgacucuccggcuaccucgcccgcugggccuucacacaaaugcgcucaccaaucaaacaagccgaauuccgcgccaccgucgucgucccccucgccgaagucaaaggaugcaccuggaacgacggagacgccauguaccucggauucgccgccggcgccgaaauguuccuccaaaccuucaccuucuucccacucgucaucgaaaugcaccgcguccucaaagacggcauggacgucaacuucaugaaaaaaguccuccgucaacgauacggccaaaaaaccgccgaacaauggaugcgcgaggaaauagucgccguccgcgccgccuucgaagccguaggcacccuagcaugggcccgcacaggcuucucccccgccggccgagacuuccuccgacaauucggcaucggaaucuaa

SEQ ID NO: 8250 - RNA, 696 nt, Artificial Sequence
  derived and/or modified CDS sequence (opt11) from OROV(H706890)__HQ830473.1__N
auggcugaauucaucuucaacgacgucccacaacgaacaaccuccaccuucgacccagaagccgccuacguagccuucgaagcaagauacggccaaguccucaacgcaggcgucguccgcgucuucuuccucaaccaaaaaaaagccaaagacguccuccgcaaaaccucccgucccauggucgaccucacauucggaggcguccaauucgccauggucaacaaccacuucccccaauuccaauccaacccaguccccgacaacggccuaacccuccaccgccucuccggcuaccucgcccgcugggccuucacccaaaugcgcucccccaucaaacaagccgaauuccgcgccaccgucgucgucccccuagccgaagucaaaggcugcacauggaacgacggcgacgccauguaucucggcuucgccgccggagccgaaauguuccuccaaaccuucaccuucuucccccucguaaucgaaaugcaccgcguccucaaagacggcauggacgucaacuucaugaaaaagguccuccgccaacgauacggccaaaaaacagccgaacaauggaugcgcgaagaaaucgucgccguccgcgcagccuucgaagccgucggaacccucgccugggcccgcaccggcuucuccccagcagcacgcgacuuccuccgccaauucggcaucggcauauaa

SEQ ID NO: 8251 - RNA, 696 nt, Artificial Sequence
  derived and/or modified CDS sequence (opt11) from OROV(H758669)__HQ830479.1__N
augucagaauucaucuucaacgacgucccccaacgcaccaccuccaccuucgaccccgaagcagccuacgucgccuucgaagcccgauacggccaagucuuaaacgccggcgucguccgcgucuucuuccucaaccaaaaaaaagccaaggacguccuccgcaaaaccucccgccccauggucgaccucaccuucggcggcguccaauucgccauacucaacaaccacuucccccaauuccaaagcaaccccgucccagacaacggccucacccuccaccgccucuccggcuaccuagcacgcugggccuucacacaaaugcgcucacccaucaaacaagccgaauuccgcgccaccgucgucguaccccucgccgaagucaaaggcugcaccuggaacgacggcgacgccauguaccucggcuucgccgccggcgccgaaauguuccuccaaaccuucaccuucuucccccucgucaucgaaaugcaccgaguccucaaagacggcauggacgucaacuucaugaaaaaaguccucagacaacgcuacggccaaaaaaccgccgaacaauggaugcgcgaagaaaucgucgccguccgcgccgccuuugaagccgucggcacccucgccugggcccgaaccggauucucccccgccgcccgcgacuuccuacgccaauucggcaucggcaucuaa

SEQ ID NO: 8252 - RNA, 696 nt, Artificial Sequence
  derived and/or modified CDS sequence (opt11) from OROV(H758687)__HQ830478.1__N
auguccgaauucaucuucaacgacgucccccaacgaaccaccagcaccuucgaccccgaagccgcauacgucgccuucgaagcccgcuacggccaaguccucaacgccggcgucgucagagucuucuuccucaaucaaaaaaaagccaaagacguccuccgcaaaacaucacgccccauggucgaccucaccuucggaggcguccaauucgccauggucaacaaccacuucccccaauuccaauccaacccaguccccgacaacggccucacccuacaccgccucuccggcuaccucgcccgaugggccuucacacaaaugcgcucccccaucaaacaagccgaauuccgagcaaccgucgucgucccccucgccgaaguaaaaggcugcaccuggaacgacggcgacgccauguaccucggcuucgccgccggagccgaaauguuccuccaaaccuucaccuuuuuccccuucgucauagaaaugcaccgcguccucaaagacggaauggacguaaacuucaugaaaaaaguccuccgacaacgcuacggacaaaaaaccgccgaacaauggaugcgagaagaaaucgucgccguccgcgccgccuucgaagccgucggaacccucgccugggcccgcaccggcuucucccccgccgcacgcgacuuccuccgccaauucggcauaggcaucuaa

SEQ ID NO: 8253 - RNA, 696 nt, Artificial Sequence
  derived and/or modified CDS sequence (opt11) from OROV(H759041)__HQ830488.1__N
augucagaauucaucuucaacgacguaccacaacgaaccaccucaaccuucgaccccgaagccgccuacgucgcauucgaagcacgcuacggccaaguccucaacgcaggagucguacgcgucuucuuccucaaccaaaaaaaagccaaagacguccuccgcaaaaccucccgacccauggucgaccucaccuucggcggcguccaauucgccaugguaaacaaccacuucccccaauuccaauccaaccccguccccgacaacggccucacccuccaccgccucucaggcuaccucgcccgcugggccuucacccaaaugcgaagccccaucaaacaagccgaauuccgcgcaacaguagucgucccccucgccgaagucaaaggaugcaccuggaacgacggcgacgccauguaccucggcuucgccgccggcgccgaaauguuccugcaaaccuucaccuucuucccccucgucauagaaaugcaccgcguccuaaacgacggcauggacgucaacuucaugaaaaaaguccuccgccaacgcuacggccagaaaaccgccgaacaauggaugcgagaagaaaucguagcaguccgcgccgccuucgaagccgucggcacccucgccugggcacgcaccggcuucucccccgccgcccgcgacuuccuacgccaauucggcaucggcaucuaa

SEQ ID NO: 8254 - RNA, 696 nt, Artificial Sequence
  derived and/or modified CDS sequence (opt11) from OROV(BeAr473358)__AF164539.1__N
augucagaauucaucuucaacgacgucccccaacgaaccaccuccaccuucgaccccgaagccgccuacgucgccuucgaagcccgcuacggccaaguccugaacgcaggcgucguccgcgucuucuuccucaaccaaaaaaaagccaaagacguccuccgcaaaaccuccagacccauggucgaccuaaccuucggcggcguccaauucgccauggucaacaaccacuucccccaauuccaauccaaccccguccccgacaacggccucacccuccacagacucuccggcuaccucgcccgcugggccuucacccacaugcgcucccccaucaaacaagccgaauuccgcgccaccgucgucgucccccucgcagaagucaaaggcugcaccuggaacgacggcgacgccauguaccucggcuucgccgccggcgccgaaauguuccuccaaaccuucacauucuucccacucgucaucgaaaugcaccgaguccucaaagacggaauggacgucaacuucaugaaaaaaauccuccgccaaagauacggccaaaaaaccgccgaacaauggaugcgcgaagaaaucaucgccgucaaaacugccuucgaaaccgucggcacccucgccugggccaucaccggcuucucccccgccgcccgcaacuuccuacgacaauucgaaaucgacaucuag

SEQ ID NO: 8255 - RNA, 696 nt, Artificial Sequence
  derived and/or modified CDS sequence (opt11) from OROV(BeH 521086)__AY704559.1__N
augucagaauuccucuucaacgacgucccacaaagaacaaccuccacauucgacccagaagccgccuacgucgccuucgaaucacgcuacggccaaguccucaacgccggcgucguccgcgucuucuuccuaaaccaaaaaaaagccaaagacguccuccgcaaaaccucccgcccaauggucgaccuaacauucggaggcguccaauucaccauggucaacaaccacuucccacaauuccaaucaaacccaguccccgacaacggccucacccuacaccgccucuccggcuaccucgcccgcugggccuucacccaaaugaggagccccaucaaacaagccgaauuccgcgccaccgucgucgucccccucgccgaagucaaaggcugcaccuggaacgacggcgacgccauguaccugggcuucgccgccggcgccgaaauguuccuccaaacauucaccuucuucccccucgucaucgaaaugcaccgcguccuuaaagacggcauggacgucaacuucaugaaaaaaguccuccgccaacgauacggccaaaaaaccgccgaacaauggaugcgagaagaaaucgucgccguucgcgccgcauucgaagccgucggcacacucgcaugggcacgcaccggcuucucccccgccgcccgcgacuuccuccgccaauccggcaucggcauauaa

SEQ ID NO: 8256 - RNA, 696 nt, Artificial Sequence
  derived and/or modified CDS sequence (opt11) from OROV(BeH121923)__HM470110.1__N
auguccgaauucaucuucaacgacgucccccaacgcaccaccuccuccuucgacccugaagccgccuacgucgccuucgaagcccgcuacggccaaguccucaacgccugcgucguccgcgucuucuuccuaaaccaaaaaaaagccaaagacguacuccguaaaaccucauggccaauggucgaccucaccuucggccgcguccaauucgccauggucaacaaccacuucccccaauuccaauccaaccccguccccgacaacggccucgcccuccaccgacucuccggcuaccuagcccgaugggccuucacccaaaugcgcucccccaucaaacaagccgaguuccgcgccaccgucgucgucccccucgccgaagucaaaggcugcaccuggaacgacggcgacgccauguaccucggcuucgccgcaggcgccgaaauguuccuccaaaccuucacauucuucccccucgucaucgaaaugcaccgcguccucaaagacggcauggacgucaacuucaugaaaaaaguccuccgccaacgauacggccaaaaaacagccgaacaauggaugcgcgaagaaaucguagccgucagagccgccuucgaagcagucggcacccucgccugggcccgcaccggcuucucccccgccgcccgcgacuuccuccgccaauucggcauugacaucuaa

SEQ ID NO: 8257 - RNA, 696 nt, Artificial Sequence
  derived and/or modified CDS sequence (opt11) from OROV(BeH379693)__AF164534.1__N
auguccgaauucaucuucaacgacgucccacaacgcacaacauccaccuucgaccccgaagccgccuacguagccuucgaagcccgcuacggccaaguccucaacgccggcgucguacgcguauucuuccucaaccaaaaaaaagccaaagacguccuccgccgaaccucccgccccauggucgaccucaccuucggcggaguacaauucgccauggucaacaaccacuucccccaauuccaauccaacccaguccccgacaacggccucacccuacaccgccucuccggcuaccucgcccgcugggccuucacccaaaugcgcucacccaucaagcaagccgaauuccgcgccaccgucgucgucccccucgccgaagucaaaggcugcaccuggaacgacggcgacgccauguaccucggcuucgcugccggcgccgaaauguuccuccaaaccuucacauucuucccccuagucaucgaaaugcaccgcguccucaaagacggcauggacgucaacuucaugaaaaaaguccuccgccaacgcuacggccaaaaaaccgccgaacaauggaugcgcgaagaaaucgucgccguccgcgccgccuucgaagccgucggcacacucgccugggcccgcaccggauucucgcccgccgcccgcgacuuccuccgacaauucggcaucggaaucuaa

SEQ ID NO: 8258 - RNA, 696 nt, Artificial Sequence
  derived and/or modified CDS sequence (opt11) from OROV(BeH381114)__AF164535.1__N
augucugaauucaucuucaacgacgucccccaacgcaccaccuccaccuucgaccccgaagccgccuacgucgccuucgaagcccgauacggccaaguccuaaacgccggaguaguacgcgucuucuuccucaaccaaaaaaaagccaaagacguccuccgcaaaacaucacgccccauggucgaccucaccuucggcggcguccaauucgccauggucaacaaccacuucccccaauuccaauccaaccccguccccgacaacggccucacccuacaccgccucucaggcuaccucgcccgcugggccuucacccaaaugcgcucacccaucaaacaagccgaauuccgcgccaccgucgucgucccccucgccgaaguaaaaggcugcacauggaacgacggcgacgccauguaccucggauucgccgccggcgcagaaauguuccuccaaacauucaccuucuucccccucgucaucgaaaugcaccgcguccuuaaagacggcauggacgucaacuucaugaaaaaaguacuccgccaacgcuacggccaaaaaaccgccgaacaauggaugcgcgaagaaaucgucgccguacgcgcagccuucgaagccgucggcacacucgccugggcccgaaccggcuucucccccgccgcccgcgacuuccuacgccaauucggcaucugcaucuag

SEQ ID NO: 8259 - RNA, 696 nt, Artificial Sequence
  derived and/or modified CDS sequence (opt11) from OROV(BeH390233)__AF164536.1__N
auguccgaauucaucuucaacgacgucccccaacgcaccaccuccaccuucgaccccgaagccgccuacgucgccuucgaagcccgcuacggccaaguacucaacgccggcguaguccgcgucuucuuccucaaccaaaaaaaagccaaagacguccuccgcaaaacaucccgcccaauggucgacuuaaccuucggaggcguccaauucgccauggucaacaaccacuucccccaauuccaauccaaccccguccccgacaacggccuaacccuccaccgccucuccggcuaccucgcccgcugggcauucacccaaaugcgcucccccaucaaacaagccgaauuccgcgccaccgucguuguaccccucgccgaagucaaaggcugcaccuggaacgacggcgacgccauguaccucggcuucgccgccggagccgaaauguuccuccaaaccuucaccuucuucccccucgucaucgaaaugcaccgcguccucaaagacggcauggacgucaacuucaugaaaaaaguccuaagacaacgcuacggacaaaaaaccgccgaacaauggaugcgcgaagagauagucgccguacgcgccgcauucgaagccgucggcacccucgccugggcacgcaccggcuucuccccagccgcccgcgacuuccucggccaauucggcaucggcaucuaa

SEQ ID NO: 8260 - RNA, 696 nt, Artificial Sequence
  derived and/or modified CDS sequence (opt11) from OROV(BeH472204)__AF164538.1__N
augagcgaauucaucuucaacgacgucccccaacgcaccaccuccaccuucgacccagaagccgccuacgucgccuucgaagcccgcuacggccaaguccucaaugccggcgucguccgcgucuucuuccucaaccaaaaaaaagcaaaagacguccuccgcaaaaccucccgaccaauggucgaccuaaccuucggcggcguccaauuugcaauggucaacaaccacuucccccaauuccaaucaaaccccguccccgacaacggccucacccuccaccgccuguccggcuaccuagcccgaugggccuucacccaaaugcgcucccccaucaaacaagccgaauuccgcgccacagucgucgucccccucgccgaagucaaaggcugcacauggaacgacggcgacgccauguaccucggcuucgccgccggcgcagaaauguuccuccaaaccuucaccuucuucccccuaguaaucgaaaugcaccgcguccuaaaagacggcauggacgucaacuucaugaaaaaaguccuccgccaacgcuacguccaaaaaaccgccgaacaauggaugcgagaagaaaucgucgccguccgcgccgccuucgaagccguaggcacccuagccugggcccgcaccggcuucucacccgccgcacgagacuuccuccgccaauucggcaucggcaucuaa

SEQ ID NO: 8261 - RNA, 696 nt, Artificial Sequence
  derived and/or modified CDS sequence (opt11) from OROV(BeH505442)__AF164542.1__N
augucagaauucaucuucaacgacgucccccaacgcaccaccuccaccuucgacccagaagccgcauacgucgccuucgaagcccgcuacggccaaguacucaacgccggcgucguccgagucuucuuccuaaaccaaaaaaaagccaaagacguccuacgaaaaaccagccgcccaauggucgaccucaccuucggcggcguacaauucgccauggucaacaaccacuucccccaauuccaaagcaaccccguccccgacaacggccucacacugcaccgccucucaggcuaccucgcccgcugggccuucacccaaaugcgcagccccauaaaacaagcagaauuccgcgccaccgucguagucccccucgccgaagucaaaggcugcaccuggaacgacggcgacgccauguaccucggcuucgccgccggcgccgaaauguuccuccaagccuucaccuucuucccccuagucaucgaaaugcaccgcguccuuaaagacggcauggacguaaacuucaugaaaaaaguccuccgccaacgcuacggacaaaaaaccgccgaacaauggaugcgcgaagaaaucgucgccgucagagcagccuucgaagccgucggcacccuagccugggcccgcaccggcuucucccccgccgcccgcgacuuccuacgccaauucggcaucgacaucuaa

SEQ ID NO: 8262 - RNA, 696 nt, Artificial Sequence
  derived and/or modified CDS sequence (opt11) from OROV(BeH541863)__AF164544.1__N
augagcgaauucaucuucucagacgucccccaacgcaccaccuccacuuucgaccccgaagccgccuacgucgccuucgaagcccgcuacggccaaguacucaacgccggcgucguccgagucuucuuccucaaccaaaaaaaagccaaagacguccuccgaaaaaccucccgccccauggucgaccucaccuucggcggcguacaauucgccauggucaacaaccacuucccccaauuccaauccaacccaguccccgauaacggccuaacccuacaccgacuuuccggcuaccucgcacgcugggccuucacccaaaugcgcucccccaucaaacaagcagaauuccgcgccaccgucgucguaccccucgccgaagucaaaggcugcaccuggaacgacggugacgccauguaccucgguuucgccgccggcgccgaaauguuccuccaaacauucaccuucuucccucucgucaucgaaaugcaccgcguccucaaagacggcauggacgucaacuucaugaaaaaaguccuacgacaacgcuacggccaaaaaaccgccgaacaauggaugcgcgaagaaaucgucgcaguacgagccgccuucgaagccgucggaacccucgccugggcccgcacaggcuucucccccgcagcccgcaacuuccuccgccaauucggcaucggaaucuaa

SEQ ID NO: 8263 - RNA, 696 nt, Artificial Sequence
  derived and/or modified CDS sequence (opt11) from OROV(BeH543033)__AF164545.1__N
auguccgaauucaucuucaacgacgucccacaacgcaccaccuccaccuucgaccccgaagccgccuacgucgccuucgaagcccgauacggacaaguccucaacgccggagucguccgcgucuucuuccuaaaccaaaaaaaagccaaagacguccuccgcaaaaccucacgccccaugguagaccuaacauucggcggcguccaauucgccauggucaacaaccacuucccacaauuccaauccaacccaguccccgacaacggccucacccuccaccgccucuccggcuaccucgcccgcugggccuucacacaaaugcgcucacccaucaaacaggccgaauuccgcgccaccgucgucgucccccucgcagaagucaaaggcugcaccuggaacgacggcgacgccauguaccucggcuucgccgccggcgcagaaauguuucuccaaaccuucacauucuucccccucguaaucgaaaugcaccgcguucucaaagacggcauggacgucaacuucaugaaaaaaguccuccgccaacgauacggccaaaaaaccgccgaacaauggaugcgagaagaaaucgucgccguccgcgccgccuucgaagccgucggcacccucgccugggcccgcaccggcuucucccccgccgcccgcgaauuccuccgccaauucggcaucggcaucuaa

SEQ ID NO: 8264 - RNA, 696 nt, Artificial Sequence
  derived and/or modified CDS sequence (opt11) from OROV(BeH543618)__AF164548.1__N
augcaagaauucaucuucaacgacgucccccaacgaaccaccuccaccuucgaccccgaagccgccuacgucgccuucgaagcccgcuacggacaaguccuaaacgccggcgucguacgagucuucuuccuaaaccaaaaaaaagccaaagauguacuccgcaaaaccagccgaccaauggucgaccucacauucggcggcguacaauucgcaauggucaacaaccacuucccccaauuccaauccaaccccguccccgacaacggccucacccuccaccgccucuccggcuaccucgcccgcugggccuucacccaaaugcgcuccccaaucaaacaagccgaauuccgagccaccgucgucgucccccucgcagaagucaaaggcugcaccuggaacgacggcgacgccauguaccucggcuucgccgccggcgccgaaauguuccuacaaaccuucaccuucuucccccucguaaucgaaaugcaccgcguccucaaagacggcauggacgucaacuucaugaaaaaaguccuccgccaacgcuacggccaaaaaaccgccgaacaauggaugagagaagaaaucgucgccguccgcgccgccuucgaagccgucggcacccuagccugggcccgcacaggcuucucccccgcagcccgcgacuuucuccgccaauucggcaucggcaucuaa

SEQ ID NO: 8265 - RNA, 696 nt, Artificial Sequence
  derived and/or modified CDS sequence (opt11) from OROV(BeH544552)__AF164546.1__N
auguccgaauucauauucaacgacgucccccaacgcaccacauccacauucgaccccgaagccgccuacgucgccuucgaagcccgcuacggacaaguccucaacgccggcgucguccgcgucuucuuccucaaccaaaaaaaagcaaaagacguccuccgcaaaaccucccgccccauggucgaccucaccuucggcggcguccaauucgcaaugguaaacaaccacuucccccaauuccaauccaaccccguccccgacaacggccucacccuccaccgccucucaggcuaccuagcccgcugggccuucacccaaaugcgcucacccaucaaacaagccgaauuccgcgccaccguagucguaccccucgccgaaguaaaaggcugcaccuggaacgacggcgacgcaauguaccucggcuucgccgccggcgccgaaauguuccuccaaaccuucaccuucuucccccucgucauagaaaugcaccgaguacucaaagacggaauggacgucaacuucaugaaaaaaguccuacgccaacgcuacggccaaaaaaccgccgaacaauggaugcgcgaagaaaucgucgccgucagagccgccuucgaagccgucggcacccucgccugggcccgcaccggcuucucacccgccgcccgcgacuuccuaagacaaaucggcauaggcaucuaa

SEQ ID NO: 8266 - RNA, 696 nt, Artificial Sequence
  derived and/or modified CDS sequence (opt11) from OROV(GML444911)__AF164556.1__N
auguccgaauucaucuucaacgacgucccccaacgcaccaccuccaccuucgaccccgaagcagccuacgucgccuucgaagcccgcuacggccaaguccucaacgccggcguaguccgcgucuucuuccucaaccaaaaaaaagccaaagacguccuccgcaaaaccucccgccccauggucgaccucaccuucggcggcguccaauucgccauggucaacaaccacuucccccaauuccaauccaaccccguccccgacaacggccucacacuccaccgccucucaggcuaccuagcacgaugggcauucacccaaaugcgauccccaaucaaacaagcagaauuccgcgccacaguaguagucccccucgccgaagucaaaggcugcacauggaacgacggcgacgccauguaccuaggcuucgccgccggcgccgaaauguuccuccaaaccuucaccuucuucccccucgucaucgaaaugcaccgaguccucaaagacggcauggacgucaacuucaugaaaaaaguccuccgccaaagauacggccaaaaaaccgccgaacaauggaugcgcgaagaaaucgucgccguccgagccgcauucgaagcagucggaacacucgccugggcccgcaccggcuucucccccgcagcccgcgacuuccuacgccaauucggcaucuacaucuaa

SEQ ID NO: 8267 - RNA, 696 nt, Artificial Sequence
  derived and/or modified CDS sequence (opt11) from OROV(IQT4083)__AF164552.1__N
auguccgaauucaucuucaacgacgucccccaacgcaccacaucaaccuucgaccccgaagccgccuacguagccuucgaagcccgcuacggccaaguccucaacgccggcgucguccgcgucuuuuuccuaaaccaaaaaaaagccaaagacguccuccgcaaaaccucccgccccauggucgaccucaccuucggcggcguacaauucgccauggucaacaaccacuucccccaauuccaauccaaccccguccccgacaacggacuaacccuccaccgacuauccggcuaccucgcccgcugggccuucacccaaaugcgaucccccaucaaacaagccgaauuccgcgccaccgucgucgucccccucgccgaagucaaaggcugcaccuggaaugacggcgacgccauguaccuaggcuucgccgccggcgccgaaauguucuuacaaacuuucaccuucuucccacuagucaucgaaaugcaccgaguccucaaagacggcauggacguaaacuucaugaaaaaaguccuccgccaacgcuacggaaaaaaaaccgccgaacaauggaugcgcgaagaaauaguagcaguccgagccgccuucgaagccgucggcacccucgccugggcccgcaccggcuucucacccgccgcccgcgacuuccuacgccaauucggaauagacaucuaa

SEQ ID NO: 8268 - RNA, 696 nt, Artificial Sequence
  derived and/or modified CDS sequence (opt11) from OROV(PPS 522 H 669314)__EF467370.1__N
augucagaauucaucuccaacgacgucccacaccgcaccaccuccaccuucgacccagaagccgccuacgucgccuucgaagccagauacggccaaguccucaacgccggcgucguccgcguauucuuccucaaccaaaaaaaagccaaagacguccuacgcaaaaccucccgacccauggucgaccuaaccuucggcggcguccaauucgccauggucaacaaccacuucccacaauuccaauccaacccaguccccgacaacggccucacccuccaccgccuauccggcuaccuagcccgcugggccuucacccaaaugcgcucccccaucaaacaagccgaauuccgcgccaccgucguagucccccucgccgaagucaaaggcugcaccuggaacgacggcgacgccauguaccucggcuucgccgccggcgccgaaauguuccuccaaaccuucaccuucuucccccucgucaucgaaaugcaccgcguccucaaagacggcauggacguaaacuucaugaaaaaaguccuccgccaacgcuacggccaaaaaaccgccgaacaauggaugagagaagaaaucgucgccguccgcgcagccuucgaagccgucggcacccucgccugggcccgaaccggcuucucccccgcagcccgcgacuuccuacgccaauucggcauaugcaucuaa

SEQ ID NO: 8269 - RNA, 696 nt, Artificial Sequence
  derived and/or modified CDS sequence (opt11) from OROV(TVP-19254/GML-480914)__KP795083.1__N
auguccgaauucaucuucaacgacgucccccaacgaacaacauccaccuucgaccccgaagccgccuacgucgccuucgaagcacgcuacggccaaguccucuccgccggcgucguccgaguauucuuccucaaccaaaaaaaagccaaagacguccuccgcaaaacaucccgcccaauggucgaccucaccuucggcggcguacaauucgccauggucaacaaccacuucccccaauuccaaucaaaccccguccccgacaacggccuaacccuacaccgucucuccgguuaccucgcccgcugggccuucacccaaaugcgaucccccaucaaacaagccgaauuccgcgccaccguaguagucccccucgccgaagucaaaggcugcaccuggaacgacggcgacgccauguaccucggauucgccgccggcgccgaaauguuccuccaaaccuucacguucuucccccucgucaucgaaaugcaccgcguccuaaaagacggcauggacgucaacuucaugaaaaaaguccuacgccaacgcuacggccaaaaaaccgccgaacaauggaugcgagaagaaaucguagcaguccgcgccgccuucgaagccgucggcacccuagccugggcccgcaccggcuucucccccgccgcccgagacuuccuccgccaauucggcaucgacaucuaa

SEQ ID NO: 8270 - RNA, 696 nt, Artificial Sequence
  derived and/or modified CDS sequence (opt11) from OROV(TVP-19256/IQE-7894)__KP795086.1__N
auguccgaauucaucuucaacgacguaccccaacgcaccaccucaaccuucgaccccgaagccgccuacgucgccuucgaagcccgauacggccagguccucaacgccggcguagucagagucuucuuccucaaccaaaaaaaagccaaagacguccuacgcaaaaccucacgccccauggucgaccucacuuucggcggcguccaauucaccauggucaacaaccacuucccacaauuccaaucaaaccccgucccagacaacggacuaacccuccaccgccucuccggcuaccucgcccgcugggccuucacacaaaugcgcucacccaucaaacaagccgaauuccgagccaccgucgucgucccacuggccgaagucaaaggcugcaccuggaacgacggcgacgccauguaccucggauucgccgccggcgcugaaauguuccuccaaaccuucacauucuucccccucgucaucgaaaugcaccgcguccucaaagacggcauggacgucaacuucaugaaaaaaguccuccgccaacgauacggccaaaaaaccgccgaacaauggaugcgcgaagaaaucgucgcaguccgcgcugccuucgaagccgucggcacccuagccugggcacgcaccggcuucucccccgccgcccgcgacuuccuacgccaauucggaaucgacaucuaa

SEQ ID NO: 8271 - RNA, 696 nt, Artificial Sequence
  derived and/or modified CDS sequence (opt11) from OROV(TVP-19258/IQT-4083)__KP795092.1__N
auguccgaauucaucuucaacgacguaccccaacgcaccaccuccaccuucgaccccgaagcagccuacgucgccuucgaagcccgauacggccaaguccucaacgccggagucguccgcguauucuuccucaaccaaaaaaaagccaaagacguccuacgaaaaaccucacgacccaugguagaccuaaccuucgguggcguccaauucgccauggucaacaaccacuucccacaauuccaaagcaaccccguccccgacaacggccucacccuccaccgccucuccggauaccucgcccgaugggccuucacccaaaugcgcucccccaucaaacaagccgaauuccgcggaaccgucgucgucccccuagccgaagucaaaggaugcaccuggaacgacggcgacgccauguaccucggcuucgccgccggcgccgaaauguuccuccaaacuuucaccuucuucccacucgucaucgaaaugcaccgcguccucaaagacggcauggacgucaacuucaugaaaaaaguccuccgacaacgcuacggacaaaaaaccgccgaacaauggaugagagaagaaaucgucgccguccgagccgccuucgaagcggucggcacccucgccugggcccgcaccggcuucucccccgccgcccgcgacuuccucagacaauucggcaucgacaucuga

SEQ ID NO: 8272 - RNA, 699 nt, Artificial Sequence
  derived and/or modified CDS sequence (opt11) from OROV/FPV(Aus Ch 16129)__AF362400.1__N
augacagacuucgucuucaacgacgucccccaacgagccaccucaacauucgacccagaagcagccuacgucgccuucgaaaaccgcuuccgcgccaaccucaccgucgacgucgcccgcaucuucuuccucaaccaaaaaaaagcaaaagaccgccucgcaaaaaccgcccgcgccaccguagacauaacauucggcggcgucgucuuccccgucguaaacaaucacuaccccgaauaccaacgcaaccccguaccagacgacggccucacccuacaccgccuauccggcuaccuagcccgauggcucaucgaccaaugcaacgcaucccccguccgcaugaccgaaauacgcacaaaaguaaucaucccccucgccgaagucaaaggcugcaccuggaacgacggcgccagcauguaccucggcuucgccgcaggcgccgaaauguuccuccaauccuucaccuucuacccccucgucauagaaaugcaacgcguccuaaaagacggcauggacgucaacuucaugcgcaaaguccucagacaacgcuacggcaccaaaaccgccgaacaauggaugcgcgacgacauagucgccgucaaaaccgcauucgaagccaucaacaccaucuccugggcccgcucaggcuucucccccgccgcccgcgaauuccuccgccaauucggcaucaacaucuaa

SEQ ID NO: 8273 - RNA, 696 nt, Artificial Sequence
  derived and/or modified CDS sequence (opt11) from OROV/IQTV(IQE3728/PER/06)__KF150535.1__N
auguccgaauucaucuucaacgacguuccccaacgcaccaccuccaccuucgacccagaagcagccuacgucgccuucgaagcccgcuacggacaaguccucaacgcaggcgucguccgcguauucuuccuaaaccaaaaaaaagccaaagacguccuccgcaaaaccucccgccccauggucgaccucaccuucggcggcguccaauucgccauggucaacaaccacuucccccaauuccaauccaaccccguccccgacaacggccucacccuccaccgacucucaggauaccucgcccgcugggcuuucacacaaaugagaucccccaucaaacaagccgaauuccgcgccaccgucgucguaccccucgccgaagucaaaggcugcaccuggaacgacggcgacgccauguaccuaggcuucgcagccggcaccgaaauguuccuccaaaccuucaccuucuucccccucgucaucgaaaugcacagaguccucaaagacggcauggacgucaacuucaugaaaaaaguccuccgccaacgauacggccaaaaaaccgcagaacaauggaugcgagaagaaaucgucgccguccgcgccgccuucgaagccgucggcacccucgccugggcccgcacaggcuucucccccgccgccagagacuuccuacgccaauucggaaucggaaucuaa

SEQ ID NO: 8274 - RNA, 699 nt, Artificial Sequence
  derived and/or modified CDS sequence (opt11) from OROV/UTIV(Be An 84785)__KF697156.1__N
auggccgaauucgucuucaacgacgugccccaacgcuccaccucaaccuucgaccccgaagucgccuacgccacauucgaagccgcauuccgccaaacccucaacgucaacgucguccgagucuucuuccucaaccaaaaaaacgccaaaaacguccuccgcaaaacaucccgccccaacgucgaccucaccuucggaggcgccaccuuccccauagucaacaaccacuucccccaauuccaauccaaccccguccccgacaacggccucacccuccaccgccucagcggcuaccucgcccgcugguccauggaccaaaugcgcacaaaccccauccgccaagccgaauuccgcgccgccgucguagucccccucgccgaaaucaaaggcugcaccuggaacgacggcgacgccauguaccucgccuucgccgcaggagcagaaauguuccucaacaccuucaccuucuucccccucgucaucgaaaugcaccgaguccucaaagacggcauggacgucaacuucaugcgcaaaguccuccgccaacgcuacggcaccaaaaccgccgaacaauggaugaaagacgaaauaauccccaucaaagccgccuucgaagccgucggaaugcuaucaugggcccgcaccggcuucucccccgcagcccgcgacuuccuccgccaauucggcaucaacgucuaa

SEQ ID NO: 8275 - RNA, 738 nt, Artificial Sequence
  derived and/or modified CDS sequence (opt11) from HRTV(TN)__KJ740146.1__N
augaccgacuggucggccauagccguggaaauaggcaacgaaccgcuagacgucccggcccuggucgaguucgcgaaagagaucgcguacgagggccuggacccggccgugaucuugggcuugcucagggaaaggggcggagaaaauuggaggaacgacgucaaauacauaaucguguucgcgcucacgcgcgggaacaagauagugaaagcgugcgggaaaaugaguaagaaaggggccgagcgaaugaccaaccucgcgcgcguguacgagcucaaggaaaaugccguggacaggauggcggucacgcccgugcguguggcccagugccuacccacauggacgugcgcagccgcggccgcgaucaaggaauaccucccggucgggcccgcgaucaugcacaacaaaauacaaggguacccacuagagaugaugugcauggccuucggcucgcucauaccccaggccgacgucucgaucgaggucauaaaagauuucauggacgcguacucgcucuggcaagauaccuuugccaggaccauaaacguagaccagcgcaagaugacgaaagcggaaguauacgcgaaauuccgcgacccacugcacgcggccgugaacagccucuucuucccaaacgcaaccaggaucucguggcugcaagcgaaagggcuccugaccgcaaccaaggaagcgucggggagcgugaaagcggccgcggccgcguacaggaacauguga

SEQ ID NO: 8276 - RNA, 738 nt, Artificial Sequence
  derived and/or modified CDS sequence (opt11) from HRTV(Patient1)__JX005842.1__N
augaccgacuggucggccauagcaguggaaauaggcaacgaaccgcucgacgucccagcccuggucgaguucgcaaaagagauugcguacgagggccuggacccggccgugaucuucggcuugcucagggaaaggggcggagaaaacuggaggaacgacgucaaauacauaaucguguucgcgcucacgcgagggaacaagaucguaaaagcgugcggaaaaaugagcaagaaaggagcagaacgcaugacaaaucuagcgcgaguguacgagcucaaggaaaacgccguggacaggauggcagucacgcccgugcgaguggcacagugcuugcccacguggacaugcgcggccgcggccgcgaucaaggaauaucucccagucgggcccgcgauaaugcacaacaaaauacaaggguacccgcucgagaugaugugcauggccuuuggcucgcucauaccacaggccgacguaucgaucgaggucauaaaagacuucauggacgcguacucgcucuggcaagacaccuuugccaggacaauaaacguggaccagcgcaagaugacgaaagcggaagucuacgcgaaauuccgcgacccacugcacgcggcagugaacucacucuuuuucccgaacgcgaccaggaucucguggcugcaagcaaaagggcuccugaccgcgaccaaggaagcgagcgggagcgugaaagcggccgcggccgcguacagaaacauguga

SEQ ID NO: 8277 - RNA, 738 nt, Artificial Sequence
  derived and/or modified CDS sequence (opt11) from HRTV(Patient2)__JX005843.1__N
augaccgacuggucggcaauagccguggaaauaggcaacgaaccacucgacguaccggccuuggucgaguucgcgaaagagaucgcguacgagggcuuagacccggccgugauauugggccugcucagggaaaggggcggagaaaacuggaggaacgacgucaaguacauaaucguauucgcgcuaacgcgcgggaacaagaucgugaaagcgugcgggaaaaugagcaagaaaggggccgagcgaaugaccaaucucgcacgaguguacgagcucaaagaaaacgccguggacagaauggcggucacgcccguacgaguggcccagugccugcccacauggacaugcgcggcagcggccgccaucaaggaauaccucccggucgggcccgcaaucaugcacaacaaaauacaaggguacccgcucgagaugaugugcauggccuucggcucgcucauaccccaggccgacgucucgaucgaagucauaaaagacuucauggacgcguacucacuauggcaagacacauucgccaggaccauaaacguagaccagcgcaagaugacgaaagcagaaguguacgcgaaauuucgcgacccccugcacgcggccguaaacucacucuucuucccgaacgcgaccagaaucucguggcugcaagcgaaagggcuccugaccgcgaccaaggaagcgagcggaagcgucaaagcggccgcggccgcguaccggaacauguga

SEQ ID NO: 8278 - RNA, 732 nt, Artificial Sequence
  derived and/or modified CDS sequence (opt11) from PTV(PAN472868)__NC_027202.1__N
auguccuacgaagaaaucgccguccaauucgcauccgaaucaaucgacgaacaagcagucgccggcuggguaaccgacuucgcauaccaaggcuucgacgccaaacgcgucaucgcccuugucaaagaccgcggcggcgaagacuggaaacaagacgucaaaaaaaugauaguccuaucacucacacgcggcaacaaaccaaacaaaaugguccucaaaauguccgacaaaggcaaagccauggucaacgaacucguccuaaaauacaaacucaaauccggcaaccccucccgcgacgaccucacccuaucccgcauaaccgccgcauucgccggcuggaccugccaagccgccgacuacguccaagaauaccuacccgucaccggccgcgccauggacgcaaucuccucauccuacccccgagcaaugaugcaccccagcuucgccggccucaucgaccaagaacuccccgccgacguccuuucagaaaucacacaagcacacugccucuucaugauacaauucuccaaaaccaucaaccccucccuccgcggccucuccaaagacgaaaucgucucauccuucgaacgccccaugcaagccgccaucucauccaccuuccucaccucugcaaaccgccgagcaaugcucaaaacccucggcaucaucaacgacaaccuaaaacccuccuccuccaccguuucagccgccaaagucuuccgcucccucuaa

SEQ ID NO: 8279 - RNA, 732 nt, Artificial Sequence
  derived and/or modified CDS sequence (opt11) from PTV(Adames)__KR912210.1__N
augucuuacgaagaaaucgccguacaauucgccagcgaauccaucgacgaacaagcaguugcaggaugggucaccgacuucgccuaccaaggcuucgacgcaaaacgagucaucgcccucgucaaagagcgcggcggcgaagacuggaaacaagacgucaagaaaaugaucguccucucacucacccgaggcaacaaacccaacaaaaugguccuaaaaauguccgacaaaggcaaagccauggucaacgaacucguccucaaauacaaacucaaauccggcaaccccucccgagacgaccuaacccucucccgcaucaccgcagccuucgccggcuggacaugccaagccgccgacuacguacaagaauaccuccccguaaccggccgcgccauggacaccaucuccucaggcuacccacgugccaugaugcaccccucauucgccggccucaucgaccaagaacuacccgccgacguccucuccgaaaucacccaagcccacugccucuucaugauccaauucuccaaaaccaucaaccccucccuccgaggacucucuaaagacgaaaucgucuccucauucgaacgccccaugcaagccgccaucucauccaccuuccuaaccuccgccaaccgacgcgccaugcucaaaacccucggaaucaucaacgacaaccuaaaacccucaucauccaccgucucagccgccaaagucuuccgcucccucuaa

SEQ ID NO: 8280 - RNA, 732 nt, Artificial Sequence
  derived and/or modified CDS sequence (opt11) from PTV(Balliet)__KR912211.1__N
augucauacgaagaaaucgccguccaauucgcuuccgaauccaucgacgaacaaaccguagccggcugggucaccgacuucgcauaccaaggcuucgacgcaaaaagaguaaucgcccucgucaaagaccgcggcggagaagacuggaaacaagacgucaaaaagaugaucguacucucccucacccgcggcaacaaaccuaacaaaaugauucucaaaauguccgacaaaggcaaagccauggucaacgaacucguccuaaaauacaaacucaaauccggcaaccccucccgcgacgaccucacacucucccgaaucaccgcagccuucgccggcuggaccugccaagccgcagacuacguccaagaauaccucccagucaccggccgcgccauggacgccaucuccuccuccuacccccgcgccaugaugcaccccuccuucgccggccucaucgaccaagaacuccccgccgacgucuucuccgaaaucacacaagcccacugccucuucaugauccaauucuccaaaaccaucaaccccucccuccgcggccucagcaaagacgaaaucgucuccuccuucgaaagacccaugcaagccgccaucuccuccaccuuccucaccuccgccaaccgccgcgccaugcuaaaaacccucggaaucaucaacgacaaccucaagcccuccuccagcaccgucuccgccgccaaagucuuccgcucccuauaa

SEQ ID NO: 8281 - RNA, 732 nt, Artificial Sequence
  derived and/or modified CDS sequence (opt11) from PTV(PaAR2381)__KP272006.1__N
auguccuacgaagaaaucgccguccaauucgccagcgaauccaucgacgaacaagccgucgccggaugggucaccgacuucgccuaccaaggauucgacgccaaacgagucaucgcccuagucaaagaccgaggcggcgacgacuggaaacaagacgucaagaaaaugaucguccuaucccucacacgcggcaacaaaccaaacaaaaugguccuaaaaaugagcgacaaaggcaaagccauggucaacgaacucguccucaaauacaaacucaaauccggcaaccccucccgagacgaccucacccuaucccgcauaaccgccgccuucgccggcuggaccugccaagcagccgacuacguccaagaauaccuccccgucaccggccgcgccauggacgccaucuccucauccuaccccagagccaugaugcaccccucauucgccggccucaucgaccaagaacucccagccgacguccuuuccgaaaucacccaagcacacugccucuucaugauccaauucuccaaaaccaucaaccccagccuccgcggccucucaaaagacgaaaucgucuccuccuucgaacgacccaugcaagccgccaucuccuccaccuuccuaacauccgccaaccgacgcgccaugcuaaaaacccucggcaucaucaacgacaaccuaaaacccagcuccucaaccgucagcgccgccaaagucuuccgcucccucuaa

SEQ ID NO: 8282 - RNA, 732 nt, Artificial Sequence
  derived and/or modified CDS sequence (opt11) from PTV(GML902876)__KP272012.1__N
augucauacgaagaaaucgcaguccaauucgccuccgaauccaucgacgaacaagccgucgccggcuggguaaccgacuucgccuaccaaggcuucgacgccaaacgcguaauagcacuagucaaagaccgcggcggagacgacuggaaacaagacgucaaaaaaaugaucguccuuucccucacccgcggcaacaaacccaacaaaaugguccucaaaauguccgacaaaggcaaagcaaugguaaacgaacuaguccucaaauacaaacucaaaucuggcaacccaucacgagacgaccucacccuaucccgcaucaccgccgcauucgccggcuggaccugccaagcagccgacuacguccaagaauaccuccccgucaccggccgugcaauggacgccaucuccuccuccuacccccgcgcaaugaugcacccauccuucgccggccucaucgaccaagaacuccccgcagacguccuauccgaaaucacccaagcacacugccucuucaugauccaauucuccaaaaccaucaacccaucccuccgcggccucuccaaagacgaaauagucuccuccuucgaacgccccaugcaagccgccaucuccucaaccuuccucacauccgccaaccgccgcgccaugcucaaaacccucggaaucauaaacgacaaccucaaacccuccagcuccaccgccuccgccgcaaaagucuucagaucccuauaa

SEQ ID NO: 8283 - RNA, 732 nt, Artificial Sequence
  derived and/or modified CDS sequence (opt11) from PTV(Adames)__KP272030.1__N
augucauacgaagaaaucgccguacaauucgccuccgaaucaaucgacgaacaagccgucgccggcugggucacacacuucgccuaccagggcuucgacgccaaacgagucaucgcacucgucaaagaacgcggcggcgaagacuggaaacaagacgucaaaaaaaugaucguacucucccucacacgcggcaacaaacccaacaaaaugguacucaaaauguccgacaaaggcaaagccauggucaacgaacucguccucaaauacaaacuaaaauccggcaaccccucccgcgacgaccucacacucucccgcaucacagccgccuucgcaggauggaccugccaagccgccgacuauguacaagaguaccuaccagucaccggacgcgccauggacaccauuuccucuggcuacccccgagccaugaugcaccccuccuucgccggacucauagaccaagaacuccccgccgacguccuuucagaaaucacccaagcccacugccuguucaugauccaauucuccaaaaccaucaaccccucccuccgcggccucucaaaagacgaaaucgucuccuccuucgaacgccccaugcaagccgccaucuccuccaccuuccuuaccuccgccaaccgccgcgccaugcucaaaacccuaggcaucaucaacgacaaccucaaacccuccucauccaccgucucagccgccaaagucuuccgcucccucuaa

SEQ ID NO: 8284 - RNA, 735 nt, Artificial Sequence
  derived and/or modified CDS sequence (opt11) from Phlebovirus(CoAr171616)__HM566153.1__N
augagcuacgaagaaaucgccgucaacuucgcaucagaauccaucgacgaauccaccaucuccgccugggucuccgacuucgccuaccaaggcuucgacgcaaaacgcgucaucgcccucaucaaagaacgcggcggcgaaaacuggaaagaagacgucaaaaaaaugaucguccuaucccucacccgaggcaacaagcccgccaaaaugauccucaaaauguccgacaaaggcaaaaaagaagucaacgaccucaucacacgcuacaaacuaaaaagcggcaacccaucccgagacgaccucacccucucacgugucgcagccgccuucgcaggcuggacaugccaagccgccgaauacguccaagaauaccuccccgucaccggccgagccauggacgcauucuccgccgacuucccccgcgcccucaugcaccccagcuucgccggccucaucgaccaagaacuccccuccuccgccaugacagacaucguccacgcccacugccuauucaugauccaauucuccaaaaccaucaaccccaccauccgcucagccucaaaagacgaaaucgucgccucuuucgacagacccaugcaagccgcaaucaacuccaccuuccucaccuccgcccaacgccgcgccaugcucaaaacccucggcgucaucaacgacaaccuaaaagucagcaccgccgucucauccgccgccaaagcauucaagaaacuccaauaa

SEQ ID NO: 8285 - RNA, 735 nt, Artificial Sequence
  derived and/or modified CDS sequence (opt11) from Phlebovirus(CoAr171616)__EF201836.1__N
augagcuaugaagaaauagccauccacuucgccucagaauccaucgacgaauccaccaucucagccugggucagcgacuucgcauaccaaggcuucgacgccaaacgcgucauugcccucauaaaagaacgcggcggcgaaaacuggaaagaagacgucaaaaaaaugaucguccuaucccucacccgcggcaacaaaccagccaaaaugauccucaaaauguccgacaaaggcaaaaaagaagucaacgaccucaucacccgauacaaacucaaauccggaaaccccucacgagacgaccuaacccuaagccgagucgccgccgccuucgcuggcuggaccugccaagccgccgaauacguccaagaauaccuacccgucaccggccgcgcaauggacgcauucuccgccgacuucccccgagcccuaaugcaccccuccuucgccggccuaaucgaccaagaacuccccagcuccgcaaugaccgacaucguucacgcccacugccucuucaugauccaauucagcaaaaccauaaaccccaccauccgcuccgccucaaaagacgaaaucgucgcauccuucgacagacccaugcaagccgccaucaacuccaccuuccucaccuccgcccaacgccgcgccaugcucaaaacccucggcgucaucaacgacaaccucaaagucucaaccgccguuuccuccgccgcaaaagccuucaaaaaacuccaauaa

SEQ ID NO: 8286 - RNA, 732 nt, Artificial Sequence
  derived and/or modified CDS sequence (opt11) from Phlebovirus(CoAr170255)__EF201840.1__N
auguccuacgaagaaaucgccauccaauucgccucagaauccgucgacgcaaccaccaucgccgccuggguauccgaauucgccuaccaaggauucgacgcaagacaagucauaaaccucgucaaacaacgcggcggcgacgacuggaaagaagacgucaaaaaaaugaucguccucucgcucacccgcggaaacaaacccucaaaaaugcucaacaaaauguccgaauccggccaaaaaaucgucaacgaccucaucuccaaauacaaacucaaaucaggcaaccccggccgcaacgaccucacccucucccgcaucgccgccgccuucgccggcuggaccugccaagccgcagaagucguccaagacuaccuacccgucaccggccgagccauggacgcaaucucggauaaauucccccgcgcccucaugcaccccuccuucgccggccucgucgaccccacccuccccgaaggagucgucgaagacaucguccacgcccacugccuauucaugauccaauucucaaaaacaaucaaccccucgcuccgcuccucauccaaaagcgaagucgucagcucauucgaccgccccaugcaagccgccauaaacucccccuuccuuacagccggaaaccgccgagacauccucaugucccucggccuaaucaacagcaaccucaagcccucacccgccgucaucgcagcagccaaagucuaccgcaagcucuaa

SEQ ID NO: 8287 - RNA, 732 nt, Artificial Sequence
  derived and/or modified CDS sequence (opt11) from Buenaventura virus(CoAr3319)__KP272003.1__N
auguccuacgaagaaaucgccauacaauucgcauccgaauccgucgacgccaccacaaucgccgccugggucuccgaauucgccuaccaaggauucgacgcccgccaagucaucaaccucguaaaacaacgcggcggcgacgacuggaaagaagacgucaaaaaaaugaucguacucucccucacccgcggcaacaaacccuccaaaaugcucaacaaaauguccgaauccggccaaaaaaucgucaacgaccucauaucgaaauacaaauuaaagucuggcaaccccggccgaaacgaccuaacccucucccgcaucgccgccgccuucgccggcuggaccugccaagccgcugaagucguccaagacuaccuccccgucaccggccgcgccauggacgccaucuccgacaaauucccucgcgcccuaaugcaccccuccuucgccggccucgucgaccccacccucccagaaggcgucgucgaagacaucguccacgcccacugccuauucaugauccaauucucaaaaaccaucaaccccucccuccguuccuccucaaaauccgaaguagucucauccuucgaccgccccaugcaagccgcaaucaacucacccuuccucaccgccggcaaccgccgcgacauccucaugucacucggccuaaucaacuccaaccuaaaacccucacccaccgucgucgccgcggccaaagucuaccgcaaacucuaa

SEQ ID NO: 8288 - RNA, 732 nt, Artificial Sequence
  derived and/or modified CDS sequence (opt11) from Cocle virus(GML244915)__KP272035.1__N
auguccuacgaagaaaucgccguccaauucgccuccgaauccaucgacgaacaagccgucgccggauggguuaccgacuucgcauaccaaggcuucgacgcccgccgcgucaucgcacuugucaaagaccgcggcggcgaagacuggaaacaagacgucaagaaaaugaucguacuaucacucacccgcggaaacaaacccaacaaaaugguccucaaaauguccgacaaaggcaaagccauggucaacgaacucguccucaaauacaaacucaaaucaggcaaccccucccgcgacgaccucacacucucccgcaucaccgccgcauucgccggauggaccugccaggccgccgacuacguccaagaauaccuccccgucaccggccgcgccauggacgccaucuccucaggcuacccccgagccaugaugcacccauccuucgccggccucaucgaccaagaacuccccgccgacguccucuccgaaaucacacaagcucacugccuauucaugauacaauucuccaaaaccaucaaccccucccuccgaggccucggcaaagacgaaaucgucuccucauucgaacgucccaugcaagccgcaauauccuccaccuuccucaccucagccaaccgccgcgccaugcucaaaacccuaggcaucaucaacgacaaucucaaaccaucaagcuccaccgucuccgcagccaaaguauuccgaucacucuaa

SEQ ID NO: 8289 - RNA, 732 nt, Artificial Sequence
  derived and/or modified CDS sequence (opt11) from Capira virus(VP-366G)__KP272044.1__N
auguccuacgaagaaaucgccauccaauucgccuccgaauccaucgacgaauccaccaucgcagcaugggucuccgacuucgccuaccaaggauucgacgccaaacaagucauaauccucaucaaaaaacgcggaggcgaaaacuggaaagaagacgucaaaaaaaugauaguccucucccuaacccgaggcaacaaaccuuccaaaauggucaacaaaauguccgacgaaggcaaaaaagucgucaacgaacucaucuccaaauacaaacucaaaacuggcaacccagcccgcgacgaccuuacccucucccgcaucgccgccgccuucgccggcuggaccugccaagccgccgaauacguccaagacuaccuccccguaaccggccgcgccauggacgcccucucagacaaauacccccgcgcccuaaugcaccccuccuucgccggacucaucgaccccacccucccagacgacgccgucaaagacaucguccacgcccacugccucuucaugauccaauucuccaaaaccaucaaccccucccuccgcucauccaccaaaaccgaaauagucaacuccuucgaccgcccaaugcaagccgccaucaacucucccuuccuaaccgccgaaaaccgccgcgccaugcuaaccacccucggcgucaucaacucuaaccuaaaacccuccgccgccgucgucgcagccgccaaggccuaccgcaaacuauaa

SEQ ID NO: 8290 - RNA, 732 nt, Artificial Sequence
  derived and/or modified CDS sequence (opt11) from Campana virus(VP-334K)__KP272042.1__N
auguccuacgaagaaaucgccauacaauucgccuccgaauccgucgacgccaccaccaucgccgccugggucuccgaauucgccuaccaaggcuucgacgcccgccaaguaaucaaccuagucaaacaaagaggcggcgacgacuggaaagaagacgucaaaaaaaugauaguccuaucacucacccgcggcaacaaacccucccgcauggucacaaaaaugucagaauccggccaaaaaauagucaacgaccucaucuccaaauacaaacucaaauccggcaacccaggccgcaacgaccucacccucucccgcguagccgccgccuucgccggcuggaccugccaggccgccgaagucguacaagacuaccuccccgucaccggccgcgccauggacgcccuauccgacaaauucccccgcgccaucaugcaccccuccuucgccggccucauagacccaacccuacccgaaaacgucgucgaagacauaguacacgcccacugccucuucaugauccaauucuccaaaaccauaaaccccucccuccgauccuccuccaaauccgaagucguauccucauucgaccgccccaugcaagccgccaucaacucacccuuccucaccgccgccaaccgccgagacaugcuaaugucccucggccucaucucguccaaccucaaacccuccgcagccgucacagccgccgcaaaagccuaccgcaaacucuaa

SEQ ID NO: 8291 - RNA, 738 nt, Artificial Sequence; identical to SEQ ID NO: 7599
  derived and/or modified CDS sequence (opt11) from RVFV(ZH-548)__DQ380151.1__N

SEQ ID NO: 8292 - RNA, 738 nt, Artificial Sequence; identical to SEQ ID NO: 7600
  derived and/or modified CDS sequence (opt11) from RVFV(OV 35/74)__EF530207.1__N

SEQ ID NO: 8293 - RNA, 762 nt, Artificial Sequence
  derived and/or modified CDS sequence (opt11) from SFNV(Toscana)__NC_006318.1__N
augucggacgagaacuaccgcgacaucgcgcucgcguucuuagacgaaagcgcagacucgggcacaaucaacgccugggucaacgaguucgccuaccaaggguucgacccaaagcgcauaguccagcucguaaaagaaagagggacagccaaagggagagacuggaagaaagacgucaagaugaugauagugcucaaccucgugcgagggaacaagccagaggcaaugaugaagaaaaugagcgagaaaggagcaucgauaguggccaaccucauaagcguguaccagcucaaggaagggaacccgggcagggacacgauaacgcuaucgcgcguaagcgcggcauucgucccguggacgguccaggcccugcgcguacucucagaaucgcucccgguaucaggcacgaccauggacgcaaucgcgggcgugacauacccaagggccaugaugcacccaucguucgcgggcauaaucgaccuagaccucccgaacggggcaggggccacgauagcggacgcgcacgggcuauucaugauagaguucagcaagaccauaaacccgagcuugcgcacgaaacaggccaacgaaguggcagcgacauucgaaaagcccaauauggcggccaugagcgggcgcuucuucacgcgcgaagacaagaagaaacuacugaucgcggucggaaucauagacgaggaccugguccuggccucggccgugguaaggagcgcggaaaaauacagggccaaggucgggaaauag

SEQ ID NO: 8294 - RNA, 762 nt, Artificial Sequence
  derived and/or modified CDS sequence (opt11) from SFNV__HM566170.1__N
auguccgaagaaaacuaccgagaaaucgcccucgccuuccuagacgaagccgccgacucaggcaccaucaccgccuggguaaacgaauucgccuaccaaggcuucgacccaaaacgaaucguccagcucgucaaagaacgcggcaccgcaaaaggccgcgacuggaaaaaagacgucaaaaugaugaucguacucaaccucguacgcggcaacaaacccgaagcaaugaugaaaaaaauguccgaaaaaggcgccggcaucgucgcccaacucaucagcgucuaccaacucaaagaaggcaaccccggccgcgacaccaucacccucucccgcgucuccgccgccuucguccccuggacaauccaagcccuccgcguccucucagacucacuccccgucacaggcaccaccauggacgccaucgcaggcgucaccuacccccgagccaugaugcacccauccuucgccggaauaaucgaccucgaccuccccaaccgcgccggcgaagucaucgccgacgcccacgggcuauucaugcucgaauucagcaaaacaaucaaccccagccuccgcacaaaacaacccaacgaaaucgccgcaaccuucgaaaaacccaacauggccgccaugucaggacgcuucuucacccgcgaagacaaaaaaaaacuccuuauggccgucggaauacucaacgaagaccucguccuaacccccgccauagucaaaugcgccgaaaaauacugcuccaaagucggcaaauaa

SEQ ID NO: 8295 - RNA, 735 nt, Artificial Sequence
  derived and/or modified CDS sequence (opt11) from SFNV(Namru)__HM566168.1__N
auguccuacgaagaaaucgccgucaacuucgccagcgaauccaucgacgaauccaccauauccgccugggucuccgacuucgccuaccaaggcuucgacgccaaacgcgucaucgcacuaauaaaagaacgcggcggcgaaaacuggaaagaagacgucaaaaaaaugaucguucucucccucacccgcggcaacaaacccgccaaaaugauccucaaaauguccgacaaaggcaaaaaagaagucaacgaccuaaucacccgcuacaaacucaaauccggcaaccccucccgcgacgaccucacccucuccagagucgcagccgccuucgccggcuggaccugccaagcagccgaauacguccaagaauaccugcccguaaccggccgcgcaauggacgcauucuccgccgacuucccccgagcccucaugcaccccuccuuugccggccucaucgaccaagaacuccccuccucugccaugaccgacaucguccacgcccacugccucuucaugauacaauucuccaaaacaaucaaccccacaauacgauccgccuccaaagacgaaauagucgccuccuucgaccgccccaugcaagccgccauaaacucaaccuuccuaaccuccgcccaacgccgcgccaugcucaaaacacucggagucaucaacgacaaccucaaaguauccaccgccguauccuccgccgccaaagcauucaaaaaacuacaauaa

SEQ ID NO: 8296 - RNA, 762 nt, Artificial Sequence
  derived and/or modified CDS sequence (opt11) from SFNV(NAMRU 840055)__EF201828.1__N
augucagaagaaaacuaccgcgagaucgcccucgccuuccuagacgaagcagccgacucaggcaccaucaccgcauggguaaacgaauucgccuaccaaggauucgaccccaaacgaaucguccaacucgucaaagaacgcggcaccgcaaaaggccgagacuggaaaaaagacgucaaaaugaugaucguacuaaacuuaguccgcggcaacaaacccgaagcaaugaugaaaaaaaugagcgaaaaaggcgccggcaucgucgcccaacucauaagcgucuaccaacuacgcgaaggcaaccccggccgcgacacaauaacacucucacgagucagcgccgccuucgucccauggaccauacaagcccuaaaaguccucuccgacucacuacccgucaccggcaccacaauggacgcaaucgccggagucgucuacccccgagccaugaugcacccauccuucgcaggaaucaucgaccucgaccuccccaaccgagccggcgaagcaaucgccgacgcccacggacuauucaugcucgaauucuccaaaacaauaaaccccagccuccgcacaaaacaacccaacgaaaucgccgcaaccuucgaaaaaccaaacauggcagcaaugucuggccgcuucuucacacgagaagacaaaaaaaaacuccuaauggcagucggcauccucaacgaagaccugguacuaacccccgccaucguaaagugcgcagaaaaauaccgcagcaaagucggaaaauaa

SEQ ID NO: 8297 - RNA, 762 nt, Artificial Sequence
  derived and/or modified CDS sequence (opt11) from SFNV(NAMRU 840055)__EF201829.1__N
augucagaagaaaacuaccgcgagaucgcacucgcguuccuagacgaagcagcggacucgggaacaauuacggccugggucaacgaguucgccuaccaaggguucgaccccaagcgaaucguccagcucgugaaagaacgcgggaccgcaaaagggcgagacuggaagaaagacgucaagaugaugaucgugcuaaaccucgugcgcgggaacaagcccgaggccaugaugaagaagaugagcgagaaaggggccgggaucguagcccagcucauaagcguguaccagcucaaggaagggaacccgggcagggacacgaucacgcucucgcgcgugagcgcagccuucgucccguggacgauccaggcccugcgcgugcucucggacucgcucccgguaacgggcacaaccauggacgcaaucgcgggcgugacauaccccagggccaugaugcacccaucauucgcgggcauaaucgaccuagaccucccgaacagagccggugaagcgaucgcagacgcgcacggacucuucauguuggaguucagcaagaccauaaacccgagccugcgcacgaaacagcccaacgaaaucgccgcaacauucgaaaagcccaacauggcggccaugagcgggcgcuucuucacgagagaagacaagaaaaagcuacugauggcagucgggauccugaacgaggacuugguccuaaccccggccauagucaagugcgcggaaaaguacugcagcaaggucgggaaauaa

SEQ ID NO: 8298 - RNA, 762 nt, Artificial Sequence
  derived and/or modified CDS sequence (opt11) from SFNV(P-7101795)__EF201830.1__N
augucagaagaaaacuaccgcgagaucgcgcucgcguuccugaacgaggccgcagacucgggcaccaucacggccuggguaaacgaguucgcauaccaaggguucgacccaaagcgcauaguacagcucguaaaagaacgcgggaccgccaaagggcgcgacuggaagaaagacgucaaaaugaugaucguacucaaccucguacgcgggaacaagcccgagaccaugaugaagaaaaugagcgagaaaggggccgggaucguggcccagcucauaagcguguaccagcucaaggaagggaacccgggcagggacacgaucacgcucucgcgaguaagugcggccuucgucccguggacgguccaggcauugcgcguacucucggacucacucccggucacgggcacaaccauggacgcgaucgcgggcguaacauaccccagggccaugaugcacccaucauucgcgggaaucaucgaccuagaccuaccaaacagggccggggaaacgaucgcggaugcgcacggacuauucaugcuagaguucaguaagacaauaaacccgagccuacgcacgaaacagccaaacgaaauagccgcgaccuucgaaaagcccaacauggcggccaugagcggacgauucuucacgcgcgaagacaagaaaaagcucuugauggcggucgggguccugaacgaagaccugguacugacaccagccauagucaaaugcgcggaaaaauacaggagcaaagucgggaaauag

SEQ ID NO: 8299 - RNA, 762 nt, Artificial Sequence
  derived and/or modified CDS sequence (opt11) from SFNV(P-7101795)__EF201832.1__N
auguccgaagaaaacuaccgagaaaucgcccucgccuuccucgacgaagccgcagacuccggaaccaucaccgccugggucaacgaauucgccuaccaaggcuucgaccccaaacgcaucguacaacucguaaaagaacgcggcaccgcaaaaggcagagacuggaaaaaagacgucaaaaugaugauaguccucaaccucguccgcggcaacaaacccgaagcaaugaugaaaaaaauguccgaaaaaggcgccggcaucguagcccaacucaucuccgucuaccaacuacgcgaaggcaaccccggccgcgacacaaucacccucucacgcguaagcgcagccuucguccccuggaccauccaagcccucaaaguacucuccgacucccuccccguaacaggcacaaccauggacgccaucgccggcgucauguacccccgagccaugaugcaccccuccuucgccggcaucaucgaccucgaccuccccaaccgcgccggcgaagccaucgccgacgcacacggccucuucaugcucgaauucuccaaaaccaucaaccccucccuccgaacaaaacaacccaacgaaaucgccgcaaccuucgaaaaacccaacauggccgcaauguccggccgauucuucacccgagaagacaaaaaaaaacuccucauggccgucggcauccuaaacgaagaccucguccucacccccgccaucauaaaaugcgccgaaaaauaccgauccaaagucggcaaauaa

SEQ ID NO: 8300 - RNA, 762 nt, Artificial Sequence
  derived and/or modified CDS sequence (opt11) from Arrabida virus(PoSFPhlebV/126/2008)__KP863801.1__N
auguccgaagacaacuaccgcaccaucgcccucgccuuccucgacgaauccgccgacucaaccaccaucaacgcaugggucaacgaauucgccuaccaagguuucgaccccaaacgcauaguccaacuaguaaaagaacgcggcaccgcaaaaggacgcgacuggaaaaaagacgucaaaaugaugaucguccucaaccucguccgcggcaacaaacccgaauccaugaugaaaaaaauguccgaaaaaggcgccgccaucguaacacaacucaucuccaccuaccaacuaaaagaaggcaaccccggcagagacaccaucacccucucccgcgucagcgccgcauucguccccuggaccguccaagcccuaaaaacacucucagaaucacucccagucaccggcaccaccauggacucaaucgccggcaccaccuaccccagaugcaugaugcacccaagcuucgccggcaucaucgaccucgaacuacccaacaacaccggcgccaugcucgccgacgcccacggccucuucaugcucgaauucuccaaaacaaucaacccgucccuccgcaccaaacaacccaaugaaaucgccgcaacauucgaaaaacccaacauggcagccaugacaggccgcuucuucacccgcgacgacaaaaaaaaacuccucaucgccaucggcguacuagacgaagaccucgucccaaacccagcaaucgaaaaaugcgccgaaaaauacaaagccaaagucggcaaauaa

SEQ ID NO: 8301 - RNA, 765 nt, Artificial Sequence
  derived and/or modified CDS sequence (opt11) from Gordil virus(Dak ANBr 496d)__KF297902.1__N
augucggaagaaaacuaccgcgagaucgcaauggcguucgcgaacgacagcgcagacuucaacaugaucucgguuugggccaaugacuucgccuaccaaggauucgacccaaagcgcauagucgagcucgugcgccagcgcgggcuagcgaaagcgcgcaacuggaagcaagacgucaagaugaugaucgugcucaaccucaugcgcgggaacaagcccgaagcaauggucaggaaaaugcaagagaaagggcaaaggaucgugcucgagcucauaagcguguacgagcuaaaagaaggaaacccgggaagggacacaaucacgcuaucgcgcguguccgcggccuucgucccguggacgaucauggccuugcgccagcucgcggaaaacaucccggucacgggcucaaucauggacucgauccuggacggggccguguacccgcgcgcgaugaugcacccgagcuucgccgggaucauagaccuggaacuacccgaaggcaggggcgcggaacuagccgacgcccacggccuauucaugaucgaguucucgaaaacaaucaaccccucacuccggaccaagagcgcgauagagaucgcagccucguucgagaaaccaaacauggccgcgaugacaggcaacuucuucaccaaggacgauaaaaggaaauugcuaaagcaaauaggaauacuagacagcgaccucaagcucacgcccgugaucgagaaagcggccgcgcucuaccgcucaaaaacgaacaaguga

SEQ ID NO: 8302 - RNA, 762 nt, Artificial Sequence
  derived and/or modified CDS sequence (opt11) from Granada virus(GR25)__GU135608.1__N
auguccgaagacaacuaccgaaccaucgcccucgccuuccuagacgaaagcgcagacuccaccaccaucaacgccugggucaacgaauucgccuaccaaggcuucgaccccaagcgcaucguccaacucgucaaagaacgcggcaccgcaaaaggccgcgauuggaaaaaagacgucaaaaugaugaucguacuaaaccucguccgaggcaacaagccagaaagcaugaugaaaaaaaugagcgaaaaaggcgccgccaucgucacccaacucauaagcacguaccaacuaaaagaaggcaaccccggcagagacaccaucacacucucccgcgucagcgccgccuucgucccauggaccguacaagcucuaaaaacgcucuccgaaucacuccccgucacaggcacaaccauggacuccauagccggcaccaccuacccccgcugcaugaugcaccccuccuucgccggcaucaucgaccucgaacuccccaacaacaccggcgccaugcucgccgacgcacacggccucuucaugcuagaauucagcaaaaccauaaacccgagccugcgcacaaaacaacccaacgaaaucgccgcaacauucgaaaaacccaacauggccgccaugaccggccgauucuucacacgagacgacaagaaaaaacuccuaaucgcaaucggcguccucaacgaagaccuaguccccaacccagccauagaaaaaugcgccgaaaaauacaaagccaaagucggcaaauaa

SEQ ID NO: 8303 - RNA, 762 nt, Artificial Sequence
  derived and/or modified CDS sequence (opt11) from Massilia virus(127)__KT906102.1__N
auguccgaagacaacuaccgcaccaucgcccucuccuuccucgacgaaaccgccguauccaccuccaucaacgccugcgucaacgaauucgcauaccaaggcuucgaccccaaaagaaucguccaacucgucaaagaacgcggcaccgccaaaggccgcgacuggaaaaaagacgucaaaaugaugaucguccucaaucucguccgcggcaacaaacccgaauccaugaugaaaaaaauguccgaaaaaggcgccgccaucgucacccaacucaucucaaccuaccaacuaaaagaaggcaacccaggccgagacacaaucacccucucccgcgucucagccgccuucguccccuggacaguccaagcccuaaaaacacucucggaaucccuccccgucaccggcaccaccauggacuccauagccggcaccaccuacccccgaugcaugaugcaccccuccuucgccggcaucaucgaccucgaacuaccaaacaacaccggcgccaugcucgcagacgcccacggccucuucaugcucgaauucuccaaaaccaucaaccccagccuccgcacaaaacaaccaaacgaaaucgccgccaccuucgaaaaacccaacauggccgcaaugaccggccgauucuucacccgcgacgacaaaaaaaaacuccucaucgccaucggcguccucgacgaagaccuaguccccaaccccgccaucgaaaaaugcgcagaaaaauacaaagccaaagucggcaaauaa

SEQ ID NO: 8304 - RNA, 762 nt, Artificial Sequence
  derived and/or modified CDS sequence (opt11) from Massilia virus(130)__KT906103.1__N
auguccgaagacaacuaccgcaccaucgcacucuccuuccucgacgaaacagccgacuccaccuccaucaacgccugcgucaacgaauucgccuaccaaggcuucgaccccaaacgcaucguccaacucgucaaagaacgcggcaccgccaaaggcagagacuggaaaaaagacgucaaaaugaugauaguccuaaaccucguccgcggcaacaaacccgaauccaugaugaaaaaaauguccgaaaaaggcgccgccaucgucacccaacucaucuccaccuaccaacucaaagaaggcaaccccggccgcgacaccaucacccuaucccgcgucagcgccgccuucguccccuggaccguacaagcccucaaaacccucuccgaaucccuccccguaaccggcaccacaauggacuccaucgccggcaccaccuacccccgcugcaugaugcaccccucauucgccggcaucaucgaccucgaacuccccaacaacaccggcgccaugcuagccgacgcccacggccucuucaugcuagaauucuccaaaacaaucaaccccagccugcgcacuaaacaaccaaacgaaaucgccgccaccuucgaaaaacccaacauggccgccaugaccggccgcuucuucacccgcgacgacaaaaaaaaacuccucauagccaucggaguccucgacgaagaccuaguccccaaccccgccauagaaaaaugcgccgaaaaauacaaagccaaaguaggcaaauaa

SEQ ID NO: 8305 - RNA, 762 nt, Artificial Sequence
  derived and/or modified CDS sequence (opt11) from Naples virus(Yu 8/76)__JF920141.1__N
auguccgaagacgacuaccacaaaaucgcccucgccuucgccgaagaaucagccgacgucuccaccauagaaagcugggucaacgacuucgccuaccaaggcuucgacccccgcagaauaguacaacuagucaaagaacgcggcacagccaaaggccgcgacuggaaaaaagacgucaaaaugaugaucguccucaaccucguacgugggaacaaacccgaagcaaugaugaaaaaaauguccgaaaaaggcgccgccaucgucgcacagcucaucagcguauaccaacucaaagaaggcaaccccggacgcgacaccaucacccuaucccgagucuccgccgccuucguccccuggacaguccaagcccuacgcguccuaucagaccaccuccccgucaccggcaccaccauggacgccaucgccggcguaacauacccccgcgcaaugaugcaccccuccuucgccggaauagucgaccucgaacuaccccgcaaaaccggcgaaaugaucgccgacgcacacggccucuucaugcucgaauucucaaaaaccaucaaccccucccuccgcaccaaacaacccaacgaaaucgccaccaccuucgaaaaaccaaacauggcagccauguccggcaaauucuucucccgagaagacaaaaaaaaacuccuaauguccgucggcaucauaaacgacgaccuccuacucacagccagcguagucaaaugcgccgaaaaauaccgagccaaaaccggcaaauaa

SEQ ID NO: 8306 - RNA, 762 nt, Artificial Sequence
  derived and/or modified CDS sequence (opt11) from Punique virus(P1_B4_2008)__FJ848987.1__N
augucagaagaaaacuaccgcgaaauagcacucgcauuccuggacgaaagcgccgacuccggcaccaucucaacaugggucaacgacuucgccuaccaaggauucgaccccaaacgcauaguacagcuaguaaaagaacgaggaaccgcaaaaggacgcgacuggaagaaagacgucaaaaugaugaucguacuaaaccucgugcgcggaaacaaacccgaaagcaugaugaagaaaaugagcgagaaaggagccgcaaucgucgcccaacuaaucgccgccuaccaacuaaaagaaggaaaccccggccgggacaccaucacacucucacgagucagcgcagccuucguccccuggacaguccaagcacuccgcucccuauccgacucgcucccagucaccggcacaaccauggacuccaucgcaggcguaacauacccacgcugcaugaugcaccccucauucgcaggcauaauagaccuagaccuacccaacgacacaggagccaugcucgcagacgcacacggccuauucaugcuagaguucagcaaaaccaucaacccaagccuccgcacaaaacaagccaacgaaauagccgccaccuucgaaaaacccaacauggcggccaugaacggacgcuucuucacccgcgaagacaaaaagaaacuccuaaucgccaucggcguacuaaacgaagaccugaucccagucuccgccauagccaaaugcgccgaaaaauacagagccaaagucggcaaauaa

SEQ ID NO: 8307 - RNA, 762 nt, Artificial Sequence
  derived and/or modified CDS sequence (opt11) from Saint Floris virus(Dak ANB512)__JF920138.1__N
augagcgaagaaaccuacgcacaacucgccauggccuuccuagcagaaccagccgacuggagcacacuauccgucugggucaacgaauucgccuaccaaggcuucgaccccaaacgaaucgucgaacucaucauggaaagaggcaaaaaauucaaccgagaauggaaaaaagacgucaaaaugaugaucacacuaaaccucauccgaggcaacaaaccagaagccaugaugcgcaaaauguccgacaaaggcagaagcaucgucagcgaacuaaucucagucuacgaacucaaagagggcaaccccggacgagacaccaucacccucucccgcgucuccgccgccuucguccccuggacgguccgcgcccuagucgcccuacaaaacgaccuccccgucaccggagccgcaauggacuccauaugcggcgucacauacccccgcgccaugaugcaccccuccuucgccggagucaucgaccucgaacuccccaacggcgucggcgcccaacucgccgacgcacacggccucuucaugcuagaauucagcaagaccaucaaccccggccuccgcaccaaacaacccaacgaaaucgccgccaccuucgaaaaacccaaccucgccgccaugaccggcaaauucuucaccaaagaagacaaacgcaaaguacucaucuccgucggcgucaucaacuccgaccuccaacccaacucaguagucaaaacaugcgccgaacucuaccgggcccgcgucaugaaauag

SEQ ID NO: 8308 - RNA, 762 nt, Artificial Sequence
  derived and/or modified CDS sequence (opt11) from Tehran virus(I-47)__JF939848.1__N
augucagaagaagacuaccgagcaaucgcccucucauucuccgacgaaagcgccgacgucggaaucaucaccaccugggucaacgaauucgccuaccaaggguucgaccccaaacgcauaguacaacuaguaaaagaacgcggacaagcaaaaggccgagacuggaaaaaagacgucaaaaugaugauaguccucaaccuaauccgcggcaacaaacccgacgccaugaugaaaaaaauguccgaaaaaggcgcagccaccguagcccaacucgucagcguauaccaacucaaagaagggaaccccggccgcgacaccaucacacucucccgcguauccgccgccuucguacccuggacaguccaagcccucaaaguccuauccgaaucccucccggucaccggcacaaccauggacaccgucgccggcguaaccuacccccgggccaugaugcaccccucauucgcaggcaucauagaccucgaauuacccggccgagccggcgaagccaucgccgacgcccacggccucuucaugcucgaauucuccaaaacaaucaaccccagccuacgaacaaaacaacccaacgaaaucgccgcaaccuucgaaaaaccaaacauggccgccaugaccggacgcuucuucacccgagaagacaaaaaaaaacuccucaucgccgucggaaucauaaacgacgaccugcuccucacccccagcaucgccaaaugcgccgaaaaguaccgagccaaagucgggaaauaa

SEQ ID NO: 8309 - RNA, 762 nt, Artificial Sequence
  derived and/or modified CDS sequence (opt11) from Zerdali virus(37)__KP966618.1__N
augucagaagaggacuaccgagcgaucgcacuaucguucucagacgaggcagccgacguaggcacgaucacggccugggucaacgaguucgccuaccaaggauucgaccccaagcgcauaguccagcucgugcgcgaacgagggaucgcgaaaggacgcgacuggaagaaagacgucaagaugaugaucguacucaaccucauacgcggaaacaagcccgacgccaugaugaagaaaauguccgaaaaaggggccgcaaccguggcccaacucgugagcguauaccaacucaaagaagggaacccgggaagggacaccauaacgcccucccgcguaagcgccgccuucgucccauggacaguacaggcccuaaaagugcucucagaaucgcucccagucacgggcacgaccauggacacgaucgcgggcguaagcuaccccagagccaugaugcaccccucguucgcgggcauaaucgaccucgaacucccgcgcagggcaggagaagucaucgccgacgcacacggacuauucaugcuggaguucagcaaaaccauaaacccgagccuccgcacaaaacagccuaacgaaaucgccgcgaccuucgaaaagcccaacauggcagcaaugaccggacgcuucuuuacacgagaagacaagaaaaagcucuuaaucgcggucggaaucauaaacgacgaccugcuccuggccccaagcguagccaagugcgcggaaaaguacagggccaaaguaggaaaauaa

SEQ ID NO: 8310 - RNA, 762 nt, Artificial Sequence
  derived and/or modified CDS sequence (opt11) from TOSV(9028)__KU904263.1__N
auguccgacgaaaacuaccgcgacauagcccuagccuuccuagacgaaagcgcagacuccggcaccaucaacgccugggucaacgaauucgccuaccaaggcuucgaccccaaacgcaucguccaacucgucaaagaacgcggcaccgcaaaaggacgcgacuggaaaaaagacgucaaaaugaugaucguccucaaccucguccgcgguaacaagcccgaagccaugaugaaaaaaaugagcgaaaaaggcgccuccaucguagccaaccucaucagcgucuaccaacuaaaagaaggcaacccaggccgagacaccaucacccucucacgcgucucagcagccuucguccccuggaccguccaagcccuccgcguccuauccgaaucccucccaguauccggaaccaccauggacgcaaucgcaggcgucaccuacccccgagccaugaugcaccccucauucgccggaaucaucgaccucgaccucccaaacggagccggcgccaccaucgccgacgcccacggacucuuuaugaucgaauucagcaaaaccauaaaccccucccuccgcaccaaacaagcaaacgaagucgccgccaccuucgaaaaacccaacauggccgccauguccggccgcuucuucacgcgcgaagacaaaaaaaaacuacucaucgccgucggcaucaucgacgaagaccuaguccuagccuccgccgucguacgcagcgcagaaaaauaccgcgcaaaagucggcaaauaa

SEQ ID NO: 8311 - RNA, 762 nt, Artificial Sequence
  derived and/or modified CDS sequence (opt11) from TOSV(SI-121283)__JF330274.1__N
augucagacgaaaacuaccgcgacauagcacucgccuuccuagacgaaagcgccgacucaggcacaaucaacgccugggucaacgaauucgcauaccaaggauucgaccccaaacgaaucguccaacuagucaaagaacgaggaaccgccaaaggccgcgacuggaaaaaagacgucaaaaugaugaucguacuuaaccucgucagagggaacaaacccgaagccaugaugaaaaaaauguccgaaaaaggcgcauccaucgucgccaaccucaucagcgucuaccaacucaaagaaggcaacccaggcagagacacaaucacccucucacgcgucuccgccgccuucguaccauggaccguccaggcccuacgcguacucuccgaaucacuccccgucucgggcaccacaauggacgccaucgccggcgucaccuacccacgcgccaugaugcaccccuccuucgccggcauaaucgaccuagaccuccccaacggagccggagccaccaucgcagacgcacacggccucuucaugauagaauucagcaaaaccaucaacccaagccuacgcaccaaacaagccaacgaaguagcagccaccuucgaaaaccccaacauggccgccauguccggccgcuucuucacccgcgaagacaagaaaaaacuccuaaucgccgucggcaucaucgacgaagaccuaguccucgccuccgccgucguccgcagcgccgaaaaauaccgagccaaagucggcaaauaa

SEQ ID NO: 8312 - RNA, 762 nt, Artificial Sequence
  derived and/or modified CDS sequence (opt11) from TOSV(5963930705)__KU935733.1__N
augucagacgagaacuaccgcgauauagcacucgcauuccuggacgagagcgcggacucgggcacgaucaacgcaugggucaacgaauuugccuaccaaggauucgaccccaagcgcauaguccagcucgugaaagagcgagggaccgcgaaagggcgcgacuggaagaaagacgucaagaugaugaucgugcucaaccucgugcgcgggaacaagcccgaggccaugaugaagaaaaugagcgagaaaggagccucgaucguggccaaccuaauaagcguguaccagcuaaaggaagggaacccgggcagggacacgauaacacucucacgagugagcgcggccuucgucccauggacgguccaggcccuacgugugcucucggaaucgcucccggucucgggcacaaccauggacgcgaucgcgggagugacauaccccagggccaugaugcaccccucguucgcgggcauaaucgaccucgaucuaccgaacggggccggggccacgaucgcggacgcacacgggcuauucaugguagaguucagcaagacaaucaaccccagccuacgcacgaaacaggccaacgaagucgccgcgacauucgaaaagcccaacauggcagcaaugagcggacgcuucuucacgcgcgaagacaagaaaaagcuccuaauagcggucgggaucauagacgaggacuuaguccuagccucggcaguggucaggagcgcggaaaaguacagggccaaggucggaaaauag

SEQ ID NO: 8313 - RNA, 762 nt, Artificial Sequence
  derived and/or modified CDS sequence (opt11) from TOSV(MRS2010-4319501)__KC776214.1__N
augucagacgaaaacuaccgcgacaucgcccucgccuuccucgacgaaagcgccgacuccggcaccaucaacgccugggucaacgaauucgccuaccaaggcuucgaccccaaacgcaucguccaacucgucaaagaacgcggcaccgccaaaggacgcgacuggaaaaaagacgucaaaaugaugaucguccucaaccucguccgcggcaacaaacccgaagcaaugaugaaaaaaauguccgaaaaaggagccuccaucguagccaaccucaucagcgucuaccaacucaaagaaggaaacccaggaagagacaccaucacccucucccgcguaucagccgccuucgucccauggacuguccaagcacuacgcguccucuccgaaucccuccccgucucaggaacgaccauggacgccaucgccggcguaaccuacccccgcgccaugaugcaccccucauucgcaggcaucaucgaccuccaccuccccaacggcgcaggcgccaccaucgccgacgcccacggccucuucaugaucgaauucagcaaaaccaucaacccaagccuccgcaccaaacaggccaacgaagucgccgccacauucgaaaaacccaacauggccgccauguccggacgcuucuucacccgcgaagacaaaaaaaaacuacucauagcagucgggaucaucgacgaagaccuaguccucgccucagccguaguccgcuccgccgaaaaauaccgcgccaaagucggaaaauaa

SEQ ID NO: 8314 - RNA, 762 nt, Artificial Sequence
  derived and/or modified CDS sequence (opt11) from TOSV(TOSV/Firenze.ITA/1983/2)__KM275765.1__N
augucagacgaaaacuaccgagacaucgcccuagccuuccucgacgagugcgcagacuccggcaccaucaacgccugggucaacgaauucgccuaccaaggcuucgacccaaaacgaaucguccaacucguaaaagaacgcggaaccgcaaaaggccgcgacuggaaaaaagacguaaaaaugaugauaguccucaaccucguacgcggcaacaaacccgaggccaugaugaaaaaaaugagcgaaaaaggcgccagcaucgucgccaaccuaaucagcgucuaccaacucaaagaaggaaaccccggacgcgacacaaucacccucagccgcgucucagccgccuucguccccuggacaguacaagcacuccgaguacucagcgaaucccuacccguaagcggcacgaccauggacgccauagccggcgucaccuacccacgcgccaugaugcacccaagcuucgcaggaaucaucgaccucgaccuccccaacggcgcuggagccaccauagccgacgcccacggccucuucaugaucgaauucuccaaaaccaucaacccgucccuccgaaccaaacaagcaaacgaagucgccgccacauucgaaaaacccaacauggcagccaugagcggccgcuucuucacccgcgaagacaaaaaaaaacuacuaaucgccgucggcauaaucgacgaagaccucguccuagccagcgccgucguccgcuccgcagaaaaauaccgagcaaaagucggaaaauaa

SEQ ID NO: 8315 - RNA, 738 nt, Artificial Sequence
  derived and/or modified CDS sequence (opt11) from SFTSV(HB29)__NC_018137.1__N
augagcgaguggucgcgcauagccguggaguucggcgaacaacaacucaaccuaacagaauuggaagacuucgcacgcgagcuagcguacgagggccuggacccggcccuaaucaucaaaaagcuaaaggaaacgggaggggacgacuggguaaaagacaccaaauucauaauaguguucgcgcuaacgcgcgggaacaagaucgugaaagcgagcggaaaaaugagcaacagcgggagcaagcgccugauggcgcuucaggaaaaguacgggcucguggaacgggccgagaccaggcucucgauaacgcccgugcgcguggcacagagccugcccacguggacaugcgcagccgcagccgcacuaaaagaauaccucccgguagggccagcggucaugaacuugaaaguagaaaacuacccgcccgagaugaugugcauggccuucggcucgcuaauaccaacggccggggucucggaagcgaccacgaaaacacucauggaagcguacucacucuggcaagacgccuucaccaaaaccauaaacguaaaaaugcgaggggccucgaaaacggaaguguacaacagcuuucgcgacccccugcacgcggccgugaacucggucuucuucccgaacgauguaagggucaaguggcugaaagcaaaagggauccugggcccggacggggucccgagcagggccgcggaaguggccgcagccgcguacaggaaccuguga

SEQ ID NO: 8316 - RNA, 738 nt, Artificial Sequence
  derived and/or modified CDS sequence (opt11) from SFTSV(111S)__KP339904.1__N
augagcgaguggucgagaauagccguagaguucggcgaacaacagcucaaccucacggaauuggaagacuucgcgcgcgagcucgcauacgagggacuagacagggcccugaucauaaagaaacucaaagaaacgggcggggacgacugggugaaagacaccaaguucauaaucguauucgcacucacgcgcggaaacaagaucgugaaagcgagcgggaaaaugagcaacagcgggagcaagcgccugauggcgcuacaggaaaaauacgggcucguagaacgggccgagacaaggcucucaaucacacccgugcgcguggcccagagccugcccacguggacgugcgcagccgcggccgcgcucaaggaauaccucccagucggacccgcagucaugaaccugaaaguggaaaacuacccgcccgagaugaugugcauggccuucggcucgcucauaccaacggccggagucucggaagcgaccacgaaaacgcucauggaagcguacucgcucuggcaagacgccuucaccaagaccauaaacgugaaaaugcgcggagccucgaaaacggaaguguacaacagcuuccgagacccccuacacgcggcagugaacucggucuucuucccgaacgacgucagggucaaguggcugaaagcgaaagggauccugggcccggacggggucccgagcagagcagcagaaguggccgcggccgcguacagaaaccuguga

SEQ ID NO: 8317 - RNA, 738 nt, Artificial Sequence
  derived and/or modified CDS sequence (opt11) from SFTSV(116S)__KP339905.1__N
augagcgaguggucgcgcauagccguggaguucggcgaacaacagcucaaccucacggaauuggaagacuuugcgcgagaacucgcguacgagggccuagacccggcauugaucaucaaaaagcucaaggaaacgggcggggacgauugggugaaagacaccaaguucauaauaguguucgcgcucacgcgcgggaacaagaucgugaaggcgagcgggaaaaugagcaacagcggaagcaagcgacugauggcgcuacaggaaaaguacgggcuaguagaaagagccgagaccagacucucgaucacacccgugcgcguggcccagagccugcccacguggacgugcgcggccgcggccgcgcucaaggaauaucucccggucgggcccgcggucaugaaccuaaaaguggaaaauuacccgcccgagaugaugugcauggcauucggcucgcucauacccacagccggggucucggaagcgaccacgaaaacgcucauggaagcguacucgcucuggcaagaugccuucaccaagacaauaaacgugaaaaugcgcggagcaucgaaaacggaaauauacaacagcuuucgcgacccccugcacgcggccgugaacucgguauuuuucccgaacgaugucagagucaagugguuaaaagcaaaagggauccugggcccggacggggucccgagcagggccgcagaaguggccgcagccgcguacagaaaccuguga

SEQ ID NO: 8318 - RNA, 738 nt, Artificial Sequence
  derived and/or modified CDS sequence (opt11) from SFTSV(132S)__KP339912.1__N
augagcgaguggucgcgcauagccguggaguucggagaacaacagcucaaccucacagaacuggaagacuucgcgcgcgaacuagcauacgaaggcuuggacccagcccugaucaucaaaaagcucaaggaaacgggcggggacgacugggugaaagacaccaaguucauaagcguauucgcacucacgcgagggaacaagauagugaaggcgagcggaaaaaugagcaacagcgggagcaagcgccugauggcacuccaggaaaaguacgggcucguagaacgagccgagaccagacucucgauaacgcccguacgaguagcccagagccugcccacguggacgugcgcggccgcggccgcgcucaaggaauaccucccagucgggcccgcggucaugaaccugaaaguggaaaacuacccacccgagaugaugugcauggccuucggcucgcucauccccacggccggggucucggaagcgaccacgaaaacgcucauggaagcguacucacuuuggcaagacgcauucaccaagaccauaaacgugaaaaugcgcggggccucaaaaacagaaguguacaauagcuuccgcgacccauugcacgcggccgugaacucagucuucuucccgaacgacgucagggucaaguggcugaaagcgaaagggauacuaggcccggacggggucccaagcagggcagcagaaguggccgcggccgcguacaggaaccuauaa

SEQ ID NO: 8319 - RNA, 738 nt, Artificial Sequence
  derived and/or modified CDS sequence (opt11) from SFTSV(2014045S)__KR075923.1__N
augagcgaguggucacgcauagccguggaguucggcgaacaacagcucaaccuaacggaauuggaagacuucgcgcgagaacucgcguaugagggccuagacccagcccugaucaucaaaaagcuaaaggaaacaggcggggacgacugggugaaagacaccaaguucauaauaguguucgcgcucacacgcgggaacaagaucgugaaagcgagcgggaaaaugagcaacagcgggagcaaacgccugauggcgcuacaggaaaaguacgggcucguagaaagggcugagaccaggcucucgaucacacccguacgaguggcccagagccuacccacauggacgugcgcagccgcggccgcgcucaaggaauaccucccggucggacccgcagucaugaaccugaagguggaaaacuacccgccagagaugaugugcauggccuucggcucacucauccccacagccgggguaucggaagcgaccacaaaaacgcucauggaggcguacucacuauggcaagacgccuucacaaagaccauaaacgugaaaaugcgaggggccucaaaaacggaaguguacaacagcuuccgcgacccccuacacgcggccgugaacucggucuucuucccgaacgacguaagggucaaguggcugaaagcgaaagggauccugggcccagacggggccccgagccgggccgcggaaguagccgcggccgcauauagaaaccuguga

SEQ ID NO: 8320 - RNA, 738 nt, Artificial Sequence
  derived and/or modified CDS sequence (opt11) from SFTSV(2014193S)__KR075916.1__N
augagcgaguggucgcgaauagccguggaguucggcgaacaacagcucaaccucacggaauuagaagacuucgcgcgcgagcucgcguacgagggccuggacccggccuugaucaucaaaaagcuaaaggaaacgggcggggacgauugggugaaagauacaaaguucauaauaguguucgcgcuaacgcgagggaacaagaucgugaaagcaagcgggaaaaugagcaacagcggaagcaagagauuaauggcacuccaggaaaaguacgggcuaguggaaagagccgaaaccaggcucucggucacacccguacgcguggcccagagcuuaccaacguggacaugcgcggcagcggcagcgcuaaaggaauaucuaccggucgggcccgcggucaugaaccugaaaguggaaaauuacccgcccgagaugaugugcauggccuucgggucgcuaauacccacggcaggagucucggaagcgaccacgaaaacgcucauggaagcguacucgcucuggcaagacgccuuuaccaagaccauaaacgugaaaaugcgcggggccucgaaaacagaaguguacaauagcuuccgcgauccccugcacgcggccgugaacucggucuucuucccaaacgacgucagaguaaagugguuaaaagcgaaagggaucuugggcccggacggggucccgagcagagccgcggaaguggccgcggccgccuacaggaaccuguga

SEQ ID NO: 8321 - RNA, 738 nt, Artificial Sequence
  derived and/or modified CDS sequence (opt11) from SFTSV(2015SH232S)__KT736097.1__N
augagcgaguggucgcgcauagccguggaguucggcgaacaacaacucaaucucacggaacuggaagauuucgcgcgcgagcucgcguacgagggauuggacccagcccugaucaucaaaaagcuaaaggaaacgggcggggaugacugggugaaagacaccaaauucauaauaguguucgcgcucacgcgagggaacaagaucguaaaagcguccgggaaaaugagcaacagcgggagcaagcgccuaauggcgcuccaggaaaaguacgggcuaguggaaagggccgagaccaggcucucgaucacgcccgugcgcguagcccagagccugcccacauggacgugcgcggccgcagccgcgcucaaggaauaucucccggucggacccgcggucaugaaccugaaaguggaaaacuacccgcccgagaugaugugcauggccuuuggcucgcucauacccacggccggggucucagaagcgaccacgaaaacgcucauggaagcguacucacucuggcaagaugccuucaccaagacaauaaacgugaaaaugcgcggagccucgaaaacggaaguauacaacaguuuccgcgacccccugcacgcggccgugaacucggucuucuucccgaacgauguaaggguaagaugguugaaagcgaaagggaucuugggcccggacgggguaccgaguagggccgcggaaguggccgcggccgcguacaggaacuuguga

SEQ ID NO: 8322 - RNA, 738 nt, Artificial Sequence
  derived and/or modified CDS sequence (opt11) from SFTSV(2015SYSH33)__KT380653.1__N
cuaagcgaauggucacgcauagccguggaguucggcgaacaacagcucaaccucacagaacuggaagacuucgcgcgcgaacuagcguacgagggccuggacccggcccugaucaucaaaaagcucaaagaaacgggcggagacgauuggguaaaagauaccaaguucauaauaguguucgcgcucacgcgcggaaacaagaucgugaaagcgagcgggaaaaugagcaacagcggcagcaaacgccugauggcgcuccaggaaaaguacggacucguagaacgagccgagacccggcuaucaaucacgcccgugcgcguggcccagagccugccaacguggacaugcgcggccgcggccgcuuuaaaggaauaccucccggucgggcccgcggucaugaacuugaaaguggaaaacuacccgcccgagaugaugugcauggccuucggcucgcucauacccacggccggggucucagaagcgaccacgaaaacgcucauggaagcauacucgcucuggcaagacgccuucaccaagaccaucaacgugaaaaugcgcggagccucaaaaacggaaguauacaacagcuuccgcgacccccugcacgcggccgugaacucagucuucuucccgaacgacgucagggucaaguggcuaaaagcgaaaggaauccugggcccggacggagucccgagcagggccgcggaaguggccgcagccgcauacagaaaccuguga

SEQ ID NO: 8323 - RNA, 738 nt, Artificial Sequence
  derived and/or modified CDS sequence (opt11) from SFTSV(2015SYSH86)__KT380657.1__N
augagcgaguggucgagaauagccguagaguucggagaacaacagcucaaccucacggaacuggaagauuucgcgcgcgaacucgcguacgaaggacuagacccggcccugaucaucaaaaagcucaaggaaacaggcggggacgacugggugaaagacaccaaguuuauaauaguguucgcgcucacacgcggaaacaagaucauaaaagcgagcgggaaaaugagcaacagcgggagcaaacgacugauggcgcuccaggaaaaguacggacucguggaaagggccgagaccaggcucucgaucacgcccgugcgcguggcccagagccugcccacguggacgugcgcagcagcggcagcgcucaaggaauaccucccgguaggacccgcgguaaugaaccugaaaguggaaaacuacccgcccgagaugaugugcauggccuucggaucgcucauacccacggccggggucucggaagcaaccacgaaaacgcucauggaagcguacucgcucuggcaagacgcauuuaccaagaccauaaacgugaaaaugcgaggggccucgaaaacagaaguauacaacagcuuccgagacccccugcacgcggccguaaacucggucuucuucccgaacgaugucagggucaaguggcuaaaagcgaaagggauccugggcccggacggcguaccgagccgggccgcggaaguggcagcggccgcauacaggaaccuguga

SEQ ID NO: 8324 - RNA, 738 nt, Artificial Sequence
  derived and/or modified CDS sequence (opt11) from SFTSV(67S)__KP339890.1__N
augagcgaguggucgcgcauagccguggaguucgccgaacaacaacucaaccucacagaacuggaagacuucgcgcgcgagcuagcguacgagggccuggacccggcacugaucaucaaaaagcucaaggaaacgggcggggacgacugggucaaagacaccaaguucauaauaguguucgcgcucacgcgcgggaacaagaucgugaaagcaagugggaaaaugagcaacagcggaagcaagcgccugauggcgcuccaggaaaaguacgggcucguggaaagagccgagaccagacucucgaucacgcccgugcgcguggcccagagccugcccacguggacaugcgcggccgcggccgcacucaaggaauaccuaccggucgggcccgcggucaugaaccugaaaguggaaaauuacccacccgagaugaugugcauggccuucggcucgcucauccccacggccggggucucggaagcgacaacgaaaacgcucauggaagcguacucgcucuggcaagacgccuucaccaagaccauaaacgugaaaaugcgcggggccucgaaaacggaaguguacaacagcuuccgcgacccccugcacgcggccguaaacuccgucuucuucccgaacgauguaagaguaaaguggcugaaagcgaaaggaauacuaggcccagacggggucccaagcagggccgcggaaguagccgcggccgcguacaggaacuuguga

SEQ ID NO: 8325 - RNA, 738 nt, Artificial Sequence
  derived and/or modified CDS sequence (opt11) from SFTSV(6S)__KP339927.1__N
augagcgaguggucgcgcauagcaguggaauuuggcgaacaacagcuaaaccucacagaacuggaagacuucgcgcgcgagcucgcguacgagggccuggacccggcacuaaucaucaaaaagcucaaggaaacaggcggagacgacugggugaaagacacaaaguucauaauaguguucgcgcucacgcgcgggaacaagaucguaaaagcgagcgggaaaaugagcaacagcgggagcaagcgccugauggcgcuacaggaaaaguacggacucguggaaagagccgagacaagguucucgaucacccccgugcgcguggcccaaagccugcccacguggacgugcgcagccgcggccgcgcuaaaagaauaucucccggucgggcccgcggucaugaaccugaaaguggaaaacuacccgcccgagaugaugugcauggccuucggaucacucauacccacggccggggucucggaagcgaccacgaaaacgcuaauggaagcguacucgcucuggcaagacgcauucaccaagaccauaaacgugaaaaugcgcggggccucgaaaacggaaguguacaacagcuuucgcgauccccugcacgcggccgugaacucgguauucuucccgaacgacgucaggguaaaguggcuaaaagcgaaagggaucuugggcccggacggggucccgagcagggccgcggaaguggccgcggccgcguacagaaacuuguga

SEQ ID NO: 8326 - RNA, 738 nt, Artificial Sequence
  derived and/or modified CDS sequence (opt11) from SFTSV(72S)__KP339891.1__N
augagcgaauggucacgcauagccguggaguucggcgaacaacagcucacgcucacggaacuggaagacuucgcgcgcgaacucgcguacgagggccuggacccggcccugauaaucaaaaagcucaaggaaacaggaggggacgacugggugaaagacacuaaguucauaauaguauucgcgcucacgcgcgggaacaaaaucgugaaagcgagcgggaaaaugagcaauagcgggaguaagcgccugauggcgcuccaggaaaaguacgggcucguggaaagagccgagaccaggcuaucgaucacgcccguacgcguggcacagagccugcccacguggacgugcgcggccgcggccgcgcucaaggaauaucuaccggucggacccgcggucaugaacuugaaaguagaaaauuacccgcccgaaaugaugugcauggccuucggcucacucauaccaacggcaggggucucagaagcgaccacgaaaacgcucauggaagcguacucgcucuggcaagacgccuucaccaagaccauaaacgugaaaaugagaggggccucaaaaacggaaguguacaacagcuuccgcgaucccuuacacgcggccgugaacucagucuucuucccaaacgacguccgggucaggugguugaaagcaaaagggaucuugggcccggacggggucccgagcagggccgcggaaguggccgcggccgcguacaggaaccuguga

SEQ ID NO: 8327 - RNA, 738 nt, Artificial Sequence
  derived and/or modified CDS sequence (opt11) from SFTSV(AP01-Korea-13)__KR612072.1__N
augagcgaguggucgcgcauagcaguggaguucggagaacaacagcucaaccucacggaacuggaagacuucgcgcgcgagcucgcguacgagggccuggacccggcccugaucaucaaaaagcucaaggaaacggguggagacgacugggugcgcgacacuaaguucauaauaguguucgcgcucacacgcgggaacaagaucguaaaagcgagcgggaaaaugagcaacagcgggagcaaacgccugauggcgcuacaggaaaaguacgggcucguggaaagggccgagaccagacucucgaucacgcccgugcgcguggcccagagccugcccacguggacgugcgcagccgcggccgcacucaaggaauaccuaccagucgggcccgcagucaugaaccugaaaguggaaaacuacccgcccgagaugaugugcauggccuucggcucacucauacccacggccggggucucggaagcgaccacgaaaacacuaauggaagcguacucacucuggcaagacgccuucaccaagacaauaaacgugaaaaugcgcggggccucgaaaacggaaguguacaacagcuuccgcgaccccuugcacgcggccgucaacucaguauuuuucccaaacgacgucagagucaaauggcugaaagcaaaaggaauccugggcccagacggggucccgagccgggccgcggaaguggccgcggccgcguacaggaaccuguga

SEQ ID NO: 8328 - RNA, 738 nt, Artificial Sequence
  derived and/or modified CDS sequence (opt11) from SFTSV(JP03-Korea-13)__KR612079.1__N
augagugaguggucgcgcauagccguagaguucggcgaacaacagcucaaccucacggaacuggaagacuucgcgcgcgagcucgcauacgagggacuggacccagcccuaauaaucaaaaagcuaaaagaaacgggaggggacgacugggugcgcgacaccaaguucauaauaguguucgcgcuaacgcgcgggaacaagaucgugaaagcaagcgggaaaaugagcaacagcgggagcaagcgccugauggcgcuacaggaaaaguacgggcucguggaaagagccgagaccaggcucucgaucacacccguacgcguggcccaaagccugcccacguggacaugcgcggccgcagccgcgcucaaggaauaccucccggucgggcccgcagucaugaaccuaaaaguagaaaacuacccgcccgaaaugaugugcauggccuucggcucgcucauaccaacggccggagucucggaagcgacaacaaaaacgcucauggaagcguacucacucuggcaagacgccuucaccaagaccauaaacgugaaaaugcgcggggccucgaaaacagaaguguacaacagcuuccgcgacccccugcacgcggccgugaacucagucuucuucccgaacgacgucagggucaagugguugaaagcaaaaggaauccugggcccggacggcaucccgagcagagccgcggaaguggcagcggccgcauacagaaaccuguga

SEQ ID NO: 8329 - RNA, 738 nt, Artificial Sequence
  derived and/or modified CDS sequence (opt11) from SFTSV(JP07-Korea-13)__KR612088.1__N
augagugaauggucgcgcauagccguagaauuuggcgagcaccagcucaaucuaacagaauuggaagacuucgcgcgagagcucgcauacgagggcuuggacccggcccugaucaucaaaaagcucaaggaaacgggaggagacgacuggguacgcgacaccaaguucauaauaguguucgcgcuuacgcgcgggaacaagaucgugaaagcgaguggaaaaaugagcaauagugggaguaagcgccugauggcgcuccaggaaaaguacgggcucguagaaagagccgagacaaggcuaucgaucacacccgugcgcguagcccagagccugcccacguggacgugcgcggccgcagcagcacuaaaagaauaccucccagucgggcccgcggucaugaaccugaaaguagaaaauuacccgcccgagaugaugugcauggccuucggcucgcucauacccacggccggggucucggaagcgaccacgaaaacgcucauggaagcguacucacuauggcaagacgcauucaccaagaccauaaacgugaaaaugcgcggagccucgaaaacggaaguauacaauagcuuccgcgacccccugcacgcggccguaaacucggucuucuucccgaacgaugucagggucaaguggcugaaagcgaaagggauccugggcccggacggggucccgagcagagcagcggaaguggccgcggccgcguacagaaaccuguga

SEQ ID NO: 8330 - RNA, 738 nt, Artificial Sequence
  derived and/or modified CDS sequence (opt11) from SFTSV(JS2011-13-2)__KR230790.1__N
augagcgaauggucgcgcauagccguggaguucggcgaacaacagcucaaccucacggaauuggaagacuucgcgcgcgaacucgcguacgaaggccuggacccggcccugaucaucaaaaagcucaaggaaacgggcggggacgacugggugaaagacacaaaguucauaauaguauucgcgcucacacgcggaaacaagaucgugaaagcgagcgggaaaaugagcucgagcgggagcaagcgccugauggcgcuccaggaaaaguacggacucguggaaagagcagagaccaggcucucaaucacgccaguacgcguagcccagagccugcccacguggacgugcgcggccgcggcagcgcucaaggaauaccucccggucgggccagcggucaugaacuugaaaguggaaaacuacccgcccgagaugaugugcauggcauucggcucgcucauacccacggccggggucucagaagcgaccacgaaaacacucauggaagcauacucacucuggcaagacgccuucaccaagaccauaaacgugaaaaugcgaggggcaucgaaaacagaaguguacaacagcuuccgcgacccccugcacgcggccguaaacucagucuucuucccgaacgacgucagagucaaguggcuaaaggcgaaagggauccuaggcccggacggggucccgagccgggccgcggaaguggccgcggccgcauacaggaaccuguga

SEQ ID NO: 8331 - RNA, 738 nt, Artificial Sequence
  derived and/or modified CDS sequence (opt11) from SFTSV(JS2014-15)__KR230799.1__N
augagcgaguggucgcgcauugccguagaguucggagaacaacagcucaaccucacggaacuggaagacuucgcgcgagagcucgcguacgagggccuggacccggcccugaucaucaaaaagcucaaggaaacgggcggagacgacuggguaaaagacaccaaauucauaauaguguucgcgcucacgcgcgggaacaaaaucgugaaagcgagcgggaaaaugaguaacagcgggagcaagcgccugauggcguuacaggaaaaguacgggcucguggaaagggccgagacacggcuaucgaucacacccguacgcguagcccagagccugcccacguggacgugcgcggccgcggcagcgcuaaaggaauaccuccuggucgggcccgcggucaugaacuugaaaguggaaaacuacccgcccgagaugaugugcauggccuuuggcucacucauacccacggccggggucucagaagcgacaacaaaaacacucauggaagcguacucgcucuggcaagacgccuucaccaagaccauaaacgugaaaaugcguggggccucaaaaacagaaguguacaacagcuuucgcgaccccuugcacgcggccgugaacucggucuucuucccgaacgacgucagggucaaguggcugaaagcgaaagggauccugggcccggacggagucccaagcagggccgcggaaguggccgcggccgcguacaggaacuuguga

SEQ ID NO: 8332 - RNA, 738 nt, Artificial Sequence
  derived and/or modified CDS sequence (opt11) from SFTSV(KASJH)__KP663733.1__N
augagcgaguggucgcgcauagccguggaauuuggcgagcaacagcucaaucuaucggaacuagaagacuucgcgcgcgagcucgcguacgagggccuggacccggccuugaucaucaaaaagcucaaggaaacgggcggggacgacugggugaaagacaccaaguucauaauaguauucgcacucacgcgcggcaacaagaucgugaaagcgagcggaaaaaugagcaacagcgggagcaagcgccugauggcgcuacaggaaaaguacgggcucguggaaagagccgagacaaggcucucaaucacacccgugcgcguggcccagagccugcccacguggacgugcgcagccgcggccgcgcucaaggaauaccucccggucggacccgcggucaugaacuugaaaguggaaaauuacccgcccgagaugaugugcauggccuuuggcucgcuaauacccacggccggggucucggaagcgaccacgaaaacgcucauggaagcauacucgcucuggcaagacgccuucacaaagacaauaaacgugaaaaugcgcggggccucgaaaacggaaguguacaacagcuuucgagacccccugcacgcggccgugaacagugucuucuucccaaacgacgucagggucaagugguugaaagcaaaagggaucuugggcccagacggggucccgagcagggccgcggaaguggccgcagccgcguacaggaaucuguga

SEQ ID NO: 8333 - RNA, 738 nt, Artificial Sequence
  derived and/or modified CDS sequence (opt11) from SFTSV(YSH116)__KT721303.1__N
augagcgaguggucacgaauagccguagaguucggcgaacaacagcuaaaccucacagaacuagaagacuucgcccgcgagcucgcguacgaaggacuggacccagccuugaucaucaaaaagcucaaggaaacaggcggagacgacugggugaaagacaccaaguucauaauaguguucgcgcucacgcgcgggaacaagauagugaaagcgagcggaaaaaugagcaacagcgggagcaagcgccugauggcgcuccaagaaaaguacgggcuaguggaaagggcagagaccagacucucgaucacaccagugcgcguggcacagagccugccaacguggacgugcgcagccgcggccgcacucaaggaauaccucccgguagggcccgcggucaugaaccucaaaguggaaaacuacccgcccgagaugaugugcauggccuucggcucgcucauccccacggcaggagucucagaagcgaccacaaaaacgcucauggaagcguacucgcucuggcaagacgucuucacaaagaccauaaacgugaaaaugcgcggagcaucaaaaacggaaguguacaacagcuuccgagauccccugcacgcggccguaaacucggucuucuucccgaacgacgucagggucaaguggcugaaagcgaaagggauccuaggcccggacggggucccaagcagggccgcggaaguggccgcggccgcauacaggaaccuguga

SEQ ID NO: 8334 - RNA, 738 nt, Artificial Sequence
  derived and/or modified CDS sequence (opt11) from SFTSV(AH-YTY/China/05/2012)__KR017811.1__N
augagcgaguggucgcgcauagccguggaauuuggcgagcaacagcucaaucucacggaacuggaagauuuugcacgcgagcuagcguacgaaggccuggacccagcccugaucauaaagaaacucaaagaaacgggcggggacgacugggugaaagacaccaaguucauaaucguauucgcgcucacgcgcgggaacaagaucgugaaagcgagcggaaaaaugagcaacagcgggagcaagcgccugauggcgcuccaggaaaaauacggacucguggaaagggccgaaaccagacucucaaucacgcccgugcgcguggcccagagccugcccacguggacgugcgcggccgcagcagcguuaaaggaauaccucccugucggacccgcggucaugaaccugaaaguggaaaacuacccacccgaaaugaugugcauggccuucggcucgcucauacccacaaccggggucucagaagcgaccacgaaaacgcucauggaagcguacucacucuggcaagacgccuucaccaaaaccauaaacgugaaaaugcgcggggccucaaaaacggaaguguacaacagcuuccgcgacccccugcacgcggccguaaacucggucuucuucccgaacgacgucagggucaaguggcugaaagcgaaagggauauuaggcccggacggagucccgagcagggccgcggaaguggccgcggccgcguacaggaaccuguga

SEQ ID NO: 8335 - RNA, 738 nt, Artificial Sequence
  derived and/or modified CDS sequence (opt11) from SFTSV(DS02/CHN/2013)__KR698319.1__N
augagcgaguggucgcgaauagccguggaguucggcgaacaacagcucaaccucacggaauuagaagauuucgcacgcgagcuagcauacgagggccuagacccggcccugauaauaaagaaacuaaaagaaacuggcggggacgacuggguacgcgauaccaaguucauaaucguguucgcgcuaacacgcgggaacaagaucguaaaagcaagcgggaaaaugagcaacagcgggagcaagcgacugauggcgcuccaggaaaaguacgggcucguggaaaaggccgaaaccaggcucucgaucacgcccgugcgcguggcccagagcuugccaacguggacaugcgcggccgcggccgcacucaaggaauaccuaccagucgggcccgcagucaugaaccugaaaguggaaaacuacccgcccgagaugaugugcauggccuucggcucgcucauacccacggcaggggucucggaagcgaccacgaaaacgcucauggaagcauacucgcucuggcaagacgccuucaccaagaccauaaacguaaaaaugcgcggggccucaaaaacggaaguguacaacagcuuccgcgacccccugcacgcagcagugaacucaguauucuucccaaacgacgucagagucaaauggcugaaagcaaaagggauccugggcccggacggagucccaagcagggccgcggaaguggccgcggccgcguacaggaaccuauga

SEQ ID NO: 8336 - RNA, 738 nt, Artificial Sequence
  derived and/or modified CDS sequence (opt11) from SFTSV(HB2014-13)__KU738908.1__N
augagcgaauggucgcgaauagccguggaguucggcgaacaacagcucaaucucacggaacuagaagacuucgcgcgcgagcucgcguacgagggccuggacccggcuuugaucaucaaaaagcuaaaggaaacgggcggggacgacuggguaaaagacaccaaguucauaauaguguucgcgcucacgcgcgggaacaagaucgugaaagcgagcgggaaaaugagcaacagcgggagcaagcgccugauggcacuccaggaaaaguacgggcuaguggaaagggccgagaccaggcucucaaucacgcccgugcgcguagcccagagccugcccacguggacaugcgcggccgcagccgcacucaaggaauaccucccggucggacccgcggucaugaacuugaaaguggaaaauuacccaccagagaugaugugcauggccuucggcucgcuaauaccaacgaccggggucucggaagcgaccacgaaaacgcuuauggaagcauacucgcucuggcaagacgccuucaccaagaccauaaacgugaaaaugcgaggggccucgaaaacggaaguguacaacagcuuucgcgauccccugcacgcagccgugaacucggucuucuucccgaacgaugucagggucaggugguugaaagcgaaagggauccugggcccggacggggucccgagcagggccgcagaaguggcagcagccgcguacaggaacuuguga

SEQ ID NO: 8337 - RNA, 738 nt, Artificial Sequence
  derived and/or modified CDS sequence (opt11) from SFTSV(HB2014-20)__KU738910.1__N
augagcgaguggucacgcauagccguggaguucggcgaacaacagcucaaccucacggaacuggaagacuucgcgcgcgagcuagcguacgaaggccuagacccggcccugaucaucaaaaagcucaaggaaacgggcggagacgacuggguaaaagacaccaaguucauaauagucuucgcacuaacgcgcgggaacaagauaguaaaagcgagcggaaaaaugagcaacaguggaagcaagcgccugaugacacuccaggaaaaauacgggcucguggaaagggccgagacccggcuaucgaucacgcccguacgcguggcacagagccuaccaacguggacgugcgcagccgcggccgcacucaaggaauaccucccggucgggcccgcagucaugaaccuaaaaguggaaaacuacccgcccgagaugaugugcauggccuucggaucacucauacccacggccggagucucagaagcaaccacaaaaacacucauggaagcguacucacucuggcaagaugccuucaccaagaccauaaacgugaaaaugcgaggagccucgaaaacagaaguauacaacagcuuccgagacccccugcacgcggccgugaacucagucuucuucccgaacgacgucagagucaaguggcugaaagcaaaaggaauccuaggcccggacggagucccgagcagggccgcggaaguagcagcggccgcguacaggaacuuauga

SEQ ID NO: 8338 - RNA, 738 nt, Artificial Sequence
  derived and/or modified CDS sequence (opt11) from SFTSV(LN2012-14)__KF887431.1__N
augagcgagcgaucacgcauagccguggaguucggagaacaacagcucaaccucacgggccuggaagacuucgcgcgcgaacucgcguacgaaggccuggacccggcccugaucaucaaaaagcucaaggaaacgggcggagacgacugggugaaagacaccaaguucauaauaguauucgcacucacgcgcggaaacaaaaucgugaaagcaagcggaaaaaugagcaacagcgggagcaagcgccugauggcgcuccaggaaaaguacggacucguggaaagggccgagaccaggcucucgauaacgcccgugcgcguggcccagagccugccaacauggacaugcgcggccgcagccgcgcucaaggaauaccucccggucgggcccgccgucaugaaccugaaagucgaaaacuauccgcccgagaugaugugcauggccuucggcucgcucauacccacggcaggagucucggaagcgacaacgcgcacgcucauggaagcauacucacuauggcaagacgcauucaccaagaccauaaacgugaaaaugcgcggggccucaaaaacggaaguguacaacagcuuucgcgacccccugcacgcggccgugaacucggucuucuuccccaacgacguccgagucaaguggcugaaagcgaaagggauccugggcccggacggagucccgagcagggccgcggaaguggccgcagccgcguacagaaaccuguga

SEQ ID NO: 8339 - RNA, 738 nt, Artificial Sequence
  derived and/or modified CDS sequence (opt11) from SFTSV(NB31/CHN/2013)__KR698325.1__N
augagcgaauggucgcgcauagccguagaguucggcgaacaacagcucaaccucauagaauuggaagacuucgcgcgcgagcucgcauacgaaggccuggacccggccuugaucauaaagaaacucaaagaaacgggcggggacgacugggugcgcgacaccaaguucauaaucguauucgcgcucacacgcggaaacaagaucgugaaagcgagcgggaaaaugagcaacagcgggagcaagcgccugauggcgcuacaggaaaaguacggguuaguggaaaaggccgagaccaggcucucgauaacgcccgugcgcguggcccagagccugcccacguggacaugcgcggccgcggccgcgcucaaggaauaccucccgguagggcccgcggucaugaaccugaaaguagaaaacuacccgcccgagaugaugugcauggccuucggaucgcucauccccacggccggggucucgaaaccaaccacgaaaacgcucauggaagcguacucgcuauggcaagacgcauuuaccaagaccauaaacgugaaaaugcgcggcgccucaaaaacagaaguguacaacagcuuccgagacccccugcacgcggccguaaacucggucuuuuucccgaacgacgucagagucaaguggcugaaagcaaaagggaucuugggcccggacggagucccgagcagagccgcggaaguggccgcggccgcauacaggaacuuguga

SEQ ID NO: 8340 - RNA, 738 nt, Artificial Sequence
  derived and/or modified CDS sequence (opt11) from SFTSV(QD7)__KR706565.1__N
augagcgaguggucucgcauagccguagaguucggagugcaacagcucaaccucacggaacuagaagacuuugcgcgcgaacuagcauacgagggccuggacccggccuugaucaucaaaaagcucaaagaaacgggaggggacgacugggugaaagacaccaaguucauaaucguauucgcgcucacaagagggaacaagaucgugaaagcgagcgggaaaaugagcaacagcggcagcaagcgacuaauggcgcuccaggaaaaauacgggcuaguagaaagggccgaaacacgacucucaaucacgcccgugcgcguggcccagagccugcccacguggacgugcgcggccgcggccgcgcuaaaagaauaccucccgguaggacccgcggucaugaaccugaaaguggaaaacuauccgcccgagaugaugugcauggccuucggcucgcucauacccacggccggggucucggaagcgaccacgaaaacacucauggaagcguacucgcucuggcaagacgccuucaccaagaccauaaacgugaaaaugcgcggggccucgaaaacggaaguguacaacagcuucagagacccccugcacgcggccgugaacucagucuucuucccgaacgacgucagggucaaguggcugaaagcgaaagggauccuaggcccggacggagucccgagcagggccgcggaaguggccgcggccgcguacagaaaccuguga

SEQ ID NO: 8341 - RNA, 738 nt, Artificial Sequence
  derived and/or modified CDS sequence (opt11) from SFTSV(SDLZP06/2011)__JQ693009.1__N
augagcgaguggucgcgcacggcaguggaauuuggcgagcaacagcuaaaccucacggaacuggaagacuucgcgcgcgagcucgcguacgagggccuggacccggccuugaucaucaaaaagcucaaggaaacaggcggggacgacugggugaaagacaccaaguucauaauaguguucgcgcucacgcgcgggaacaagaucguaaaagcgagugggaaaaugagcaacagcgggagcaagcgacugauggcgcuccaggaaaaguacgggcuaguggaaagggccgagacaaggcucucgaucacgccaguacgcguagcccagagccugccaacguggacgugcgcggccgcggccgcgcucaaggaauaccucccggucgggcccgcagucaugaaccugaaaguggaaaauuacccacccgagaugaugugcauggccuuuggcucacucauaccaacggcaggagucucggaagcaacaacgaaaacgcucauggaagcguacucacucuggcaagacgccuucacaaagaccauaaacguaaaaaugcgcggggccucgaaaacagaaguguacaacagcuuccgcgaccccuugcacgcggccgucaacucggucuucuuuccgaacgacguaagggucaaguggcugaaagcgaaaggaaucuugggcccggacggagucccgagcagggccgcggaaguagccgcagccgcguacagaaaccuguga

SEQ ID NO: 8342 - RNA, 738 nt, Artificial Sequence
  derived and/or modified CDS sequence (opt11) from SFTSV(ZJZHSH-FDE/China/06/2012)__KR017821.1__N
augagcgaguggucgcgcauagcaguggaguucggcgaacaacagcucaaucucacggaacuggaagacuucgcgcgcgagcucgcguacgagggccuagacccggcccugaucaucaaaaagcucaaggaaacaggcggagacgacugggugcgcgacaccaaauucauaauaguguucgcgcucacgcgcgggaacaagaucgugaaagcgagugggaaaaugagcaacagcggaagcaagcgccugauggcacuccaggaaaaguacgggcucguggaaaaggccgagaccaggcucucaaucacgcccguacgcguggcccaaagccuacccacguggacgugcgcagcagcggcagcgcucaaggaauaucuaccggucgggcccgcggucaugaacuugaaaguggaaaauuacccgcccgagaugaugugcauggccuucggcucgcuaauacccacagccggggucucggaagcaaccacaaaaacgcuaauggaagcguacucgcucuggcaagacgccuucaccaagacaauaaacguaaaaaugcgcggggccucgaaaacggaaguguacaacagcuuccgcgaccccuuacacgcggccgugaacucgguccuguucccgaacgacgucagggucaaaugguugaaagcgaaaggaaucuugggaccggacggggucccgagcagggccgcagaaguggccgcagccgcguacaggaaccuguga

SEQ ID NO: 8343 - RNA, 738 nt, Artificial Sequence
  derived and/or modified CDS sequence (opt11) from SFTSV(ZJZHSH-FZHR/China/07/2013)__KR017824.1__N
augagcgaguggucacgaauagccguggaauuuggcgagcaacagcucaaucuaacggaauuagaagauuucgcgcgcgagcuagcguacgagggccuggacccggcccugauaaucaaaaagcucaaggaaacgggaggggacgacuggaugaaagacaccaaguucauaauaguguucgcgcucacgcgcgggaacaagaucgugaaagcgagcgggaaaaugagcaauagcgggagcaagcgcuugauggcacuccaggaaaaguacgggcucguggaaagagccgagaccaggcucucgaucacgcccgugcgcguagcccagagccugcccacguggacgugcgcggccgcggccgcacuaaaggaauaucuaccggucgggcccgcggucaugaacuuaaaaguggaaaauuacccgcccgagaugaugugcauggccuucggcucgcucauacccacggccggggucucggaagcgacaaccaaaacgcucauggaagcguacucacucuggcaagacgccuuuaccaagaccauaaacgugaaaaugagaggggccucgaaaacggaaguguacaauagcuuucgcgaucccuugcacgcggccgugaacucggucuucuucccgaacgauguacgggucaaguggcuaaaagcgaaagggauccugggcccggacgggguaccgaguagagccgcggaaguagccgcggccgcauacaggaaccuguga

SEQ ID NO: 8344 - RNA, 738 nt, Artificial Sequence
  derived and/or modified CDS sequence (opt11) from SFTSV(ZJZHSH-HYC/China/05/2012)__KR017809.1__N
augagcgaguggucacgcauagccguggaauuuggcgagcaacagcuaaaucucacggaacuggaagacuucgcgcgcgagcucgcguacgagggcuuggacccggccuugaucaucaaaaagcucaaggaaacgggcggagacgacugggugcgcgacaccaaauucauaauaguguucgcgcucacgcgcgggaacaagaucguaaaagcgagcgggaaaaugagcaauagcgggagcaagcgccuaauggcgcuacaggaaaaguacgggcucguagaaaaggccgagaccagacucucgaucacgcccgugcgaguggcccagagcuugcccacguggacgugcgcggccgcggccgcgcucaaggaauaucuaccggucgggcccgcgguaaugaaccugaaaguggaaaauuacccgcccgaaaugaugugcauggccuucggcucacucauccccacggucggggucucggaagcgaccacgaaaacgcuaauggaagcguacucgcucuggcaagaugcauuuaccaagaccauaaacguaaaaaugcgcggggccucgaaaacggaaguguacaauagcuuccgcgauccccuacacgcggccgugaacucggucuucuucccgaacgaugucagggucaagugguugaaagcgaaaggaaucuugggcccggacggggucccaagcagagccgcggaaguggccgcggccgcauacaggaacuuguga

SEQ ID NO: 8345 - RNA, 738 nt, Artificial Sequence
  derived and/or modified CDS sequence (opt11) from SFTSV(SPL003A)__AB817996.1__N
augagcgaguggucacgcauagccguggaguucggcgaacaacaacucaaccucacggaacuggaagacuucgcacgcgaacuagcguacgaaggccuagacccagcacuaaucaucaaaaagcucaaggaaacgggcggagacgacuggguacgagacaccaaguucauaauaguauucgcacucacgcgcgggaacaagaucgugaaagcgagcgggaaaaugagcaacagcgggagcaagcgccuaauggcgcuccaggaaaaguacgggcucguggaaagagccgagacccgacucucgaucacgcccgugcgcguggcccagagccuacccacguggacgugcgcggccgcggccgcgcucaaggaauaccucccggucgggcccgcagucaugaaccugaaaguggaaaacuacccgcccgagaugaugugcauggcauucggcucgcucauacccacggccggaguaucagaagcgaccacaaaaacacucauggaagcguacucgcucuggcaagacgccuucaccaagaccauaaacgucaaaaugcgcggggccuccaaaacagaaguguacaacagcuuccgagacccacuacacgcggcagugaacucagucuucuucccgaacgaugucagaguaaaguggcugaaagcaaaaggaauccuaggaccggacggggccccgagcagagccgcagaaguggccgcagccgcguaccgaaaccuguga

SEQ ID NO: 8346 - RNA, 738 nt, Artificial Sequence
  derived and/or modified CDS sequence (opt11) from SFTSV(SPL077A)__AB985536.1__N
augagcgaguggccgcgcauagccguggaauuuggcgaacaacagcucaaucucacggaauuggaagauuucgcacgagagcucgcguacgagggauuggacccagccuuaauuaucaaaaagcucaaggaaacgggcggggacgacugggugcgcgauaccaaguucauaauaguguuugcacucacgcgagggaacaagaucgugaaagcgagcgggaaaaugagcaacagugggagcaagcgcuugauggcgcuccaggaaaaguacgggcucguggaaagagccgagacaaggcucucaauaacgcccgugcgcguggcccagagccugccaacguggacgugcgcggccgcggccgcgcucaaggaauaucucccggucgggccagcggucaugaaccugaaaguggaaaauuacccaccagagaugaugugcauggccuuuggaucacuaauacccacggccggagucucggaagcaaccacaaaaacgcucauggaagcguacucgcuauggcaagacgccuuuaccaagacaauaaacgugaaaaugcgcggggcaucgaaaacggaaguguacaauagcuuccgagaucccuugcacgcggccgugaacucggucuucuucccgaacgaugucagggucaagugguuaaaagcaaaagggaucuugggcccggacggggucccgagcagagccgcggaaguagccgcggccgcguacaggaacuuguaa

SEQ ID NO: 8347 - RNA, 738 nt, Artificial Sequence
  derived and/or modified CDS sequence (opt11) from SFTSV(SPL106A)__AB985548.1__N
augagcgacuggucgcgaaucgccguagaguucggcgaacaacaacucaaccucacggaacuagaagacuucgcacgcgaacucgcauacgaaggccucgacccggcccugaucaucaaaaagcucaaagaaacaggcggcgacgacuggguccgcgacaccaaauucauaauagucuucgcccucacacgcggaaacaagaucguaaaagcaagcgggaaaaugagcaacagcggaagcaagcgccuaauggcacuccaagaaaaauacggacucguagaaagagccgaaaccagacucucaaucacacccguacgcguggcccagucccuacccaccuggaccugcgcagccgcagccgcacuaaaagaauaccuaccggucggacccgcagucaugaaccugaaaguagaaaacuacccacccgaaaugaugugcauggccuucggcucacucauacccacagccggggucuccgaagcaaccacaaaaacacucauggaagcauacucacucuggcaagacgccuucaccaaaaccaucaacgucaaaaugcgcggggccucaaaaacggaaguauacaacagcuuccgcgacccccuacacgcggccgugaacucaguauucuucccaaacgacgucagagucaagugguuaaaagcaaaagggauccuaggcccggacggagucccaagcagggccgccgaaguagccgcagccgcauacagaaaccuguaa

SEQ ID NO: 8348 - RNA, 738 nt, Artificial Sequence
  derived and/or modified CDS sequence (opt11) from SFTSV(SPL114A)__AB985552.1__N
augagcgaguggucgcgcauagccguggaguucggcgaacaacagcucaaccucacggaacuggaagacuucgcgcgcgagcucgcguacgaaggccuagacccggcccugaucaucaaaaagcucaaggaaacgggcggggacgacugggugcgcgacaccaaguucauaauaguguucgcccucacgcgagggaacaagauagugaaagcgcccgggaaaaugagcaacagugggaguaagcgacuaauggcgcuucaggaaaaguacgggcucguggaaagggccgagaccagacucucaaucacacccgugcgaguggcccagagccugcccacguggacaugcgcggccgcggccgcgcucaaagaauaccucccggucgggccugcggucaugaaccugaaaguagaaaacuacccacccgagaugaugugcauggcauucggcucacuaauacccacggccggggucucggaagcgaccacgaaaacacucauggaagcauacucacuauggcaagacgccuucacaaagaccauaaacgugaaaaugcgaggggccucgaaaacggaaguauacaacagcuuccgcgacccccugcacgcggccgugaacucagucuucuucccgaacgacgucagggucaaauggcugaaagcaaaaggaauccuaggcccggacggagucccgagcagagccgcggaaguggccgcagccgcguacaggaaccuguga

SEQ ID NO: 8349 - RNA, 738 nt, Artificial Sequence
  derived and/or modified CDS sequence (opt11) from SFTSV(SPL125A)__AB985557.1__N
augagcgaguggucgggcguggccguagaguucggcgaacaacagcucaaucucacggaauuggaagauuucgcgcgcgaacucgcguacgagggacuggacccggccuugaucaucaaaaagcucaaagagacgggcggggacgauugggugcgcgacacaaaguucauaauaguguucgcacucacacgagggaacaagauagugaaagcgagcgggaaaaugagcaauagcggcagcaagcgccuaauggcgcuccaggaaaaguacgggcucguagaaagagccgagaccagacucucgaucacgcccgugcgaguggcccagagcuugcccacauggacgugcgcggccgcggccgcgcucaaggaauaccuaccggucgggcccgcggucaugaacuuaaaaguggaaaacuacccgcccgagaugaugugcauggccuuuggcucacucauacccacggccggggucucggaagcgaccacgaaaacgcucauggaagcguacucgcucuggcaagaugccuucaccaagaccauuaacgugaaaaugagaggggccucgaaaacagaaguguacaacagcuuucgagacccccuacacgcggccgugaacucggucuucuucccgaacgacgucagggucaaguggcugaaagcaaaagggauccugggcccggacggggucccgagcagagccgcagaaguggccgcggcagcguacagaaaccuguga

SEQ ID NO: 8350 - RNA, 738 nt, Artificial Sequence
  derived and/or modified CDS sequence (opt11) from SFTSV(SPL160A)__AB985571.1__N
augagcgaguggucgcgcauagccguggaguucggcgaacaacagcuaaaccucacggaauuggaagacuucgcgcgcgaacucgcauacgagggauuggacccggcccugauuauaaccaagcuaaaggaaacgggaggagacgacugggugcgcgacaccaaauucauaaucguguucgcacucacgcgaggaaacaaaaucgugaaagcgagcgggaaaaugagcaacagcgggagcaagcgccugauggcgcuccaggaaaaguacggacucguagaaagagccgagaccaggcucucgaucacacccgugcgcguggcccagagccugcccacguggacaugcgcggccgcggccgcgcucaaggaauaccucccggucgggcccgcggucaugaacuugaaaguggaaaacuacccacccgaaaugaugugcauggccuucggcucacuuauacccacggccggagucucggaagcgaccacaaaaacgcucauggaagcguacucacucuggcaagaugccuucaccaagaccauaaacgugaaaaugagaggggccucaaaaacggaaguguacaacagcuuccgcgacccccuacacgcggccgugaacucagucuucuucccgaacgacgucagggucaagugguugaaagcgaaagggauccuaggcccagacggggucccaagcagggccgcggaaguagccgcggccgcguacaggaaccuguga

SEQ ID NO: 8351 - RNA, 738 nt, Artificial Sequence
  derived and/or modified CDS sequence (opt11) from SFTSV(SPL163A)__AB985573.1__N
augagcgaguggucgagaauagcaguggaguucggcgaacaacagcuaaaccucacggaacuggaagacuucgcgcgcgaacucgcguacgagggccuggacccggcccuaaucaucaaaaagcucaaggaaacgggcggggacgacugggugcgcgauaccaaguucauaauaguguucccacuaacgcgcgggaacaagaucgugaaagcgagcggaaaaaugagcaauagcggaagcaagcgccugauggcgcuccaggaaaaauacgggcucguggaaagggcagaaacaagacucucgaucacaccagugcgcguggcccagagccuacccacauggacaugcgcagccgcggccgcgcucaaggaauaccucccggucggacccgcagucaugaaccugaaaguggaaaacuacccgcccgagaugaugugcauggccuucggcucacucauacccacggccggagucucggaagcaaccacgaaaacgcuaauggaagcauacucgcucuggcaagacgcauucaccaagaccauaaacguaaaaaugcgcggggcaucgaaaaccgaaguauacaauagcuuccgcgaccccuugcacgcggccguaaacucggucuucuucccgaacgacgucagagucaaguggcugaaagcgaaagggauccugggcccggacggggucccgaguagggccgcagaaguggcagcagccgcauacaggaaccuguga

SEQ ID NO: 8352 - RNA, 738 nt, Artificial Sequence
  derived and/or modified CDS sequence (opt11) from SFTSV/FTLSV(2011YPQ12)__KF711915.1__N
augagcaaguggucacgcauagccguggaguucggcgaacaacagcucaaccuaacggaacuggaagacuucgcacgcgagcucgcguacgagggccuagacccggcccugaucaucaaaaagcucaaggaaacgggcggagacgauugggugaaagacaccaaguucauaauaguguucgcacucacgcgcgggaacaagaucgugaaagcaagcggaaaaaugagcaacagcgggagcaagcgacugauggcgcuccaggaaaaguacgggcuaguggaaagggccaagaccaggcucucaaucacacccgugcgcguggcccagagccugcccacguggacgugcgcggccgcggccgcgcucaaggaauaccucccagucgggcccgcggucaugaaccugaaaguggaaaauuacccgcccgagaugaugugcauggcauucggcucgcucauaccaacggccggagucucggaagcgaccacgaaaacgcucauggaagcauacucgcucuggcaagacgccuucaccaagaccauaaacgugaaaaugcgcggagccucgaaaacagaaguguacaacagcuuccgagacccacugcacgcggccguaaacucgguuuucuucccgaacgacguaagggucaaauggcuaaaagcgaaaggaauccugggcccggacggagucccgagcaaggccgcagaaguagccgcagccgcguacagaaaccuguga

SEQ ID NO: 8353 - RNA, 738 nt, Artificial Sequence
  derived and/or modified CDS sequence (opt11) from SFTSV/FTLSV(2011YXX9)__KF711898.1__N
augagcgaguggucgcgcauagccguggaguucggagaacaacagcucaaccuaacagaacuggaagacuucgcgcgcgaacucgcguacgaaggccuggacccggcccugaucaucaaaaagcuaaaagaaacgggcggggacgacugggugaaagauacaaaguucauaauaguguucgcgcucacacgcggaaacaagaucgugaaagcgagcggaaaaaugagcaacagcggaagcaagcgccuaauggcacuacaggaaaaguacggacucguggaaagggccgagaccaggcucucgaucacgcccgugcgcgucgcccagagccuacccacguggacaugcgcagccgcggccgcacucaaggaauaccucccggucgggcccgcggucaugaaccugaaaguggaaaacuacccgcccgagaugaugugcauggcauucggaucgcucauacccacagccggggucucggaagcaaccacaaaaacgcucguagaagcguacucgcucuggcaagacgccuucaccaaaaccaucaacgugaaaaugcgaggagccucgaaaacggaaguguacaacagcuuccgcgacccccugcacgcggcagugaacucggucuucuucccgaacgacgucagggucaaguggcugaaagcgaaagggauccugggcccagacggagucccgagcagagcagcggaaguggccgcggccgcguaccggaacuuguga

SEQ ID NO: 8354 - RNA, 738 nt, Artificial Sequence
  derived and/or modified CDS sequence (opt11) from SFTSV/FTLSV(YPQ2)__KF356519.1__N
augagcgaguggucgcgcauagcaguggaguucggcgaacaacagcucaaccuaacggaacuggaagacuucgcacgagagcuagcguacgagggccuggacccggcccuaaucauaaagaaacucaaagaaacgggcggagacgauuggguaaaagacaccaaguucauaaucguguucgcgcucacgcgcgggaacaagaucguaaaagcgagcggaaaaaugagcaacagcgggagcaaacgacuaauggcgcuccaggaaaaguacgggcucguggaaagggccgagaccagacuaucgaucacgcccgugcgaguggcccagagucugcccacauggacgugcgcagcagcggccgcgcucaaggaauaccucccagucgggcccgcagucaugaacuugaaaguggaaaacuacccgcccgagaugaugugcauggccuucggcucacuaauacccacggccggagucucggaagcgaccacgaaaacacucauggaagcauacucacucuggcaagacgccuucaccaaaaccauaaacgugaaaaugcgaggggccucaaaaacggaaguguacaacagcuuccgagacccccugcacgcggccgugaacucgguauucuucccgaacgacgucagggucaaguggcugaaagcaaaagggauccuaggcccgaacggggucccgagcagagccgcggaaguggccgcggccgcauacagaaaccuguga

SEQ ID NO: 8355 - RNA, 738 nt, Artificial Sequence
  derived and/or modified CDS sequence (opt11) from SFTSV/Guertu virus(DXM)__KT328591.1__N
augagcgaauggucgaaaauagccgucgaauucggcgaacaacaacucaacgucauagaacuggaagaauucgcccgcgaacucgcauacgagggccuagacccagcccugaucauaaaaaaacuaaaagaagucggcggcgacgacuggaugcgcgacaccaaauucauaauaguauucgcacuaacacgcggaaacaaaauccuaaaagcagcaggaaaaaugagcaacuccggaagcaaacgcauaauggcccuccaagaaaaguacggacuagucgaaagagccgaaacccggcucucaaucacacccgugcgaguagcccaaagccuacccacauggacaugcucagccgcagccgcacuccaagaauaccucccagucggacccgccguaaugucccuaaaaguauccaacuucccacccgaaaugaugugcauggccuucggcucccucauacccgccaccggaguccccgaaucaaccacaaaaauccuaauggaagcauacucacucuggcaagacgccuucacaaaaaccauaaacguaaaaaugcgaggagccucaaaagccgaagucuacaacagcuuccgcgacccccuacacgcagccguaaacucagucuucuucccaaacgacguccgacuacgauggcuaaaaucaaaaggaauccuaggcccagacggacucccaagcaaagccguagaaacagccgccgccgccuaccgcaaccuguaa

SEQ ID NO: 8356 - RNA, 738 nt, Artificial Sequence
  derived and/or modified CDS sequence (opt11) from SFTSV/Huaiyangshan virus(2010-FQM)__HQ419240.1__N
augagcgaguggucgcgcauagccgugaaauucggcgagcaacagcucaaccucacggaacuggaagacuucgcgcgcgagcuagcauacgaaggccuagacccggcccugaucaucaaaaagcucaaggaaacgggcggggacgacuggguaaaagacaccaaguucauaauaguguucgcacucacgcgcgggaacaagaucguaaaagcgagcgggaaaaugagcaacagcgggagcaaacgccugauggcacuacaggaaaaguacgggcuaguggaaagggccgagaccagacucuccaucacacccgugcgcguggcccagagccugcccacguggacaugcgcagccgcggccgcacucaaggaauaccucccggucggacccgcggucaugaacuugaaaguagaaaacuacccgcccgaaaugaugugcauggccuucggcucgcucauaccaacagccggagucucagaagcaacaacgaaaacacucauggaagcguacucgcuauggcaagacgccuucaccaagaccaucaacguaaaaaugcgcggggccucgaaaacggaaguguacaacagcuuccgcgaccccuuacacgcggccguaaacucagucuuucuaccgaacgaugucagagucaaguggcugaaagcgaaaggaauccuagguccggacggggucccgagcagagccgcggaaguagccgcggccgcguacaggaaccuguga

SEQ ID NO: 8357 - RNA, 738 nt, Artificial Sequence
  derived and/or modified CDS sequence (opt11) from SFTSV/Huaiyangshan virus(2010-ZGQ)__HQ419241.1__N
augagcgaguggucgcgcauagccguagaguucggcgaacaacagcucaaccucacggaacuggaagacuucgcgcgcgaacucgcauacgagggccuggacccggcccugaucaucaaaaagcucaaggaaacgggcggggacgacugggugaaagacacaaaguucauaauaguauucgcgcucacgcgaggaaacaagaucguaaaagcaagcgggaaaaugagcaacagcgggagcaagcgccugaugucacuccaggaaaaguacgggcuaguggaaagggccgagaccaggcucucaauuacacccguacguguagcccagagccugcccacauggacgugcgcggccgcggccgcgcucaaggaauaccucccggucgggcccgcaguaaugaaccugaaaguggaaaacuacccgcccgagaugaugugcauggccuucggcucgcucauaccaacggccggagucucggaagcgaccacgcgcacgcucauggaagcguacucccuauggcaagacgccuucaccaaaaccauaaacgugaaaaugcgcggagcaucaaaaacggaaguauacaacagcuuccgcgacccacugcacgcagccguaaacucagucuucuucccgaacgacguccgggucaaauggcugaaagcgaaagggauccugggcccggacggggucccgagcagggccgcggaaguggccgcggccgcguacagaaaccuauaa

SEQ ID NO: 8358 - RNA, 738 nt, Artificial Sequence
  derived and/or modified CDS sequence (opt11) from SFTSV/Huaiyangshan virus(S-HGX)__HQ171192.1__N
augagcgaguggucgcgcauagccguagaguucggcgaacaacagcucaaucucacggaacuggaagacuucgcgcgagagcuagcauacgagggccuggacccggcacugaucaucaaaaagcuaaaggaaacaggcggggacgacugggugaaagacaccaaguucauaauaguguucgcgcucacgcgagggaauaagaucgugaaagcaagcgggaaaaugagcaacuccggguccaagcgccugauggcgcuccaggaaaaguacgggcucguggaaagggcagaaaccaggcucucgaucacgcccgugcgcguggcccagagccugcccacguggacgugcacagccgcggccgcacucaaggaauaccucccggucgggcccgcggucaugaaccuaaaaguggaaaacuacccgcccgagaugaugugcauggcuuucgaaucgcucauacccacggccggggucuccgaagcaaccacgaaaacgcuaauggaagcguauucacucuggcaagacgcauuuaccaagaccauaaacguggaaaugcgaggggccucgaaaacggaaguauacaacagcuuccgcgacccccuacacgcggccgugaacucaguauucuucccgaacgacgucagagucaaguggcugaaagcgaaaggaauccuaggaccggacggggucccgagcagagccgcagaaguggccgcggccgcguacagaaaccuguaa

SEQ ID NO: 8359 - RNA, 738 nt, Artificial Sequence
  derived and/or modified CDS sequence (opt11) from SFTSV/Huaiyangshan virus(S-HZM)__HQ171193.1__N
augagcgaguggucgcgaauagccguggaguucggcgaacaacagcucaaccucacagaacuagaagacuucgcgcgcgaacucgcauacgaaggauuggacccggcccuaaucaucaaaaagcucaaggaaacgggcggggacgacuggguaaaagacaccgaguucauaauaguguucgcgcuaacgcgcggaaacaagauaguaaaagcgagcggaaaaaugagcaacagcgggaguaagcgccuaauggcgcuacaggaaaaguacgggcucguggaaagagcagagaccaggcucucgaucacgcccgugcgcguggcccagagccuacccacguggacgugcgcggcugcagccgcacucaaggaauaccucccggucgggccagcggucaugaacuugaaaguggaaaacuacccgccagaaaugaugugcauggccuucggcucacuaauacccacgaccggggucucggaagcgaccacgaaaacgcucauggaagcguacucacucuggcaagacgccuucaccaagacaauaaacgugaaaaugcgcggggcaucgaagacggaaguguacaacagcuuccgcgacccacuacacgcggccgugaacucggucuucuucccaaacgaccucagggucaaaugguugaaagcgaaagggaucuugggcccggacggggucccgagcagagccgcggaagucgccgcggccgcauacaggaacuuguga

SEQ ID NO: 8360 - RNA, 738 nt, Artificial Sequence
  derived and/or modified CDS sequence (opt11) from SFTSV/Huaiyangshan virus(S-WJ)__HQ171191.1__N
augagcgaguggucgcgcauagccguggaauuuggcgagcaacagcucaaucucacggaauuggaagacuucgcgcgcgagcuagcguacgagggccugggaccggcccugaucaucaaaaagcucaaggaaacgggcggggacgacugggugaaagacaccaaguucauaauaguauucgcgcucacgcgcgggaacaagauagugaaagcgagcgggaaaaugagcaauagcgggagcaagcgccugauggcgcuacaggaaaaguacgggcuaguggaaagggccgagaccagacucucgauaacgcccguacgcguggcccagagccugcccacguggacgugcgcggccgcggccgcgcucaaggaauaucucccggucggacccgcagucaugaaccugaaaguggaaaacuacccacccgagaugaugugcauggccuuuggcucgcucauacccaccgcaggggucucagaagcgaccacgaaaacgcucauggaagcguacucgcucuggcaagaugcauuuaccaagaccaucaacgugaaaaugcgaggggcuucgaaaacggaaguauacaauagcuuccgcgacccccugcacgcagccgugaacucggucuuuuucccgaacgaugucagggucaaguggcugaaagcgaaagggauccugggcccggacggggucccaagcagagccgcagaaguggcagcggccgcguacaggaacuuauaa

SEQ ID NO: 8361 - RNA, 738 nt, Artificial Sequence
  derived and/or modified CDS sequence (opt11) from SFTSV/Phlebovirus(JS2010-019)__JQ317180.1__N
augagcgaauggucgcgcauagccguggaguucggcgaacaacagcucaaccucacggaacuggaagacuucgcacgcgagcuagcguacgaaggccuagacccggcauugaucaucaaaaagcucaaagaaacgggcggagacgacugggugaaagacaccaaguucauaauaguguucgcgcucacacgcgggaacaaaaucguaaaagcgagcggaaaaaugaguaacagcggaagcaagcgcuuaauggcacuccaggaaaaauacgggcuaguggaaagggccgagaccaggcucucgaucacgcccgugagagucgcccagagccugcccacauggacgugcgcggccgcggccgcucucaaggaauaccucccggucggacccgcggucaugaaccugaaaguggaaaacuacccgcccgagaugaugugcauggccuucggcucgcuaauaccaacggccggagucucggaagcaacaacgaaaacgcucauggaagcguacucgcucuggcaagacgccuucaccaagaccauaaacgugaaaaugcgcggggccucgaaaacagaaguguacaacagcuuccgagacccccugcacgcggccgugaacucggucuucuucccgaacgacgucagggucaagugguuaaaagcgaaagggauccugggcccggacggagucccgagcagagccgcggaagcggccgcggcagcauacagaaacuuguga

SEQ ID NO: 8362 - RNA, 738 nt, Artificial Sequence
  derived and/or modified CDS sequence (opt11) from SFTSV/Phlebovirus(SD24/China/2010 strain SD24)__HM802205.1__N
augagcgaauggucacgcauagccguggaguucggcgaacaacagcucaaccuaacggaacuggaagacuucgcgcgagagcuagcguacgagggccuggacccggcauugaucauaaagaaacuaaaagaaacgggcggggacgacugggugaaagacaccaaguucauaaucguguucgcgcucacgcgaggaaacaagaucgugaaagcgagcgggaaaaugaguaacagcgggagcaagcgccugauggcgcuccaggaaaaguacggacucguggaaagagccgagaccaggcucucaauaacgccaguacgcguggcccagagccugcccacguggacgugcgcggccgcggccgcgcucaaggaauaucucccggucgggcccgcggucaugaaccugaaaguggaaaacuacccacccgagaugaugugcauggccuucggcucacucauaccaacggccgggguaacggaagcaaccacaaaaacgcucauggaagcguacucgcucuggcaagaugccuucaccaagaccaucaacgugaaaaugcgcggggccucgaaaacggaagucuacaacagcuuccgcgacccucugcacgcggccguaaacucgguauucuucccaaacgacgucagagucaaguggcugaaagcaaaagggaucuugggcccggacggaguaccgagcagggccgcggaaguggccgcggccgcauacagaaaccuauga

SEQ ID NO: 8363 - RNA, 738 nt, Artificial Sequence
  derived and/or modified CDS sequence (opt11) from SFTSV/Phlebovirus(ZJ1/China/2011)__HE663216.1__N
augagugaguggucgcgcauagccguggaauuuggagagcaacagcucaaccucacggaacuagaagacuucgcacgcgaacuagcauacgagggcuuggacccggcacugauaaucaaaaagcuaaaggaaaccggcggggacgacuggguacgcgauaccaaguucauaauaguguucgcacucacgcgcgggaacaagaucgugaaagcgagcgggaaaaugagcaauagcgggagcaaacgccugauggcgcuccaagaaaaguacgggcucguggaaaaggcagagacccggcucucgaucacgcccgugcgcguggcccagagcuugcccacguggacaugcgcggccgcagccgcgcucaaggaauaccuaccggucgggcccgcggucaugaaccugaaaguggaaaauuacccgcccgagaugaugugcauggccuucggcucacucauacccacggccggggucucagaagcgaccacgaaagcgcucauggaagcguacucgcucuggcaagacgccuuuacaaagaccauaaacgugaaaaugcgcggagccucgaaaacggaaguguacagcucauuccgcgauccauuacacgcggccgugaacucggucuucuucccgaacgacguuagggucaagugguugaaagcgaaagggauccugggcccggacggggucccgagcagggccgcggaaguagccgcagccgcguacaggaaccuauga

SEQ ID NO: 8364 - RNA, 3417 nt, Artificial Sequence
  derived and/or modified CDS sequence (opt4) from ANDV(Chile-9717869)__AF291703.2__GP
auggagggcugguaccugguggugcugggcgugugcuacacccugacccuggccaugcccaagaccaucuacgagcugaagauggagugcccccacaccgugggccugggccagggcuacaucaucggcagcaccgagcugggccugaucagcaucgaggccgccagcgacaucaagcuggagagcagcugcaacuucgaccugcacaccaccagcauggcccagaagagcuucacccagguggaguggagaaagaagagcgacaccaccgacaccaccaacgccgccagcaccaccuucgaggcccagaccaagaccgugaaccugagaggcaccugcauccuggcccccgagcuguacgacacccugaagaaggugaagaagaccgugcugugcuacgaccugaccugcaaccagacccacugccagcccaccguguaccugaucgcccccgugcugaccugcaugagcaucagaagcugcauggccagcguguucaccagcagaauccaggugaucuacgagaagacccacugcgugaccggccagcugaucgagggccagugcuucaaccccgcccacacccugacccugagccagcccgcccacaccuacgacaccgugacccugcccaucagcugcuucuucacccccaagaagagcgagcagcugaaggugaucaagaccuucgagggcauccugaccaagaccggcugcaccgagaacgcccugcagggcuacuacgugugcuuccugggcagccacagcgagccccugaucgugcccagccuggaggacaucagaagcgccgagguggugagcagaaugcuggugcaccccagaggcgaggaccacgacgccauccagaacagccagagccaccugagaaucgugggccccaucaccgccaaggugcccagcaccagcagcaccgacacccugaagggcaccgccuucgccggcgugcccauguacagcagccugagcacccuggugagaaacgccgaccccgaguucguguucagccccggcaucgugcccgagagcaaccacagcaccugcgacaagaagaccgugcccaucaccuggaccggcuaccugcccaucagcggcgagauggagaaggugaccggcugcaccguguucugcacccuggccggccccggcgccagcugcgaggccuacagcgagaacggcaucuucaacaucagcagccccaccugccuggugaacaaggugcagagauucagaggcagcgagcagaagaucaacuucaucugccagagaguggaccaggacguggugguguacugcaacggccagaagaaggugauccugaccaagacccuggugaucggccagugcaucuacaccuucaccagccuguucagccugaugcccgacguggcccacagccuggccguggagcugugcgugcccggccugcacggcugggccaccgugaugcugcugagcaccuucugcuucggcugggugcugauccccgccgugacccugaucauccugaagugccugagagugcugaccuucagcugcagccacuacaccaacgagagcaaguucaaguucauccuggagaaggugaagaucgaguaccagaagaccaugggcagcauggugugcgacgugugccaccacgagugcgagaccgccaaggagcuggagagccacagacagagcugcaucaacggccagugccccuacugcaugaccaucaccgaggccaccgagagcgcccugcaggcccacuacagcaucugcaagcugaccggcagauuccaggaggcccugaagaagagccugaagaagcccgaggugaagaagggcugcuacagaacccugggcguguucagauacaagagcagaugcuacgugggccugguguggugccugcugcugaccugcgagaucgugaucugggccgccagcgccgagaccccccugauggagagcggcuggagcgacaccgcccacggcgugggcgagauccccaugaagaccgaccuggagcuggacuucagccugcccagcagcagcagcuacagcuacagaagaaagcugaccaaccccgccaacaaggaggagagcauccccuuccacuuccagauggagaagcaggugauccacgccgagauccagccccugggccacuggauggacgccaccuucaacaucaagaccgccuuccacugcuacggcgccugccagaaguacagcuaccccuggcagaccagcaagugcuucuucgagaaggacuaccaguacgagaccggcuggggcugcaaccccggcgacugccccggcgugggcaccggcugcaccgccugcggcguguaccuggacaagcugaagagcgugggcaaggccuacaagaucaucagccugaaguacaccagaaaggugugcauccagcugggcaccgagcagaccugcaagcacaucgacgccaacgacugccuggugacccccagcgugaaggugugcaucgugggcaccgugagcaagcugcagcccagcgacacccugcuguuccugggcccccuggagcagggcggcaucauccugaagcaguggugcaccaccagcugcgccuucggcgaccccggcgacaucaugagcacccccagcggcaugagaugccccgagcacaccggcagcuucagaaagaucugcggcuucgccaccacccccgugugcgaguaccagggcaacaccaucagcggcuacaagagaaugauggccaccaaggacagcuuccagagcuucaaccugaccgagccccacaucaccaccaacaagcuggaguggaucgaccccgacggcaacaccagagaccacgugaaccuggugcugaacagagacgugagcuuccaggaccugagcgacaaccccugcaagguggaccugcacacccaggccaucgagggcgccuggggcagcggcgugggcuucacccugaccugcaccgugggccugaccgagugccccagcuucaugaccagcaucaaggccugcgaccuggccaugugcuacggcagcaccgugaccaaccuggccagaggcagcaacaccgugaagguggugggcaagggcggccacagcggcagcagcuucaagugcugccacgacaccgacugcagcagcgagggccugcuggccagcgccccccaccuggagagagugaccggcuucaaccagaucgacagcgacaagguguacgacgacggcgccccccccugcaccuucaagugcugguucaccaagagcggcgaguggcugcugggcauccugaacggcaacuggaucguggugguggugcugguggugauccugauccugagcaucaucauguucagcgugcugugccccagaagaggccacaagaagaccguguga

SEQ ID NO: 8365 - RNA, 3417 nt, Artificial Sequence
  derived and/or modified CDS sequence (opt4) from ANDV(AH-1)__AF324901.2__GP
auggagggcugguaccugguggcccugggcgugugcuacacccugacccuggccaugcccaagaccaucuacgagcugaagauggagugcccccacaccgugggccugggccagggcuacaucaucggcagcaccgagcugggccugaucagcaucgaggccgccagcgacaucaagcuggagagcagcugcaacuucgaccugcacaccaccagcauggcccagaagagcuucacccagguggaguggagaaagaagagcgacaccaccgacaccaccaacgccgccagcaccaccuucgaggcccagaccaagaccgugaaccugagaggcaccugcauccuggcccccgagcuguacgacacccugaagaaggugaagaagaccgugcugugcuacgaccugaccugcaaccagacccacugccagcccaccguguaccugaucgcccccgugcugaccugcaugagcaucagaagcugcauggccagcguguucaccagcagaauccaggugaucuacgagaagacccacugcgugaccggccagcugaucgagggccagugcuucaaccccgcccacacccugacccugagccagcccgcccacaccuacgacaccgugacccugcccaucagcugcuucuucacccccaagaagagcgagcagcugaaggugaucaagaccuucgagggcauccugaccaagaccggcugcaccgagaacgcccugcagggcuacuacgugugcuuccugggcagccacagcgagccccugaucgugcccagccuggaggacaucagaagcgccgagguggugagcagaaugcuggugcaccccaucggcgaggaccacgacgccauccagaacagccagagcuaccugagaaucgugggccccaucaccgccaaggugcccagcaccagcagcaccgacacccugaagggcaucgccuucgccggcgugcccauguacagcagcuucagcacccuggugagaaacgccgaccccgaguucguguucagccccggcaucauccccgagagcaaccacagcgugugcgacaagaagaccgugcccaucaccuggaccggcuaccugcccaucagcggcgagauggagaaggugaccggcugcaccguguucugcacccuggccggccccggcgccagcugcgaggccuacagcgagaacggcaucuucaacaucagcagccccaccugccuggugaacaaggugcagagauucagaggcagcgagcagaagaucaacuucaucugccagagaguggaccaggacguggugguguacugcaacggccagaagaaggugauccugaccaagacccuggugaucggccagugcaucuacaccuucaccagccuguucagccugaugcccgacguggcccacagccuggccguggagcugugcgugcccggccugcacggcugggccaccgugaugcugcugagcaccuucugcuucggcugggugcugauccccgccgugacccugaucauccugaagugccugagagugcugaccuucagcugcagccacuacaccaacgagagcaaguucaaguucauccuggagaaggugaagguggaguaccagaagaccaugggcagcauggugugcgacgugugccaccacgagugcgagaccgccaaggagcuggagagccacagacagagcugcaucaacggccagugccccuacugcaugaccaucaccgaggccaccgagagcgcccugcaggcccacuacagcaucugcaagcugaccggcagauuccaggaggcccugaagaagagccugaagaagcccgaggugaagaagggcugcuacagaacccugggcguguucagauacaagagcagaugcuacgugggccugguguggugccugcugcugaccugcgagaucgugaucugggccgccagcgccgagaccccccugauggagagcggcuggagcgacaccgcccacggcgugggcgagauccccaugaagaccgaccuggagcuggacuucagccugcccagcagcagcagcuacagcuacagaagaaagcugaccaaccccgccaacaaggaggagagcauccccuuccacuuccagauggagaagcaggugauccacgccgagauccagccccugggccacuggauggacgccaccuucaacaucaagaccgccuuccacugcuacggcgccugccagaaguacagcuaccccuggcagaccagcaagugcuucuucgagaaggacuaccaguacgagaccggcuggggcugcaaccccggcgacugccccggcgugggcaccggcugcaccgccugcggcguguaccuggacaagcugaagagcgugggcaaggccuacaagaucaucagccugaaguacaccagaaaggugugcauccagcugggcaccgagcagaccugcaagcacaucgacgccaacgacugccuggugacccccagcgugaaggugugcaucgugggcaccgugagcaagcugcagcccagcgacacccugcuguuccugggcccccuggagcagggcggcaucauccugaagcaguggugcaccaccagcugcgccuucggcgaccccggcgacaucaugagcacccccagcggcaugagaugccccgagcacaccggcagcuucagaaagaucugcggcuucgccaccacccccgugugcgaguaccagggcaacaccgugagcggcuacaagagaaugauggccaccaaggacagcuuccagagcuucaaccugaccgagccccacaucaccaccaacaagcuggaguggaucgaccccgacggcaacaccagagaccacgugaaccuggugcugaacagagacgugagcuuccaggaccugagcgacaaccccugcaagguggaccugcacacccaggccaucgagggcgccuggggcagcggcgugggcuucacccugaccugcaccgugggccugaccgagugccccagcuucaugaccagcaucaaggccugcgaccuggccaugugcuacggcagcaccguggccaaccuggccagaggcagcaacaccgugaagguggugggcaagggcggccacagcggcagcagcuucaagugcugccacgacaccgacugcagcagcgagggccugcuggccagcgccccccaccuggagagagugaccggcuucaaccagaucgacagcgacaagguguacgacgacggcgccccccccugcaccuucaagugcugguucaccaagagcggcgaguggcugcugggcauccugaacggcaacuggaucguggugguggugcugguggugauccugauccugagcaucaucauguucagcgugcugugccccagaagaggccacaagaagaccguguga

SEQ ID NO: 8366 - RNA, 3417 nt, Artificial Sequence
  derived and/or modified CDS sequence (opt4) from ANDV(CHI-7913)__AY228238.1__GP
auggagggcugguaccugguggcccugggcaucugcuacacccugacccuggccaugcccaagaccaccuacgagcugaagauggagugcccccacaccgugggccugggccagggcuacaucaucggcagcaccgagcugggccugaucagcaucgaggccgccagcgacaucaagcuggagagcagcugcaacuucgaccugcacaccaccagcauggcccagaagagcuucacccagguggaguggagaaagaagagcgacaccaccgacaccaccaacgccgccagcaccaccuucgaggcccagaccaagaccgugaaccugagaggcaccugcauccuggcccccgagcuguacgacacccugaagaaggugaagaagaccgugcugugcuacgaccugaccugcaaccagacccacugccagcccaccguguaccugaucgcccccgugcugaccugcaugagcaucagaagcugcauggccagaguguucaccagcagaauccaggugaucuacgagaagacccacugcgugaccggccagcugaucgagggccagugcuucaaccccgcccacacccugacccugagccagcccgcccacaccuacgacaccgugacccugcccaucagcugcuucuucacccccaaggagagcgagcagcugaaggugaucaagaccuucgagggcauccugaccaagaccggcugcaccgagaacgcccugcagggcuacuacgugugcuuccugggcagccacagcgagccccugaucgugcccagccuggaggacaucagaagcgccgagguggugagcagaaugcuggugcaccccagaggcgaggaccacgacgccauccagaacagccagagccaccugagaaucgugggccccaucaccgccaaggugcccagcaccagcagcaccgacacccugaagggcaccgccuucgccggcgugcccauguacagcagccugagcacccuggugaagaacgccgaccccgaguucguguucagccccggcaucauccccgagagcaaccacagcgugugcgacaagaagaccgugcccaucaccuggaccggcuaccugcccaucagcggcgagauggagaaggugaccggcugcaccguguucugcacccuggccggccccggcgccagcugcgaggccuacagcgagaacggcaucuucaacaucagcagccccaccugccuggugaacaaggugcagagauucagaggcagcgagcagaagaucaacuucaucugccagagaguggaccaggacguggugguguacugcaacggccagaagaaggugauccugaccaagacccuggugaucggccagugcaucuacaccuucaccagccuguucagccugaugcccgacguggcccacagccuggccguggagcugugcgugcccggccugcacggcugggccaccgugaugcugcugagcaccuucugcuucggcugggugcugauccccgccgugacccugaucauccugaagugccugagagugcugaccuucagcugcagccacuacaccaacgagagcaaguucaaguucauccuggagaaggugaagguggaguaccagaagaccaugggcagcauggugugcgacgugugccaccacgagugcgagaccgccaaggagcuggagagccacagacagagcugcaucaacggccagugccccuacugcaugaccaucaccgaggccaccgagagcgcccugcaggcccacuacagcaucugcaagcugaccggcagauuccaggaggcccugaagaagagccugaagaagcccgaggugaagaagggcugcuacagaacccugggcguguucagauacaagagcagaugcuacgugggccugguguggugccugcugcugaccugcgagaucgugaucugggccgccagcgccgagaccccccugauggagagcggcuggagcgacaccgcccacggcgugggcgagauccccaugaagaccgaccuggagcuggacuucagccugcccagcagcagcagcuacagcuacagaagaaagcugaccaaccccgccaacaaggaggagagcaucagcuuccacuuccagauggagaagcaggugauccacgccgagauccagccccugggccacuggauggacgccaccuucaacaccaagaccgccuuccacugcuacggcgccugccagaaguacagcuaccccuggcagaccagcaagugcuucuucgagaaggacuaccaguacgagaccggcuggggcugcaaccccggcgacugccccggcgugggcaccggcugcaccgccugcggcguguaccuggacaagcugaagagcgugggcaaggccuacaagaucaucagccugaaguacaccagaaaggugugcauccagcugggcaccgagcagaccugcaagcacaucgacgccaacgacugccuggugacccccagcgugaaggugugcaucgugggcaccgugagcaagcugcagcccagcgacacccugcuguuccugggcccccuggagcagggcggcgugauccugaagcaguggugcaccaccagcugcgccuucggcgaccccggcgacaucaugagcacccccagcggcaugagaugccccgagcacaccggcagcuucagaaagaucugcggcuucgccaccacccccgugugcgaguaccagggcaacaccaucagcggcuacaagagaaugauggccaccaaggacagcuuccagagcuucaaccugaccgagccccacaucaccgccaacaagcuggaguggaucgaccccgacggcaacaccagagaccacgugaaccuggugcugaacagagacgugagcuuccaggaccugagcgacaaccccugcaagguggaccugcacacccaggccaucgagggcgccuggggcagcggcgugggcuucacccugaccugcaccgugggccugaccgagugccccagcuucaugaccagcaucaaggccugcgaccuggccaugugcuacggcagcaccguggccaaccuggccagaggcagcaacaccgugaagguggugggcaagggcggccacagcggcagcagcuucaagugcugccacgacaccgacugcagcagcgagggccugcuggccagcgccccccaccuggagagagugaccggcuucaaccagaucgacagcgacaagguguacgacgacggcgccccccccugcaccuucaagugcugguucaccaagagcggcgaguggcugcugggcauccugaacggcaacuggaucguggugguggugcugguggugauccugauccugagcaucaucauguucagcgugcugugccccagaagaggccacaagaagaccguguga

SEQ ID NO: 8367 - RNA, 3417 nt, Artificial Sequence
  derived and/or modified CDS sequence (opt4) from Hu39694(Hu39694)__AF028023.1__GP
auggagggcugguaccugaucgugcugggcgugugcagcacccugacccuggccaugcccagaaccaucuacgagcugagaauggagugcccccacaccgugggccugggccagggcuacaucaucggcagcaccgagcugggccugauccccaucgagaccgugagcgaccugaagcuggagagcagcugcaacuucgaccugcacaccaccagcaugacccagaagagcuacacccagguggaguggagaaagaagagcgacaccaccgacaccaccaacgccgccagcaccaccuucgaggcccagaccaagaccgugaaccugagaggcaccugcgugcuggccagcgagcuguacgacacccugaagaagaucaagaagaccgugcugugcuacgaccugaccugcaaccagacccacugccagcccaccguguaccugaucgcccccgugagcaccugcaugagcaucagaagcugcauggccagcguguucaccaacagaauccaggugaucuacgagaagacccacugcgugaccggccagcugguggagggccagugcuucaaccccgcccacacccugacccugagccagcccgcccacaccuacgagauggugacccugcccgugaccugcuucuucacccccaagaagagcgaccagcugaagcugaucaagaccuucgagggcaucaucagcaagaccggcugcaccgagaacgcccugcagggcuacuacgugugcuuccugggcagccacagcgagccccugcacgugcccagccuggaggacaucagaagcguggagguguucagcagaaugaucauccaccccagaggcgaggaccacgaccccauccagaacagccagggcuuccugagaaucgugggccccaucaccgccaaggugcccagcaccagcagcaccgacacccugaagggcaccgccuucgccggcgugcccauguacagcagccugagcacccuggugagaaccaccgaccccgaguacguguucagccccggcaucauccccgagagcaaccacagcaccugcgacaagaagaccaucccccugaccuggaccggcuaccugcccaucgccggcgagauggagaaggugaccggcugcaccguguucugcacccuggccggccccggcgccagcugcgaggccuacagcgagcacggcaucuucaacaucagcagccccaccugccuggugcacaaggugcagaaguucagaggcagcgagcagaagaucaacuucaucugccagagaguggaccaggacguggugguguacugcaacggccagaagaaggugauccugaccaaggaccuggugaucggccagugcaucuacaccuucaccagccuguucagccugaugcccgacguggcccacagccuggccguggagcugugcgugcccggccugcacggcugggccaccgugaugcugcugagcaccuucugcuucggcuggauccugauccccgccaucacccugguggugcugaaguuccugaagauggccaccuucagcugcagccacuacaccaacgagagcaaguucaaguucauccuggagaaggugaagguggaguaccagaagaccaugggcagcauggugugcgacaucugccaccacgagugcgagaccgccaaggagcuggagagccacaagcagagcugcaucaacggccagugccccuacugcaugaccaugaccgaggccaccgagagcgcccugcaggcccacuacagcaucugcaagcugaccggcagauuccaggaggcccugaagaagagccugaagagacccgaggugaagaagggcugcuacagaacccugggcguguucagauacaagagcagaugcuacgugggccugguguggugcgugcugcugaccugcgagcugaucgugugggccgccagcgccgagaccccccugcuggagagcggcuggagcgacaccgcccacggcgugggcgaggugcccaugaagaccgaccuggagcuggacuucagccugcccagcagcagcagcuacagcuacagaagaaagcugaccaaccccgccaacaaggaggagagcauccccuuccacuuccagauggagaagcaggugauccacgccgagauccagacccugggccacuggauggacgccaccuucaacaucaagaccgccuuccacugcuacggcgccugccagaaguacagcuaccccuggcagaccgccaagugcuucuucgagaaggacuaccaguacgagaccggcuggggcugcaaccccggcgacugccccggcuucggcaccggcugcaccgccugcggcguguaccuggacaagcugaagagcgugggcaaggccuacaagaucaucagccugaaguacaccagaaaggugugcauccagcugggcaccgagcagaccugcaagcacaucgacgccaacgacugccuggugacccccagcgugaaggugugcaucaucggcaccgugagcaagcugcagcccagcgacacccugcuguuccugggcccccuggagcagggcggcauccugcugaagcaguggugcaccaccagcugcgccuucggcgaccccggcgacaucaugagcaccaccagcggcaugagaugccccgagcacaccggcagcuucagaaagaucugcggcuucgccaccacccccgugugcgaguaccagggcaacaccaucagcggcuacaagagaaugauggccaccaaggacagcuuccagagcuucaaccugaccgacccccacaucaccaccaacaagcuggaguggaucgaccccgacggcaacaccagagaccacgugaaccuggugcugaacagagacgugagcuuccaggaccugagcgacaaccccugcaagguggaccugcacacccaggccaucgagggcgccuggggcagcggcgugggcuucacccugaccugcaccgugggccugaccgagugccccagcuucaucaccagcaucaaggccugcgacauggccaugugcuacggcagcaccgugagcaaccuggccagaggcagcaacaccgugaagguggugggcaagggcggccacagcggccugcacagcagaugcugccacgacaccgacugcagcagcgagggccugguggccagcgccccccaccuggagagagugaccggcuucaaccagaucgacagcgacaagguguacgacgacggcgccccccccugcaccuucaagugcugguucaccaagagcggcgaguggcugcugggcauccugaacggcaacuggaucguggugguggugcuggugguggugcugaucuucagcaucauccuguucaacauccugugccccagaagaggccacaagaagaccguguga

SEQ ID NO: 8368 - RNA, 3417 nt, Artificial Sequence
  derived and/or modified CDS sequence (opt4) from LECV(Of22819)__AF028022.1__GP
auggagggcugguaccugaucgugcugggcgugugcagcacccugacccuggccaugcccaagaccaucuacgagcugaagauggagugcccccacaccgugggccugggccagggcaucaucgugggcagcaccgagcugggccugauccccaucgagaccgccagcgaccugaagcuggagagcagcugcaacuucgaccugcacaccaccagcaugacccagaagagcuacacccagguggaguggagaaagaagagcgacaccaccgacaccaccaacgccgccgccaccaccuucgagagccaggccaagaccgugaaccugagaggcaccugcgugcuggccgccgagcuguacgacacccugaagaaggugaagaagaccgugcugugcuacgaccugaccugcaaccagacccacugccagcccaccguguaccugaucgcccccgugaucaccugcaugagcaucagaagcugcauggccagcguguucaucagcagaauccagaucaucuacgagaagacccacugcgugaccggccagcugaucgagggccagugcuucaaccccgcccacacccugacccuggcccagcccgcccacaccuacgagaccgugacccugcccgugaccugcuucuucacccccaagaagagcgaccagcugaagcugaucaagaccuucgagggcaucaucagcaagaccggcugcaccgagaacgcccugcagggcuacuacgugugcuuccugggcagccacagcgagccccugcacgugcccagccugaaggacaucagaagcgccgagguggugaccagaaugaucgugcaccccagaggcgaggaccacgaccccauccagaacagccagggcuaccugagaaucgugggcccccugaccgccaaggugcccagcaccagcagcagcgacacccugcagggcaccgccuucgccggcgugcccauguacagcagccugagcacccuggugagaaacaccgaccccgaguucguguucagccccggcaucauccccgagagcaaccacagcgccugcgacaagaagaccaucccccugaccuggaccggcuaccugcccaucagcggcgagauggagaaggugaccggcugcaccguguucugcacccuggccggccccggcgccagcugcgaggccuacagcgagagcggcaucuucaacaucagcagccccaccugccuggugaacaaggugcagaaguucagaggcagcgagcagaagaucaacuucaucugccagagaguggaccaggacguggugguguacugcaacggccagaagaaggugauccugaccaagacccuggugaucggccagugcaucuacaccuucaccagccuguucagccugaugcccgacguggcccacagccuggccguggagcugugcgugcccggccugcacggcugggccaccgugaugcugcugagcaccuucugcuucggcuggauccugauccccgccaucacccugguggugcugaaggugcugaagguggccaccuucagcugcagccacuacaccaacgagagcaaguucaaguucauccuggagaaggugaagguggaguaccagaagaccaugggcagcauggugugcgacaucugccaccacgagugcgagaccgccaaggagcuggagagccacaagcagagcugcaucaacggccagugccccuacugcaugaccaugaccgaggccaccgagagcgcccugcaggcccacuucgccaucugcaagcugaccggcagauuccaggaggcccugaagaagagccugaagaagcccgaggugagaaagggcugcuacagaacccugggcguguucagauacaagagcagaugcuacgugggccugguguggugcgugcugcugaccugcgagcugaucgugugggccgccagcgccgagaccccccugcuggagagcggcuggagcgacaccgcccacggcgugggcgaggugcccaugaagaccgaccuggagcuggacuucagccugcccagcagcagcagcuacagcuacagaagaaagcugaccaaccccgccaacaaggaggagagcauccccuuccacuuccagauggagaagcaggugauccacgccgagauccagaaccugggccacuggauggacgccaccuucaacaucaagaccgccuuccacugcuacggcgccugccagaaguacagcuaccccuggcagaccgccaagugcuucuucgagaaggacuaccaguacgagaccggcuggggcugcaaccccggcgacugccccggcgugggcaccggcugcaccgccugcggcguguaccuggacaagcugaagagcgugggcaaggccuacaagaucaucagccugaaguacaccagaaaggugugcauccagcugggcaccgagcagaccugcaagcacaucgacgccaacgacugccuggugacccccagcgugaaggugugcaucgugggcaccgugagcaagcugcagcccagcgacacccugcuguuccugggcccccuggagcagggcggcaucauccugaagcaguggugcaccaccagcugcgccuucggcgaccccggcgacaucaugagcaccaccagcggcaugagaugccccgagcacaccggcagcuucagaaagaucugcggcuucgccaccacccccgugugcgaguaccagggcaacaccaucagcggcuacaagagaaugauggccaccaaggacagcuuccagagcuucaaccugaccgacccccacaucaccaccaacaagcuggaguggaucgaccccgacggcaacaccagagaccacgugaaccuggugcugaacagagacgugagcuuccaggaccugagcgacaaccccugcaagguggaccugcacacccaggccaucgagggcgccuggggcagcggcgugggcuucacccugaccugcaccgugggccugaccgagugccccagcuucaugaccagcaucaaggccugcgaccuggccaugugcuacggcagcaccgugcacaaccuggccagaggcagcaacaccgugaagguggugggcaagggcggccacagcggcagcagcuucaagugcugccacgacaccgacugcagcagcgagggccugguggccagcgccccccaccuggagagagugaccggcuucaaccagaucgacagcgacaagguguacgacgacggcgccccccccugcaccuucaagugcugguucaccaagagcggcgaguggcugcugggcauccugaacggcaacuggaucguggugguggugcuggugguggugcugaucuucagcaucauccuguucagcauccugugccccagaagaggccacaagaagaccguguga

SEQ ID NO: 8369 - RNA, 3417 nt, Artificial Sequence
  derived and/or modified CDS sequence (opt4) from ORNV(Ol22996)__AF028024.1__GP
auggagggcugguaccugaucgugcugggcgugugcagcaccgugacccuggccaugcccaagaccaucuacgagcugaagauggagugcccccacaccgugggccugggccagggcuacaucaucggcagcaccgagcugaaccugauccccaucggcgccgccagcgaccugaagcuggagagcagcugcgacuucgaccuguacaccacccccaugacccagaagagcuacacccagguggaguggagaaagaagagcgagaccaccgacaccaccaacgccgccgccaccaccuucgagagccagaccaagaccgugaaccugagaggcaccugcauccuggccagcgagcuguacgacacccugaacaagaucaagaagcccgugcugugcuacgaccugaacugcaaccagaccagaugccagcccaccguguaccugaucgcccccgugaucaccugcaugagcaucagaagcugcauggccagcgugagcaacagcagaauccagaucaucuacgagaagacccacugcgugaccggccagcugguggagggccagugcuucaaccccagccacacccugacccuggcccagcccgcccacaccuacgagaccgugacccugcccgugaccugcuucuucacccccaagaagagcgaccagcugaagcuggugaagaccuucgagggcaucaucaccaagaccggcugcaccgagaacgcccugcagggcuacuacgugugcuuccugggcagccacagcgagccccugcacgugcccagccuggaggacaucagaagcgccgagguggugagcagaaugaucgugcaccccagaggcgaggaccacgaccccauccagaacagccagggccaccugagaaucgugggccccaucaccgccaaggugcccagcaccagcagcagcgacacccugcagggcaccgccuucagcggcgugcccauguacagcagccugagcacccuggugagaagcgccgaccccgaguucguguucagccccggcauccugcccgagagcaaccacagcgugugcgacaagaagacccugccccugaccuggaccggcuaccugcccaucagcggcgagauggagaaggugaccggcugcaccguguucugcacccuggccggccccggcgccagcugcgaggccuacagcgagaacggcaucuucaacaucagcagccccaccugccuggugaacaaggugcagaaguucagaggcagcgagcagaagaucaacuucaucugccagagaauggaccaggacguggugguguacugcaacggccagaagaaggugauccugaccaagacccuggugaucggccagugcaucuacaccuucaccagccuguucagccugaugcccgacguggcccacagccuggccguggagcugugcgugcccggccugcacggcugggccaccgugaugcugcugagcaccuucugcuucggcuggauccugauccccgccaucacccugguggugcugaaguuccugaagauggccaccuucagcugcagccacuacaccaacgagagcaaguucaagcugauccuggagaaggugaagguggaguaccagaagaccaugggcagcauggugugcgacaucugccaccacgagugcgagaccgccaaggugcuggagagccacaagcagagcugcaucaacggccagugccccuacugcaugaccaugaccgaggccaccgagagcgcccugcaggcccacuacagcaucugcaagcugaccggcagauuccaggaggcccugaagaagagccugaagaagcccgaggugaagagaggcugcuacagaacccugggcguguucagauacaagagcagaugcuacgugggccugguguggugcgugcugcugaccugcgagcugaucgugugggccgccagcgccgagaccccccugcuggagagcggcuggagcgacaccgcccacggcgugggcgagauccccaugaagaccgaccuggagcuggacuucagccugcccagcagcagcagcuacagcuacagaagaaagcugaccaaccccgccaacaaggaggagagcauccccuuccacuuccagauggagaagcaggugauccacgccgagauccagacccugggccacuggauggacgccaccuucaacaucaagaccgccuuccacugcuacggcgccugccagaaguacagcuaccccuggcagaccgccaagugcuucuucgagaaggacuaccaguacgagaccggcuggggcugcaaccccggcgacugccccggcgugggcaccggcugcaccgccugcggcguguaccuggacaagcugaagagcgugggcaaggccuacaagaucaucagccugaaguacaccagaaaggugugcauccagcugggcaccgagcagaccugcaagcacaucgacgccaacgacugccuggugacccccagcgugaaggugugcaucgugggcaccgugagcaagcugcagcccagcgacacccugcuguuccugggcccccuggagcagggcggcaucauccugaagcagugguggaccaccagcugcgccuucggcgaccccggcgacaucaugagcaccaccagcggcaugagaugccccgagcacaccggcagcuucagaaagaucugcggcuucgccaccacccccgugugcgaguaccagggcaacaccaucagcggcuacaagagaaugauggccaccaaggacagcuuccagagcuucaaccugaccgacccccacaucaccaccaacaagcuggaguggaucgaccccgacggcaacaccagagaccacgugaaccuggugcugaacagagacgugagcuuccaggaccugagcgacaaccccugcaagguggaccugcacacccaggccaucgagggcgccuggggcagcggcgugggcuucacccugaccugcaccgugggccugaccgagugccccagcuucaugaccagcaucaaggccugcgaccuggccaugugcuacggcagcaccgugaccaaccuggccagaggcagcaacaccgugaagguggugggcaagggcggccacagcggcagcagcuucaagugcugccacgacaccgacugcagcagcgagggccugguggccagcgccccccaccuggagagagugaccggcuucaaccagaucgacagcgacaagguguacgacgacggcgccccccccugcaccuucagaugcugguucaccaagagcggcgaguggcugcugggcauccugaacggcaacuggaucguggugguggugcugaucguggugcugaucuucagcaucgugcuguucagcauccugugccccagaagaggccacaagaaggccguguga

SEQ ID NO: 8370 - RNA, 3426 nt, Artificial Sequence
  derived and/or modified CDS sequence (opt4) from BCCV__L39950.1__GP
augggcagacuguaccugaucgugcugggcgugcugaucaccgccaccgccggcuuccccagaagcgugcacgagcugaagaucgagugcccccacaccguggugcugggccagggcuacgugaccggcagcguggagcugggcuucaucgcccuggaccaggugaccgaccugaagaucgagagcagcugcagcuucgaccaccacgccgcccccaccaccacccagaacuucacccagcugaagugggccaagaccgccagcaccaccgacaccaccaacgccgccgagaccaccuucgagagcaagagcaccgaggugcaccugaagggcgugugcaccauccccagcaacgugcuggacggccccagcagacccgugaccggcagaaagaccguggugugcuacgaccuggccugcaaccagacccacugccagcccaccgugcaccugcuggcccccauccagaccugcaugagcgugagaagcugcaugaucagccugcuggccagcagaauccaggugguguacgagaagaccuacugcgugaccggccagcugaucgagggccugugcuucaaccccgugcccaaccuggcccugacccagcccggccacaccuacgacaccuucacccugcccaucaccugcuuccugguggccaagaagggcgccaaccugaagaucgccguggagcuggagaagcugaccaccaagaccggcugcgccgagaacgcccugcaggccuacuacaucugcuucaucggccagcacagcgagccccugaccgugcccaugcuggaggacuacagaagcgccgagaucuucaccagaaucaugaugaaccccaagggcgaggaccacgacauggagcagagcagccagggcgcccugagaaucgugggccccaucaagggcaaggugccccccaccgagaccagcgacaccgugcagggcaucgccuucgccggccugcccauguacagcagcuucagcagccuggugagaaaggccgagcccgaguaccuguucagccccggcaucaucgccgagagcaaccacagcagcugcgacaagaagacccugccccugaccuggagaggcuuccugagcaugagcggcgagaucgagagaaucaccggcugcaacguguucugcacccuggccggccccggcgccagcugcgaggccuacagcgagaacggcaucuucaacaucagcagccccaccugccuggugaacaaggugcagaaguucagaggcagcgagcagagaaucaacuucaucagccagagaaucgaccaggacgugaucguguacugcaacggccagaagaaggugauccugaccaagacccuggugaucggccagugcaucuacaccuucaccagcaucuucagccugauccccagcguggcccacagccuggccguggagcugugcgugcccggcauccacggcugggccaccaucgcccuggugaucaccuucugcuucggcuggcugcugauccccaccaccaccaugguggugcugaagugccugagacugcugaccuacagcugcagccacuacagcaccgagagcaaguucaaggugauccuggagaaggugaagguggaguaccagaagaccaugggcagcauggugugcgacaucugccaccacgagugcgagaccgccaaggagcuggagagccacaagaagagcugcgccgacggccagugccccuacugcaugaccaucaccgaggccaccgagagcgcccugcaggcccacuacgccgugugcaagcugaccggcagauuccacgaggcccugaagaagagccugaagaagcccgaggugcagagaggcugcuacagaacccugggcguguucagauacaagagcagaugcuacgugggccugguguggaugugccugcugacccuggagcugaucgugugggccgccagcgccgacaccccccugcuggagcccggcuggagcgacaccgcccacggcgugggcgacauccccaugaagaccgaccuggagcuggacuucgccauccccagcagcagcagcuacagcuacagaagaagacuggugaaccccgccaacagcgacgagaccgugcccuuccacuuccagcuggagagacaggugauccacgccgagauccagagccugggccacuggauggacgccaccuucaacaucaucagcgccuuccacugcuacggcgagugcaagaaguacagcuaccccuggcagaccgccaagugcuucuucgagaaggacuaccaguacgagaccagcuggagcugcaacccccccgacugccccggcgugggcaccggcugcaccgccugcggcaucuaccuggacaagcugaagagcgugggcaaggccuacaaggugaucacccugaaguacgccagaaaggugugcauccagcugggcaccgagcagaccugcaagaacaucgacgugaacgacugccuggugaccagcagcaucaaggugugcaugaucggcaccaucagcaaguuccagcccggcgacacccugcuguuccugggcccccuggaggagggcggccuggugcugaagcaguggugcaccaccaccugcagcuucggcgaccccggcgacaucaugagcaccaccagcggcaugagaugccccgagcacaccggcagcuucagaaagaucugcggcuucgccaccacccccgugugcgaguaccagggcaacaccgugagcggcuucaagagacugauggccaccaaggacagcuuccagagcuucaacgugagcgaggugcacaucaccaccaccaagcuggaguggagcgaccccgacagcaacaucaaggaccacaucaaccugauccugaacagagacgugagcuuccaggaccugagcgacaaccccugcaagguggaccugagcacccaggccaucgacggcgccuggggcagcggcgugggcuucacccugaccugcaucgugggccugaccgagugcagcagcuucaugaccagcaucaaggugugcgacauggccaugugcuacggcgccagcguggugaaccuggugagaggcagcaacaccgugaagaucgugggcaagggcggccacagcggcagcaccuucagaugcugccacgacaaggacugcaccagcaacggccugcuggccagcgccccccaccuggagagagugaccggcuucaaccagaucgacagcgacaagguguacgacgacggcgccccccccugcagcaucaagugcugguucgccaagagcggcgaguggcugcugggcauccugaacggcaacuggguggugguggccgugcuggugaucauccugcugaucagcaucuuccuguucagcuucuucugccccaucagaagccacaagaagcagcuguga

SEQ ID NO: 8371 - RNA, 3408 nt, Artificial Sequence
  derived and/or modified CDS sequence (opt4) from DOBV(DOBV/Ano-Poroia/Afl9/1999)__NC_005234.1__GP
augaucauguggggccugcugcugaccaugauccugaucgacuucggcgccagccugagaaacguguacgacaugaagaucgagugcccccacagcaucaacuucggcgagagcagcgugaccggcaagguggagcugcccccccugcugcugaccgacgccgaggcccuggugcccgagagcagcugcaacauggacaaccaccagagcaugagcaucauccagaaggugaccaaggugagcuggagaaagaaggccgacaaggcccaggccgccaaggacagcuucgagaccaccagcagcgaggugaaccugaagggcaccugcgcccugagccacagaaugguggaggagagcuacagaaacagaagaagcgugaucugcuacgaccugagcugcaacagcacccacugcaagcccaccaugcacaugaucgugcccgugcacagcugcaacaugaugaagagcugccuggugggccugggccccuacagaauccagaucguguacgagagaaccuacugcaccaccggcauccugaccgagggcaagugcuucgugcccgaccagagcaucgugaacgugaucaagaacggcguguucgacaucgccagcgugagcaucgugugcuucuucaucagagugaagggcaccaacuacaagaucauggccagcaucaagaccgccaccgccaacaacugcaacgacaccgacaacaaggugcagggcuacuaccugugcaucgugggcggcaacagcagccccguguacgcccccagcaccaccgacuucagaagcauggaggcccuggccagccugcugagagccccccacggcgaggaccacgaccugagcggcgaggagguggccaccuacagcaucgccggccagaucgagggcaagaucccccacaccgccaacgccgccaacaugcuguucaccgccuucagcggcauccccagcuacagcagccugagcguguucaucggcagccaggacggccccgugaucuacagccccggccuguuccccagacugaaccagagcagcugcgacaagaucgcccugccccugaucugggagggcuacaucgaccugcccggcuacuacgagaccgugcaccccugcaacguguucugcgugcugagcggccccggcgccagcugcgaggccuucagcgagggcggcaucuucaacaucaccagccccaccugccuggugagcaagcagaacagauucagagccgccgagcagcaggugaacuucgugugccagagaguggaccaggacaucgugaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccugagcaucacccuggccgugcugguggugcugaaguucuucgccgccauccugcacaacagcagccaggagaacagauucaagaucauccugagaaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcccaccgagagcgccuuccaggcccacuacaaggugugccaggccacccacagauucagagacgaccugaagaagaccaucaccccccagagcaccagccccggcugcuacagaacccugaaccuguucagauacaagagcagaugcuacaucuucaccgugugggugacccugcugaucaucgagagcaucaugugggccgccagcgccagcgagaccgugcuggagcccagcuggaacgacaacgcccacggcgugggcguggugcccaugcacaccgaccuggagcuggacuucagccugcccagcagcagcaaguacaccuacaagagaaagcugaccagcccccugaaccaggagcagagcguggaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccaagugccacuucgagagagacuucgaguacgagaacaacuggggcugcaaccccgccgacugccccggcaucggcaccggcugcaccgccugcggccuguacaucgaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggagggcggcggccugaucuucaaggacuggugcaccagcaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccagagcuucaacaccagcagcauccacuacaccgacgagagaaucgaguggaaggaccccgacggcaugcugaaggaccaccugaacauccuggugaccaaggacaucgacuucgagaaccugggcgagaaccccugcaaggugggccugcagaccagcagcaucgagggcgccuggggcagcggcgugggcuucacccugaccugccagaucagccugaccgagugcagcagauuccugaccagcaucaaggccugcgacauggccaucugcuacggcgcccagagcgugacccugaucagaggccagaacaccgugaaggugagcggcaagggcggccacagcggcagcagcuucaagugcugccacggcaccgacugcagccagcagggccugcaggccagcgccccccaccuggacaaggugaacggcaucguggagcaggagagcgagaagguguacgacgacggcgccccccagugcggcaucagcugcugguucgugaagagcggcgaguggaucaccggcaucuucaacggcaacuggaucgugaucguggugcugguguucuucuucauccugagccugauccugcugagccugcugugccccaucagaaagcacaagagaagcuga

SEQ ID NO: 8372 - RNA, 3408 nt, Artificial Sequence
  derived and/or modified CDS sequence (opt4) from DOBV(DOB/Saaremaa/160V)__AJ009774.2__GP
augaucauguggggccugcugcugaccaugagccugaucaaccugggcgccagccugagaaacguguacgacaugaagaucgagugcccccacagcaucaacuucggcgagagcagcgugaccggcaagguggagcugccccccauccugcugaccgacgccgaggcccuggugcccgagagcagcugcaacauggacaaccaccagagccugagcaucacccagaaggugaccaaggugagcuggagaaagaaggccgaccaggugcaggccgccaaggacagcuucgagaccaccagcaacgagaucaaccugaagggcaccugcacccugacccacagaaugguggaggagagcuacagaaacagaaagagcgugaucugcuacgaccugagcugcaacagcacccacugcaagcccaccaugcacaugaucgugcccgugcacagcugcaacaugaugaagagcugccuggugggccugggccccuacagagugcaggugguguacgagagaaccuacugcaccaccggcauccugaccgagggcaagugcuucgugcccgaccagagcaucaucagcgugaucaagaacggcguguucgacaucgccagcgugagcaucgugugcuucuucaucagagugaagggcaccagcuacaagaucauggccagcaucaagaccagcaaccccaacaacugcaacgacaccgacaacaaggugcagggcuacuaccugugcaucgugggcgccaacagcagccccguguacgcccccagcaccaccgacuucagaagcaccgaggcccuggccagccugcugagaagcccccacggcgaggaccacgaccugagcggcgaggagguggccaccuacagcaucgccggccagaucgagggcaagaucccccacaccgccaacgccgccaacauggccuucaccgccuucagcggcauccccagcuacagcagccugagcguguucgccggcaaccaggacggcaccaucaucuucagccccggccuguuccccaagcugaaccagagcagcugcgacaagguggcccugccccugaucugggagggcuacaucgaccugcccggcuacuacgagaccauccaccccugcaacguguucugcgugcugagcggccccggcgccagcugcgaggccuucagcgagggcggcaucuucaacaucaccagccccaccugccuggugagcaagcagaacagauucagagccgccgagcagcagaucaacuucgugugccagagaguggaccaggacaucgugaucuacugcaacggccagaagaagaccauccugaccaagacccuggugaucggccagugcaucuacagcgugaccagccuguucagcaucaugcccagcguggcccacagcaucgccaucgagcugugcgugcccggcuuccacggcugggccaccgccgcccugcugaccaccuucugcuucggcuggauccugauccccagcaucacccuggccgugcugaucgugcugaaguucuucgccgccauccugcacaacagcagccaggagaacagauucaagaucauccugagaaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcugaccgagagcgccuuccaggcccacuacagagugugccaggccacccacagauucagagacgaccugaagaagaccaucaccccccagagcaccagccccggcugcuacagaacccugaaccuguucagauacaagagcagaugcuacaucuucaccguguggguggugcugcugaucaucgagagcauccugugggccgccagcgccagcgagcuggugcuggagcccaacuggaacgacaacgcccacggcgugggcaucgugcccaugcacaccgaccuggagcuggacuucagccugcccagcagcagcaaguacaccuacaagagaaagcugaccagccccaucaaccaggagcagagcaucgaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccaagugccacuucgagagagacuucgaguacgagaacaacuggagcugcaacccccccgacugccccggcaucggcaccggcugcaccgccugcggccuguaccuggaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggagggcggcggccugaucuucaaggacuggugcaccaccaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccaggccuucaacaccagcuacauccacuacaccgacgagcagaucgaguggaaggaccccgacggcaugcugaaggaccaccugaacauccuggugaccaaggacaucgacuucgagaaccugggcgagaaccccugcagagugggccugcagaccgccagcaucgagggcgccuggggcagcggcgugggcuucacccugaccugccagaucagccugaccgagugcagcagauuccugaccagcaucaaggccugcgacauggccaucugcuacggcgcccagagcgugacccuggugagaggccagaacaccgugaaggugagcggcaagggcggccacagcggcagcagcuucaagugcugccacggcaacgacugcagccagcagggccugcaggccagcgccccccaccuggacaaggugaacggcaucguggagcaggagagcacccagguguacgacgacggcgccccccagugcggcaucagcugcugguucaucaagagcggcgaguggaucaagggcaucuucagcggcaacuggaucgugaucguggugcugaucgugcuguucauccugagccugauccugcugagcuuccugugccccaucagaaagcacaagagaagcuga

SEQ ID NO: 8373 - RNA, 3408 nt, Artificial Sequence
  derived and/or modified CDS sequence (opt4) from DOBV(East Slovakia/400Af/98)__AY168577.1__GP
augaucauguggggccugcugcugaccaugauccugaucgacuucggcaccagccugagaaacguguacgacaugaagaucgagugcccccacagcaucaacuucggcgagagcagcgugaccggcaagguggagcugcccccccugcugcugaccgacgccgaggcccuggugcccgagagcagcugcaacauggacaaccaccagagcaugagcaucauccagaaggugaccaaggugagcuggagaaagaaggccgacaaggcccaggccgccaaggacagcuucgagaccaccagcagcgaggugaaccugaagggcaccugcacccugagccacagaaugguggaggagagcuacagaaacagaagaagcgugaucugcuacgaccugagcugcaacagcacccacugcaagcccaccaugcacaugaucgugcccgugcacagcugcaacaugaugaagagcugccuggugggccugggccccuacagaauccaggugguguacgagagaaccuacugcaccaccggcauccugaccgagggcaagugcuucgugcccgaccagagcaucgugaacgugaucaagaacggcguguucgacaucgccagcgugagcaucgugugcuucuucaucagagugaagggcaccaacuacaagaucauggccagcaucaagaccgccaccgccaacaacugcaacgacaccgacaacaaggugcagggcuacuaccugugcaucgugggcggcaacagcagccccguguacgcccccagcaccaccgacuucagaagcauggaggcccuggccagccugcugagagccccccacggcgaggaccacgaccugagcggcgaggagguggccaccuacagcaucgccggccagaucgagggcaagaucccccacaccgccaacgccgccaacaugcuguucaccgccuucagcggcauccccagcuacagcagccugagcguguacaucggcagccaggacggccccgugguguacagccccggccuguuccccaagcugaaccagagcagcugcgacaagguggcccugccccugaucugggagggcuacaucgaccugcccggcuacuacgagaccgugcaccccugcaacguguucugcgugcugagcggccccggcgccagcugcgaggccuucagcgagggcggcaucuucaacaucaccagccccaccugccuggugagcaagcagaacagauucagagccgccgagcagcaggugaacuucgugugccagagaguggaccaggacaucgugaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccccagcaucacccuggccgugcugguggugcugaaguucuucgccgccauccugcacaacagcagccaggagaacagauucaagaucauccugagaaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcccaccgagagcgccuuccaggcccacuacaaggugugccaggccacccacagauucagagacgaccugaagaagaccaucaccccccagagcaccagccccggcugcuacagaacccugaaccuguucagauacaagagcagaugcuacaucuucaccgugugggugacccugcugaucaucgagagcaucaugugggccgccagcgccagcgagaacgugcuggagcccagcuggaacgacaacgcccacggcgugggcguggugcccaugcacaccgaccuggagcuggacuucagccugcccagcagcagcaaguacaccuacaagagaaagcugaccagcccccugaaccaggagcagagcguggaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccaagugccacuucgagagagacuucgaguacgagaacagcuggggcugcaaccccgccgacugccccggcaucggcaccggcugcaccgccugcggccuguacaucgaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggagggcggcggccugaucuucaaggacuggugcaccagcaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccagagcuucaacaccagcagcauccacuacaccgacgagagaaucgaguggaaggaccccgacggcaugcugaaggaccaccugaacauccuggugaccaaggacaucgacuucgagaaccugggcgagaaccccugcaaggugggccugcagaccagcagcaucgagggcgccuggggcagcggcgugggcuucacccugaccugccagaucagccugaccgagugcagcagauuccugaccagcaucaaggccugcgacauggccaucugcuacggcgcccagagcgugacccugaucagaggccagaacaccgugaaggugagcggcaagggcggccacagcggcagcagcuucaagugcugccacggcaccgacugcagccagcagggccugcaggccagcgccccccaccuggacaaggugaacggcaucguggagcaggagagcgagaagguguacgacgacggcgccccccagugcggcaucagcugcugguucgugaagagcggcgaguggaucaccggcaucuucaacggcaacuggaucgugaucguggugcugaucuucuucuucauccugagccugauccugcugagccugcugugccccaucagaaagcacaagagaagcuga

SEQ ID NO: 8374 - RNA, 3408 nt, Artificial Sequence
  derived and/or modified CDS sequence (opt4) from DOBV(East Slovakia/862Aa/97)__AY168578.1__GP
augaucauguggggccugcugcugaccaugagccugaucaaccugggcgccagccugagaaacguguacgaccugagaaucgagugcccccacagcaucaacuucggcgagagcagcgugaccggcaagguggagcugccccccaucccccugaccgacgccgagacccuggugcccgagagcagcugcaacauggacaaccaccagagccugagcaucacccagaaggugaccaaggugagcuggagaaagaaggccgacaaggugcaggccgccaaggacagcuucgagaccaccagcagcgagaucaaccugaagggcaccugcacccuggcccacagaaugguggaggagagcuacagaaacagaaagagcgugaucugcuacgaccugagcugcaacagcacccacugcaagcccaccauguacaugaucgugcccgugcacagcugcaacaugaugaagagcugccuggugggccugggccccuacagaauccaggugguguacgagagaaccuacugcaccaccggcauccugaucgagggcaagugcuucgugcccgaccagagcaucaucagcgugaucaagaacggcguguucgacaucgccagcgugagcaucgugugcuucuucaucagaaucaagggcaacagcuacaagaucaugaccaacaucaagaccgccaaccccaacaacugcaacgacaccgacaacaaggugcagggcuacuaccugugcaucgugggcgccaacagcagccccguguacgcccccagcaccaccgacuucagaagcauggaggugcuggccagccugcugagaagcccccacggcgaggaccacgaccugagcggcgaggagguggccaccuacagcaucgccggccagguggagggcaaggugccccacaccgagaacgccgccaacaugcuguucaccgccuucagcggcauccccagcuacagcagccugagcguguucgccggcaaccaggacggcaccgugaucuacagccccggccuguuccccaagcugaaccagagcagcugcgagaagguggcccugccccugaucugggagggcuacaucgaccugcccggcuacuacgagaccauccaccccugcaacguguucugcgugcugagcggccccggcgccagcugcgaggccuucagcgagggcggcaucuucaacaucaccagccccaccugccuggugagcaagcagaacagauucagagccgccgagcagcagaucaacuucgugugccagagaguggaccaggacaucgugaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccccagcaucacccuggccauccugaucgugcugaaguucuucgccgccauccugcacaacagcagccaggagaacagauucaaggugauccugagaaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcugaccgagagcgccuuccaggcccacuacagagugugccaggccacccacagauucagagacgaccugaagaagaccaucaccccccagagcaccagccccggcugcuacagaacccugaaccuguucagauacaagagcagaugcuacaucuucaccguguggguggugcugcugaucaucgagagcauccugugggccgccagcgccagcgagaucgugcuggagcccagcuggaacgacaacgcccacggcgugggcguggugcccaugcacaccgaccuggagcuggacuucagccugcccagcagcagcaaguacaccuacaagagaaagcugaccagccccaucaaccaggagcagagcguggaccugcacaucgagaucgagagccagagaaucagcaccagcgugcacgcccugggccacugguucgacggcagacugaaccugaagaccagcuuccacugcuacggcgccugcaccaaguacgaguaccccuggcacaccgccagaugccacuucgagagagacuucgaguacgagaacagcuggagcugcaaccccgccgacugccccggcaucggcaccggcugcaccgccugcggccuguaccuggaccagcugaagcccgugggcagcgccuacaagcugaucaccgugagauacagcagaaaggugugcgugcaguucggcgaggagaaccugugcaagaucaucgacaugaacgacugcuucgugagcagacacgugaaggugugcaucaucggcaccgugagcaaguucagccagggcgacacccugguguuccugggccccauggagggcggcggccugaucuucaaggacuggugcaccaccaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccaggccuucaacaccagcuacauccacuacaccgacgagagaaucgaguggaaggaccccgacggcaugcugaaggaccacaucaacauccuggugaccaaggacaucgacuucgagaaccugggcgagaaccccugcaaggugggccugcagaccgccagcaucgagggcgccuggggcagcggcgugggcuucacccugaccugccagaucagccugaccgagugcagcagauuccugaccagcaucaaggccugcgacauggccaucugcuacggcgcccagagcgugacccuggugagaggccagaacaccgugaaggugagcggcaagggcggccacagcggcagcagcuucaagugcugccacggcaccgacugcagccagcagggccugcaggccagcgccccccaccuggacaaggugaacggcaucguggagcaggagagcacccagguguacgacgacggcgccccccagugcggcaucagcugcugguucaucaagagcggcgaguggaucaagggcaucuucaacggcaacuggaucgugaucguggugcugaucuucuucuucauccugagccugauccugcugagcuuccugugccccaucagaaagcacaagagaagcuga

SEQ ID NO: 8375 - RNA, 3408 nt, Artificial Sequence
  derived and/or modified CDS sequence (opt4) from DOBV(A35)__GU904036.1__GP
augaucauguggggccugcugcugacccugagccugaucagccugggcgccagccugagaaacguguacgaccugagaaucgagugcccccacagcaucaacuucggcgagagcagcgugaccggcaagguggagcugccccccaucccccugaccgacgccgagacccuggugcccgagagcagcugcaacauggacaaccaccagagccugagcaucacccagaaggugaccaaggugagcuggagaaagaaggccgacaaggugcaggccgccaaggacagcuucgagaccaccagcagcgagaucaaccugaagggcaccugcacccuggcccacagaaugguggaggagagcuacagaagcagaaagagcgugaucugcuacgaccugagcugcaacagcacccacugcaagcccaccauguacaugaucgugcccgugcacagcugcaacaugaugaagagcugccuggugggccugggccccuacagaauccaggugguguacgagagaaccuacugcaccaccggcauccugaucgagggcaagugcuucgugcccgaccagagcaucaucagcgugaucaagaacggcguguucgacaucgccagcgugagcaucgugugcuucuucaucagaaucaagggcaacagcuacaagaucaugaccaacaucaagaccgccaaccccaacaacugcaacgacaccgacaacaaggugcagggcuacuaccugugcaucgugggcgccaacagcagccccguguacgcccccagcaccaccgacuucagaagcauggaggugcuggccagccugcugagaagcccccacggcgaggaccacgaccugagcggcgaggagguggccaccuacagcaucgccggccagguggagggcaaggugccccacaccgagaacgccgccaacaugcuguucaccgccuucagcggcauccccagcuacagcagccugagcguguucgccggcaaccaggacggcaccgugaucuacagccccggccuguuccccaagcugaaccagagcagcugcgagaagguggcccugccccugaucugggagggcuacaucgaccugcccggcuacuacgagaccauccaccccugcaacguguucugcgugcugagcggccccggcgccagcugcgaggccuucagcgagggcggcaucuucaacaucaccagccccaccugccuggugagcaagcagaacagauucagagccgccgagcagcagaucaacuucgugugccagagaguggaccaggacaucgugaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccccagcaucacccuggccauccugaucgugcugaaguucuucgccgccauccugcacaacagcagccaggagaacagauucaaggugauccugagaaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcugaccgagagcgccuuccaggcccacuacagagugugccaggccacccacagauucagagacgaccugaagaagaccaucaccccccagagcaccagccccggcugcuacagaacccugaaccuguucagauacaagagcagaugcuacaucuucaccguguggguggugcugcugaucaucgagagcauccugugggccgccagcgccagcgagaucgugcuggagcccagcuggaacgacaacgcccacggcgugggcguggugcccaugcacaccgaccuggagcuggacuucagccugcccagcagcagcaaguacaccuacaagagaaagcugaccagccccaucaaccaggagcagagcguggaccugcacaucgagaucgagagccagagaaucagcaccagcgugcacgcccugggccacugguucgacggcagacugaaccugaagaccagcuuccacugcuacggcgccugcaccaaguacgaguaccccuggcacaccgccagaugccacuucgagagagacuucgaguacgagaacagcuggagcugcaaccccgccgacugccccggcaucggcaccggcugcaccgccugcggccuguaccuggaccagcugaagcccgugggcagcgccuacaagcugaucaccgugagauacagcagaaaggugugcgugcaguucggcgaggagaaccugugcaagaucaucgacaugaacgacugcuucgugagcagacacgugaaggugugcaucaucggcaccgugagcaaguucagccagggcgacacccugguguuccugggccccauggagggcggcggccugaucuucaaggacuggugcaccaccaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccaggccuucaacaccagcuacauccacuacaccgacgagagaaucgaguggaaggaccccgacggcaugcugaaggaccacaucaacauccuggugaccaaggacaucgacuucgagaaccugggcgagaaccccugcaaggugggccugcagaccgccagcaucgagggcgccuggggcagcggcgugggcuucacccugaccugccagaucagccugaccgagugcagcagauuccugaccagcaucaaggccugcgacauggccaucugcuacggcgcccagagcgugacccuggugagaggccagaacaccgugaaggugagcggcaagggcggccacagcggcagcagcuucaagugcugccacggcaccgacugcagccagcagggccugcaggccagcgccccccaccuggacaaggugaacggcaucguggagcaggagagcacccagguguacgacgacggcgccccccagugcggcaucagcugcugguucaucaagagcggcgaguggaucaagggcaucuucaacggcaacuggaucgugaucguggugcugaucuucuucuucauccugagccugauccugcugagcuuccugugccccaucagaaagcacaagagaagcuga

SEQ ID NO: 8376 - RNA, 3408 nt, Artificial Sequence
  derived and/or modified CDS sequence (opt4) from DOBV(A6)__GU904033.1__GP
augaucauguggggccugcugcugaccaugauccugaucgacuucggcgccagccugagaaacguguacgacaugaagaucgagugcccccacagcaucaacuucggcgagagcagcgugaccggcaagguggagcugcccccccugcugcugaccgacgccgaggcccuggugcccgagagcagcugcaacauggacaaccaccagagcaugagcaucauccagaaggugaccaaggugagcuggagaaagaaggccgacaaggcccaggccgccaaggacagcuucgagaccaccagcagcgaggugaaccugaagggcaccugcacccugagccacagaaugguggaggagagcuacagaaacagaagaagcgugaucugcuacgaccugagcugcaacagcacccacugcaagcccaccaugcacaugaucgugcccgugcacagcugcaacaugaugaagagcugccuggugggccugggccccuacagaauccagguggccuacgagagaaccuacugcaccaccggcauccugaccgagggcaagugcuucgugcccgaccagagcaucgugagcgugaucaagaacggcguguucgacaucgccagcgugagcaucgugugcuucuucaucagagugaagggcaccaacuacaagaucauggccagcaucaagaccgccaccgccaacaacugcaacgacaccgacaacaaggugcagggcuacuaccugugcaucgugggcggcaacagcagccccguguacgcccccagcaccaccgacuucagaagcauggaggcccuggccagccugcugagagccccccacggcgaggaccacgaccugagcggcgaggagguggccaccuacagcaucgccggccagaucgagggcaagaucccccacaccgccaacgccgccaacaugcuguucaccgccuucagcggcauccccagcuacagcagccugagcguguucaucggcagccaggacggccccaucaucuacagccccggccuguuccccaagcugaaccagagcagcugcgacaagguggcccugccccugaucugggagggcuacaucgaccugcccggcuacuacgagaccgugcaccccugcaacguguucugcgugcugagcggccccggcgccagcugcgaggccuucagcgagggcggcaucuucaacaucaccagccccaccugccuggugagcaagcagaacagauucagagccgccgagcagcaggugaacuucgugugccagagaguggaccaggacaucaucaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccccagcaucacccuggccgugcugguggugcugaaguucuucgccgccauccugcacaacagcagccaggagaacagauucaagaucauccugagaaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcccaccgagagcgccuuccaggcccacuacaaggugugccaggccacccacagauucagagacgaccugaagaagaccaucaccccccagagcaccagccccggcugcuacagaacccugaaccuguucagauacaagagcagaugcuacaucuucaccgugugggugacccugcugaucaucgagagcaucaugugggccgccagcgccagcgagaacgugcuggagcccagcuggaacgacaacgcccacggcgugggcguggugcccaugcacaccgaccuggagcuggacuucagccugcccagcagcagcaaguacaccuacaagagaaagcugaccagcccccugaaccaggagcagagcguggaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccaagugccacuucgagagagacuucgaguacgagaacagcuggggcugcaaccccgccgacugccccggcaucggcaccggcugcaccgccugcggccuguacaucgaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggugggcggcggccugaucuucaaggacuggugcaccagcaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccagagcuucaacaccagcagcauccacuacaccgacgagagaaucgaguggaaggaccccgacggcaugcugaaggaccaccugaacauccuggugaccaaggacaucgacuucgagaaccugggcgagaaccccugcaaggugggccugcagaccagcagcaucgagggcgccuggggcagcggcgugggcuucacccugaccugccagaucagccugaccgagugcagcagauuccugaccagcaucaaggccugcgacauggccaucugcuacggcgcccagagcgugacccugaucagaggccagaacaccgugaaggugagcggcaagggcggccacagcggcagcagcuucaagugcugccacggcaccgacugcagccagcagggccugcaggccagcgccccccaccuggacaaggugaacggcaucguggagcaggacagcgagaagguguacgacgacggcgccccccagugcggcaucagcugcugguucgugaagagcggcgaguggaucaccggcaucuucaacggcaacuggaucgugaucguggugcugguguucuucuucauccugagccugauccugcugagccugcugugccccaucagaaagcacaagagaagcuga

SEQ ID NO: 8377 - RNA, 3408 nt, Artificial Sequence
  derived and/or modified CDS sequence (opt4) from DOBV(B13)__GU904034.1__GP
augaucauguggggccugcugcugaccaugauccugaucgacuucggcgccagccugagaaacguguacgacaugaagaucgagugcccccacagcaucaacuucggcgagagcagcgugaccggcaagguggagcugcccccccugcugcugaccgacgccgaggcccuggugcccgagagcagcugcaacauggacaaccaccagagcaugagcaucauccagaaggugaccaaggugagcuggagaaagaaggccgacaaggcccaggccgccaaggacagcuucgagaccaccagcagcgaggugaaccugaagggcaccugcacccugagccacagaaugguggaggagagcuacagaaacagaagaagcgugaucugcuacgaccugagcugcaacagcacccacugcaagcccaccaugcacaugaucgugcccgugcacagcugcaacaugaugaagagcugccuggugggccugggccccuacagaauccaggugguguacgagagaaccuacugcaccaccggcauccugaccgagggcaagugcuucgugcccgaccagagcaucgugagcgugaucaagaacggcguguucgacaucgccagcgugagcaucgugugcuucuucaucagagugaagggcaccaacuacaagaucauggccagcaucaagaccgccaccgccaacaacugcaacgacaccgacaacaaggugcagggcuacuaccugugcaucgugggcggcaacagcagccccguguacgcccccagcaccaccgacuucagaagcauggaggcccuggccagccugcugagagccccccacggcgaggaccacgaccugagcggcgaggagguggccaccuacagcaucgccggccagaucgagggcaagaucccccacaccgccaacgccgccaacaugcuguucaccgccuucagcggcauccccagcuacagcagccugagcguguucaucggcagccaggacggccccaucaucuacagccccggccuguuccccaagcugaaccagagcagcugcgacaagguggcccugccccugaucugggagggcuacaucgaccugcccggcuacuacgagaccgugcaccccugcaacguguucugcgugcugagcggccccggcgccagcugcgaggccuucagcgagggcggcaucuucaacaucaccagccccaccugccuggugagcaagcagaacagauucagagccgccgagcagcaggugaacuucgugugccagagaguggaccaggacaucaucaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccccagcaucacccuggccgugcugguggugcugaaguucuucgccgccauccugcacaacagcagccaggagaacagauucaagaucauccugagaaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcccaccgagagcgccuuccaggcccacuacaaggugugccaggccacccacagauucagagacgaccugaagaagaccaucaccccccagagcaccagccccggcugcuacagaacccugaaccuguucagauacaagagcagaugcuacaucuucaccgugugggugacccugcugaucaucgagagcaucaugugggccgccagcgccagcgagaacgugcuggagcccagcuggaacgacaacgcccacggcgugggcguggugcccaugcacaccgaccuggagcuggacuucagccugcccagcagcagcaaguacaccuacaagagaaagcugaccagcccccugaaccaggagcagagcguggaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccaagugccacuucgagagagacuucgaguacgagaacagcuggggcugcaaccccgccgacugccccggcaucggcaccggcugcaccgccugcggccuguacaucgaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggugggcggcggccugaucuucaaggacuggugcaccagcaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccagagcuucaacaccagcagcauccacuacaccgacgagagaaucgaguggaaggaccccgacggcaugcugaaggaccaccugaacauccuggugaccaaggacaucgacuucgagaaccugggcgagaaccccugcaaggugggccugcagaccagcagcaucgagggcgccuggggcagcggcgugggcuucacccugaccugccagaucagccugaccgagugcagcagauuccugaccagcaucaaggccugcgacauggccaucugcuacggcgcccagagcgugacccugaucagaggccagaacaccgugaaggugagcggcaagggcggccacagcggcagcagcuucaagugcugccacggcaccgacugcagccagcagggccugcaggccagcgccccccaccuggacaaggugaacggcaucguggagcaggacagcgagaagguguacgacgacggcgccccccagugcggcaucagcugcugguucgugaagagcggcgaguggaucaccggcaucuucaacggcaacuggaucgugaucguggugcugguguucuucuucauccugagccugauccugcugagccugcugugccccaucagaaagcacaagagaagcuga

SEQ ID NO: 8378 - RNA, 3408 nt, Artificial Sequence
  derived and/or modified CDS sequence (opt4) from DOBV(Aa1854/Lipetsk-02)__EU188453.1__GP
augaucauguggggccugcugcugaccauggcccugaucaaccccggcgccacccugagaaacguguacgacaugagaaucgagugcccccacagcaucaacuucggcgagagcagcgugaccggcaagguggagcugccccccaucccccuggccgacgccgagacccuggugcccgagagcagcugcaacauggacaaccaccagagccugagcaucacccagaaggugaccaaggugagcuggagaaagaaggccgacaaggugcaggccgccaaggacagcuucgagaccaccagcagcgagaucaaccugaagggcaccugcacccugacccacagaaugguggaggagagcuacagaaacagaaagagcgugaucugcuacgaccugagcugcaacagcacccacugcaagcccaccaugcacaugaucgugcccgugcacagcugcaacaugaugaagagcugccuggugggccugggccccuacagaauccaggugguguacgagagaaccuacugcaccaccggcauccugaccgagggcaagugcuucgugcccgaccagagcaucgugagcgugaucaagaacggcguguucgacaucgccagcgugagcaucgugugcuucuucaucagaaucaagggcaacagcuacaagaucauggccagcaucaaggaggccaaccccaacaacugcaacgacaccgacaacaaggugcagggcuacuaccugugcaucgugggcgccaacagcagccccguguacgcccccagcaccaccgacuucagaagcguggaggcccuggccagccugcugagaagcccccacggcgaggaccacgaccugagcggcgaggagguggccaccuacagcaucgccggccagguggagggcaaggugccccacaccgccaacgccgccaacaugcuguucaccgccuucagcggcauccccagccacagcagcuucagcguguucaccggcaaccaggacggcaccgugaucuacagccccggccuguuccccaagcugaaccagagcgccugcgacaagguggcccugccccugaucugggagggcuacaucgaccugcccggcuacuacgagaccauccaccccugcaacguguucugcgugcugagcggccccggcgccagcugcgaggccuucagcgagggcggcaucuucaacaucaccagccccaccugccuggugagcaagcagaacagauucagagccgccgagcagcagaucaacuucgugugccagagaguggaccaggacaucgugaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccccagcaucacccuggccauccugaucgugcugaaguucuucgccgccauccugcacaacagcagccaggagaacagauucaagaucauccugagaaagaucaaggaggaguucgagagaaccaagggcagcauggugugcgaggugugcaaguacgagugcgagaccggcaaggagcugaaggcccacaaccugagcugcccccagagccagugccccuacugcuucacccacugcgagcugaccgagagcgccuuccaggcccacuacagagugugccaggccacccacagauucagagacgaccugaagaagaccaucaccccccagagcaccagccccggcugcuacagaacccugaaccuguucagauacaagagcagaugcuacaucuucaccguguggguggugcugcugaucaucgagagcauccugugggccgccagcgccagcgagaccgugcuggagcccaacuggaacgacaacgcccacggcgugggcguggugcccaugcacaccgaccuggagcuggacuucagccugcccagcagcagcaaguacaccuacaagagaaagcugaccagccccaucaaccaggagcagagcguggaccugcacaucgagguggagagccagggcaucagcaccagcgugcacgcccugggccacugguucgacggcagacugaaccugaagaccagcuuccacugcuacggcgccugcaccaaguacgaguaccccuggcacaccgccagaugccacuucgagagagacuucgaguacgagaacagcuggagcugcaaccccgccgacugccccggcaucggcaccggcugcaccgccugcggccuguaccuggaccagcugaagcccgugggcagcgccuacaagcugaucaccgugagauacagcagaagagugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggagggcggcggccugaucuucaaggacuggugcaccaccaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccaggccuucaacaccagcaacauccacuacaccgacgagagaaucgaguggaaggaccccgacggcaugcugaaggaccaccugaacauccuggugaccaaggacaucgacuucgagaaccugggcgagaaccccugcaaggugggccugcagaccgccagcaucgagggcgccuggggcagcggcgugggcuucacccugaccugccagaucagccugaccgagugcagcagauuccugaccagcaucaaggccugcgacauggccaucugcuacggcgcccagagcgugacccuggugagaggccagaacaccgugaaggugagcggcaagggcggccacagcggcagcagcuucaagugcugccacggcaccgacugcagccagcagggccugcaggccagcgccccccaccuggacaaggugaacggcaucguggagcaggagagcacccagguguacgacgacggcgccccccagugcggcaucagcugcugguucaucaagagcggcgaguggaucaagggcaucuucaacggcaacuggaucgugaucguggugcugaucuucuucuucauccugagccugauccugcugagcuuccugugccccaucagaaagcacaagagaagcuga

SEQ ID NO: 8379 - RNA, 3402 nt, Artificial Sequence
  derived and/or modified CDS sequence (opt4) from DOBV(Ap/Sochi/hu)__JF920149.1__GP
auguggggccugcugcugaccaugauccugaucgacuucggcgccacccugagaaacguguacgacaugagaaucgagugcccccacagcgugaacuucggcgagagcagcgugagcggcaagguggagcugccccccgugcugcugagcgagguggagacccuggugcccgagagcagcugcaacauggacaaccaccagagcaugagcaucauccagaaggugacccagcugaccuggagaaagaaggccgacaaggcccaggccgccaaggacagcuucgagaucaccagcggcgaggugagccugaagggcaccugcacccugacccacagaaugguggaggacagccacagaaacagaaagagcaucaucugcuacgaccugagcugcaacagcacccacugcaagcccaccaugcacaugaucgugcccauccacagcugcaacaugaugaagagcugccuggugggccugggccccuacagaauccaggugguguacgagagaaccuacugcaccaccggcauccugaccgagggcaagugcuucgugcccgaccagagcaucgugaacgugaucaagaacggcguguucgacaucgccagcgugagcaucgugugcuucuucgugagagugaagggcaccaacuacaagaucauggccagcaucaagaccgccaccagcaacaacugcaacgacaccggcaacaaggugcagggcuacuaccugugcaucgugggcggcaacagcagccccguguacgugcccagcaccaccgacuucagaagcauggaggcccuggccagcaugcugagagccccccacggcgaggaccacgaccuggccggcgaggagguggccaccuacagcaucgccggccagguggagggcaaggugccccacaccgccagcaccgccaacaugcugcugaccgccuucagcggcauccccagcuacagcagccugagcguguucaccggcagccaggacggccccaucguguacagccccggccuguuccccaagcugaaccagagcagcugcgacaaggugggccugccccugaucugggagggcuacaucgaccugcccggcuacuacgagaccgugcaccagugcaacguguucugcgugcugagcggccccggcgccagcugcgaggccuucagcgagggcggcaucuucaacaucaccagccccaacugcauggugagcaagcagaacagauucagagccgccgagcagcaggugaacuucgccugccagagaguggaccaggacauccugaucuucugcaacggccagaagaagaccauccugaccaagacccuggugaucggccagugcaucuacagcaucaccagccuguucagcaucaugcccggcguggcccacagcaucgccaucgagcugugcgugcccggcuuccacggcugggccaccgccgcccugcugaccaccuucugcuucggcugggugcugauccccagcaucacccuggccgugcugguggugcugaaguucuucgccgccauccugcacaacagcagccaggagaacagauucaagcugauccugaagaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcccaccgagagcgccuuccaggcccacuacaaggugugccaggccacccacagauucagagacgaccugaagaagaccaucaccccccagagcaccagccccggcugcuacagaacccugaaccuguucagauacaagagcagaugcuacaucuucaccguguggguggugcugcuggugguggagagcgugaugugggccgccagcgccagcgagaccgugcuggagcccagcuggaacgacaacgcccacggcgugggcguggugcccaugcacaccgaccuggagcuggacuucagccugcccagcagcagcaaguacaccuacaagagaaagcugaccagccccaucaaccaggagcagagcguggaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccagaugccacuucgagagagacuucgaguacgagaacagcuggggcugcaaccccgccgacugccccggcaucggcaccggcugcaccgccugcggcaucuacaucgaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggagggcggcggccugaucuucaaggacuggugcaccagcaccugccaguucggcgaccccggcgacaucaugagccccaaggacaagggcuucagcugccccgaguucaccggccacuucagaaagaagugcaacuucgccaccacccccgugugcgaguacgacggcaacauggugagcggcuacaagaaggugauggccaccaucgacagcuuccaggccuucaacaccagcagcauccacuacaccgacgagagaaucgaguggaaggaccccgacggcaugcugaaggaccaccugaacauccuggugaccaaggacaucgacuucgagaaccugggcgacaaccccugcaaggugggccugcagaccgugagcaucgagggcgccuggggcagcggcgugggcuucacccugaccugccaggugagccugaccgagugcagcagauuccugaccagcaucaaggccugcgacaaggccaucugcuacggcgcccagagcagcacccugaucagaggccagaacaccgugaaggugagcggcaagggcggccacagcggcagcagcuucaagugcugccacggcaccgacugcagccagcagggccugcaggccagcgccccccaccuggacaagaucaacggcaucguggagcaggagaacgagaagguguacgacgacggcgccccccagugcggcaucagcugcugguucgugaagagcggcgaguggauccagggcaucuucaacggcaacuggaucgugaucguggugcugaucuucuucuucauccugagccugauccugcugagcaucuucugccccaucagaaagcacaagagaagcuga

SEQ ID NO: 8380 - RNA, 3402 nt, Artificial Sequence
  derived and/or modified CDS sequence (opt4) from DOBV(Ap1584/Sochi-01)__EU188450.1__GP
auguggggccugcugcugaccaugauccugaucgacuucggcgccacccugagaaacguguacgacaugagaaucgagugcccccacagcgugaacuucggcgagagcagcgugagcggcaagguggagcugccccccgugcugcugagcgagguggagacccuggugcccgagagcagcugcaacauggacaaccaccagagcaugagcaucauccagaaggugacccagcugaccuggagaaagaaggccgacaaggcccaggccgccaaggacagcuucgagaucaccagcggcgaggugagccugaagggcaccugcacccugacccacagaaugguggaggacagccacagaaacagaaagagcaucaucugcuacgaccugagcugcaacagcacccacugcaagcccaccaugcacaugaucgugcccauccacagcugcaacaugaugaagagcugccuggugggccugggccccuacagaauccaggugguguacgagagaaccuacugcaccaccggcauccugaccgagggcaagugcuucgugcccgaccagagcaucgugaacgugaucaagaacggcguguucgacaucgccagcgugagcaucgugugcuucuucgugagagugaagggcaccaacuacaagaucauggccagcaucaagaccgccaccagcaacaacugcaacgacaccggcaacaaggugcagggcuacuaccugugcaucgugggcggcaacagcagccccguguacgugcccagcaccaccgacuucagaagcauggaggcccuggccagcaugcugagagccccccacggcgaggaccacgaccuggccggcgaggagguggccaccuacagcaucgccggccagguggagggcaaggugccccacaccgccaacgccgccaacaugcugcugaccgccuucagcggcgugcccagcuacagcagccugagcguguucaccggcagccaggacggccccaucguguacagccccggccuguuccccaagcugaaccagagcagcugcgacaaggugggccugccccugaucugggagggcuacaucgaccugcccggcuacuacgagaccgugcaccagugcaacguguucugcgugcugagcggccccggcgccagcugcgaggccuucagcgagggcggcaucuucaacaucaccagccccaacugcauggugagcaagcagaacagauucagagccgccgagcagcaggugaacuucgccugccagagcguggaccaggacauccugaucuucugcaacggccagaagaagaccauccugaccaagacccuggugaucggccagugcaucuaccccaucaccagccuguucagcaucaugcccggcguggcccacagcaucgccaucgagcugugcgugcccggcuuccacggcugggccaccgccgcccugcugaccaccuucugcuucggcugggugcugauccccagcaucacccuggccgugcugguggugcugaaguucuucgccgccauccugcacaacagcagccaggagaacagauucaagcugauccugaagaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcccaccgagagcgccuuccaggcccacuacaaggugugccaggccacccacagauucagagacgaccugaagaagaccaucaccccccagagcaccagccccggcugcuacagaacccugaaccuguucagauacaagagcagaugcuacaucuucaccguguggguggugcugcuggugguggagagcgugaugugggccgccagcgccagcgagaccgugcuggagcccagcuggaacgacaacgcccacggcgugggcguggugcccaugcacaccgaccuggagcuggacuucagccugcccagcagcagcaaguacaccuacaagagaaagcugaccagccccaucaaccaggagcagagcguggaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccagaugccacuucgagagagacuucgaguacgagaacagcuggggcugcaaccccgccgacugccccggcaucggcaccggcugcaccgccugcggcaucuacaucgaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggagggcggcggccugaucuucaaggacuggugcaccagcaccugccaguucggcgaccccggcgacaucaugagccccaaggacaagggcuucagcugccccgaguucaccggccacuucagaaagaagugcaacuucgccaccacccccgugugcgaguacgacggcaacauggugagcggcuacaagaaggugauggccaccaucgacagcuuccaggccuucaacaccagcagcauccacuacaccgacgagagaaucgaguggaaggaccccgacggcaugcugaaggaccaccugaacauccuggugaccaaggacaucgacuucgagaaccugggcgacagccccugcaaggugggccugcagaccgugagcaucgagggcgccuggggcagcggcgugggcuucacccugaccugccaggugagccugaccgagugcagcagauuccugaccagcaucaaggccugcgacaaggccaucugcuacggcgcccagagcagcacccugaucagaggccagaacaccgugaaggugagcggcaagggcggccacagcggcagcagcuucaagugcugccacggcaccgacugcagccagcagggccugcaggccagcgccccccaccuggacaagaucaacggcaucguggagcaggagaacgagaagguguacgacgacggcgccccccagugcggcaucagcugcugguucgugaagagcggcgaguggauccagggcaucuucaacggcaacuggaucgugaucguggugcugaucuucuucuucauccugagccugauccugcugagcaucuucugccccaucagaaagcacaagagaagcuga

SEQ ID NO: 8381 - RNA, 3408 nt, Artificial Sequence
  derived and/or modified CDS sequence (opt4) from DOBV(GER/05/477/Af)__GQ205411.1__GP
augaucauguggggccugcugcugacccugagccugaucaaccugggcgccagccugagaaacguguacgacaugaagaucgagugcccccacagcaucaacuucggcgagagcagcgugaccggcaagguggagcugcccccccugcugcugaccgacgccgaggcccuggugcccgagagcagcugcaacauggacaaccaccagagccugagcaucacccagaaggugaccaaggugagcuggagaaagaaggccgacaaggugcaggccgccaaggacagcuucgagaccaccagcagcgaggugaacuucaagggcaccugcacccugacccacagaaugguggaggagagcuacagaaacagaaagagcgugaucugcuacgaccugagcugcaacagcacccacugcaagcccaccaugcacaugaucgugcccgugcacagcugcaacaugaugaagagcugccuggugggccugggccccuacagaauccaggugguguacgagagaaccuacugcaccaccggcauccugaccgagggcaagugcuucgugcccgaccagagcaucaucagcgugcugaagaacggcguguucgacaucgccagcgugagcaucgugugcuucuucaucagaaucaagggcaccagcuacaagaucaugaccagcaucaaggaggccaaccccaacaacugcaacgacaccgacaacaaggugcagggcuacuaccugugcaucgugggcgccaacagcagccccguguacgcccccagcaccaccgacuucagaagcguggaggcccuggccagccugcugagaagcccccacggcgaggaccacgaccuggccggcgaggagguggccaccuacagcaucgccggccagguggagggcaaggugccccacaccgccaacgccgccaacaugcuguucaccgccuucagcggcauccccagcuacagcagcuucagcguguucaccggcaaccaggagggcaacgugaucuacagccccggccuguuccccaagcugaaccagagcagcugcgagaagguggcccugccccugaucugggagggcuacaucgaccugcccggcuacuacgagaccgugcaccccugcaacguguucugcgugcugagcggccccggcgccagcugcgaggccuucagcgagggcggcaucuucaacaucaccagccccaccugccuggugagcaagcagaacagauucagagccgccgagcagcagaucaacuucgugugccagagaguggaccaggacaucgugaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccccagcaucacccuggccauccugaucauccugaaguucuucgccgcccuguuccacaacagcagccaggagaacagauucaagaucauccugaagaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcugaccgagagcgccuuccaggcccacuacagagugugccaggccacccacagauucagagacgaccugaagaagaccaucaccccccagagcaccagccccggcugcuacagaacccugaaccuguucagauacaagagcagaugcuacaucuucaccgugugggugauccugcugaucaucgagagcauccugugggccgccagcgccagcgagaccgugcuggagcccagcuggaacgacaacgcccacggcgugggcguggugcccaugcacaccgaccuggagcuggacuucagccugcccagcagcagcaaguacaccuacaagagaaagcugaccagccccaucaaccaggagcagagcguggaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccaagugccacuucgagagagacuucgaguacgagaacagcuggagcugcaaccccgccgacugccccggcaucggcaccggcugcaccgccugcggccuguaccuggaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggagggcggcggccugaucuucaaggacuggugcaccaccaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccaggccuucaacaccagcaacauccacuacaccgacgagagaaucgaguggaaggaccccgacggcaugcugaaggaccaccugaacauccuggugaccaaggacaucgacuucgagaaccugggcgagaaccccugcaaggugggccugcagaccgccagcaucgacggcgccuggggcagcggcgugggcuucacccugaccugccagaucagccugaccgagugcagcagauuccugaccagcaucaaggccugcgacauggccaucugcuacggcgcccagagcgugacccuggugagaggccagaacaccgugagagugagcggcaagggcggccacagcggcagcagcuucaagugcugccacggcaccgacugcagccagcagggccugcaggccagcgccccccaccuggacaaggugaacggcaucguggagcaggagagcacccagguguacgacgacggcgccccccagugcggcaucagcugcugguucgugaagagcggcgaguggaucaagggcaucuucaacggcaacuggaucgugaucguggugcugaucuuccuguuccugcugagccugauccugcugagcuuccugugccccaucagaaagcacaagagaagcuga

SEQ ID NO: 8382 - RNA, 3408 nt, Artificial Sequence
  derived and/or modified CDS sequence (opt4) from DOBV(GER/07/607/Af)__GQ205410.1__GP
augaucauguggggccugcuggugacccugagccugaucaaccugggcgccagccugagaaacguguacgacaugaagaucgagugcccccacagcaucaacuucggcgagagcagcgugaccggcaagguggagcugcccccccugccccugaccgacgccgagacccuggugcccgagagcagcugcaacauggacaaccaccagagccugagcaucacccagaaggugaccaaggugagcuggagaaagaaggccgacaaggugcaggccgccaaggacagcuucgagaccaccagcagcgagaugaaccugaagggcaccugcacccugacccacagaaugguggaggagagcuacagaaacagaaagagcgugaucugcuacgaccugagcugcaacagcacccacugcaagcccaccaugcacaugaucgugcccgugcacagcugcaacaugaugaagagcugccuggugggccugggccccuacagaauccaggugguguacgagagaaccuacugcaccaccggcauccugaccgagggcaagugcuucgugcccgaccagagcaucaucagcgugaugaagaacggcguguucgacaucgccagcgugagcaucgugugcuucuucaucagaaucaagggcaccagcuacaagaucaugaccagcaucaaggaggccaaccccaacaacugcaacgacaccgacaccaaggugcagggcuacuaccugugcaucgugggcgccaacagcagccccguguacgcccccagcaccaccgacuucagaagcguggaggcccuggccagccugcugagaagcccccacggcgaggaccacgaccuggccggcgaggagguggccaccuacagcaucgccggccagguggagggcaaggugccccacaccgccaacgccgccaacaugcuguucaccgccuucagcggcauccccagcuacagcagcuucagcguguucaccggcaaccaggacggcaccgugaucuacagccccggccuguuccccaagcugaaccagagcagcugcgacaagguggcccugccccugaucugggagggcuacaucgaccugcccggcuacuacgagaccgugcaccccugcaacguguucugcgugcugagcggccccggcgccagcugcgaggccuucagcgagggcggcaucuucaacaucaccagccccaccugccuggugagcaagcagaacagauucagagccgccgagcagcagaucaacuucgugugccagagaguggaccaggacaucgugaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccccagcaucacccuggccauccugaucgugcugaaguucuucgccgcccugcugcacaacagcagccaggagaacagauucaagaucauccugaagaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcugaccgagagcgccuuccaggcccacuacagagugugccaggccacccacagauucagagacgaccugaagaagaccaucaccccccagagcaccagccccggcugcuacagaacccugaaccuguucagauacaagagcagaugcuacaucuucaccgugugggugauccugcugaucaucgagagcauccugugggccgccagcgccagcgagaccgugcuggagcccagcuggaacgacaacgcccacggcgugggcguggugcccaugcacgccgaccuggagcuggacuucagccugcccagcagcagcaaguacaccuacaagagaaagcugaccagccccaucaaccaggagcagagcguggaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccaagugccacuucgagagagacuucgaguacgagaacagcuggagcugcaaccccgccgacugccccggcaucggcaccggcugcaccgccugcggccuguaccuggaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggagggcggcggccugaucuucaaggacuggugcaccaccaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccaggccuucaacaccagcaacauccacuacaccgacgagagaaucgaguggaaggaccccgacggcaugcugaaggaccaccugaacauccuggugaccaaggacaucgacuucgagaaccugggcgagaaccccugcaaggugggccugcagaccgccagcaucgacggcgccuggggcagcggcgugggcuucacccugaccugccagaucagccugaccgagugcagcagauuccugaccagcaucaaggccugcgacauggccaucugcuacggcgcccagagcgugacccuggugagaggccagaacaccgugaaggugagcggcaagggcggccacagcggcagcagcuucaagugcugccacggcaccgacugcagccagcagggccugcaggccagcgccccccaccuggacaaggugaacggcaucguggagcaggagagcacccagguguacgacgacggcgccccccagugcggcaucagcugcugguucgugaagagcggcgaguggaucaagggcaucuucagcggcaacuggaucgugaucguggugcugaucuuccuguuccugcugagccugauccugcugagcuuccugugccccaucagaaagcacaagagaagcuga

SEQ ID NO: 8383 - RNA, 3408 nt, Artificial Sequence
  derived and/or modified CDS sequence (opt4) from DOBV(GER/08/118/Aa)__GQ205412.1__GP
augaucauguggggccugcuggugauccugagccugaucaaccugggcgccagccugagaaacguguacgacaugaagaucgagugcccccacagcaucaacuucggcgagagcagcgugaccggcaagguggagcugcccccccugccccugaccgacgccgagacccuggugcccgagagcagcugcaacauggacaaccaccagagccugagcaucacccagaaggugaccaaggugagcuggagaaagaaggccgacaaggugcaggccgccaaggacagcuucgagaccaccagcagcgagaucaaccugaagggcaccugcacccugacccacagaaugguggaggagagcuacagaaacagaaagagcgugaucugcuacgaccugagcugcaacagcacccacugcaagcccaccaugcacaugaucgugcccgugcacagcugcaacaugaugaagagcugccuggugggccugggccccuacagaauccaggugguguacgagagaaccuacugcaccaccggcauccugaccgagggcaagugcuucgugcccgaccagagcaucaucagcgugaugaagaacggcguguucgacaucgccagcgugagcaucgugugcuucuucaucagaaucaagggcaccagcuacaagaucaugaccagcaucaaggaggccaaccccaacaacugcaacgacaccgacaacaaggugcagggcuacuaccugugcaucgugggcgccaacagcagccccguguacgcccccagcaccaccgacuucagaagcguggaggcccuggccagccugcugagaagcccccacggcgaggaccacgaccuggccggcgaggagguggccaccuacagcaucgccggccagguggacggcaaggugccccacaccgccaacgccgccaacaugcuguucaccgccuucagcggcauccccagcuacagcagcuucagcguguucaccggcaaccaggacggcaccgugaucuacagccccggccuguuccccaagcugaaccagagcagcugcgacaagguggcccugccccugaucugggagggcuacaucgaccugcccggcuacuacgagaccgugcaccccugcaacguguucugcgugcugagcggccccggcgccagcugcgaggccuucagcgagggcggcaucuucaacaucaccagccccaccugccuggugagcaagcagaacagauucagagccgccgagcagcagaucaacuucgugugccagagaguggaccaggacaucgugaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccccagcaucacccuggccauccugaucgugcugaaguucuucgccgcccugcugcacaacagcagccaggagaacagauucaagaucauccugaagaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcugaccgagagcgccuuccaggcccacuacagagugugccaggccacccacagauucagagacgaccugaagaagaccaucaccccccagagcaccagccccggcugcuacagaacccugaaccuguucagauacaagagcagaugcuacaucuucaccgugugggugauccugcugaucaucgagagcauccugugggccgccagcgccagcgagaccauccuggagcccagcuggaacgacaacgcccacggcgugggcguggugcccaugcacaccgaccuggagcuggacuucagccugcccagcagcagcaaguacaccuacaagagaaagcugaccagccccaucaaccaggagcagagcguggaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccaagugccacuucgagagagacuucgaguacgagaacagcuggagcugcaaccccgccgacugccccggcaucggcaccggcugcaccgccugcggccuguaccuggaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggagggcggcggccugaucuucaaggacuggugcaccaccaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccaggccuucaacaccagcaacauccacuacaccgacgagagaaucgagugggaggaccccgacggcaugcugaaggaccaccugaacauccuggugaccaaggacaucgacuucgagaaccugggcgagaaccccugcaaggugggccugcagaccgccagcaucgacggcgccuggggcagcggcgugggcuucacccugaccugccagaucagccugaccgagugcagcagauuccugaccagcaucaaggccugcgacauggccaucugcuacggcgcccagagcgugacccuggugagaggccagaacaccgugaaggugagcggcaagggcggccacagcggcagcagcuucaagugcugccacggcaccgacugcagccagcagggccugcaggccagcgccccccaccuggacaaggugaacggcaucguggagcaggagagcacccagguguacgacgacggcgccccccagugcggcaucagcugcugguucgugaagagcggcgaguggaucaagggcguguucagcggcaacuggaucgugaucguggugcugaucuuccuguuccugcugagccugauccugcugagcuuccugugccccaucagaaagcacaagagaagcuga

SEQ ID NO: 8384 - RNA, 3408 nt, Artificial Sequence
  derived and/or modified CDS sequence (opt4) from DOBV(GER/08/131/Af)__GQ205413.1__GP
augaucauguggggccugcugcugacccugagccugaucaaccugggcgccagccugagaaacguguacgacaugaagaucgagugcccccacagcaucaacuucggcgagagcagcgugaccggcaagguggagcugcccccccugcugcugaccgacgccgagacccuggugcccgagagcagcugcaacauggacaaccaccagagccugagcaucacccagaaggugaccaaggugagcuggagaaagaaggccgacaaggugcaggccgccaaggacagcuucgagaccaccagcagcgaggugaaccugaagggcaccugcacccugacccacagaaugguggaggagagcuacagaagcagaaagagcgugaucugcuacgaccugagcugcaacagcacccacugcaagcccaccaugcacaugaucgugcccgugcacagcugcaacaugaugaagagcugccuggugggccugggccccuacagaauccaggugguguacgagagaaccuacugcaccaccggcauccugaccgagggcaagugcuucgugcccgaccagagcaucaucagcgugaucaagaacggcguguucgacaucgccagcgugagcaucgugugcuucuucaucagaaucaagggcaccagcuacaagaucaugaccagcaucaaggagagcaaccccaacaacugcaacgacaccgacaacaaggugcagggcuacuaccugugcaucgugggcgccaacagcagccccguguacgcccccagcaccaccgacuucagaagcguggaggcccuggccagccugcugagaagccccuacggcgaggaccacgaccuggccggcgaggagguggccaccuacagcaucgccggccagguggagggcaaggugccccacaccgccaacgccgccaacaugcuguucaccgccuucagcggcauccccagcuacagcagcuucagcguguucaccggcaaccaggacggcaacgugaucuacagccccggccuguuccccaagcugaaccagagcagcugcgagaagguggcccugccccugaucugggagggcuacaucgaccugcccggcuacuacgagaccgugcaccccugcaacguguucugcgugcugagcggccccggcgccagcugcgaggccuucagcgagggcggcaucuucaacaucaccagccccaccugccuggugagcaagcagaacagauucagagccgccgagcagcagaucaacuucgugugccagagaguggaccaggacaucgugaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccccagcaucacccuggccauccugaucgugcugaaguucuucgccgcccugcugcacaacagcagccaggagaacagauucaagaucauccugaagaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcugaccgagagcgccuuccaggcccacuacagagugugccaggccacccacagauucagagacgaccugaagaagaccaucaccccccagagcaccagccccggcugcuacagaacccugaaccuguucagauacaagagcagaugcuacaucuucaccgugugggugauccugcugaucaucgagagcauccugugggccgccagcgccagcgagaucgugcuggagcccagcuggaacgacaacgcccacggcgugggcguggugcccaugcacaccgaccuggagcuggacuucagccugcccagcagcagcaaguacaccuacaagagaaagcugaccagccccaucaaccaggagcagagcguggaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccaagugccacuucgagagagacuucgaguacgagaacagcuggagcugcaaccccgccgacugccccggcaucggcaccggcugcaccgccugcggccuguaccuggaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggagggcggcggccugaucuucaaggacuggugcaccaccaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccaggccuucaacaccagcaacauccacuacaccgacgagagaaucgaguggaaggacaccgacggcaugcugaaggaccaccugaacauccuggugaccaaggacaucgacuucgagaaccugggcgagaaccccugcaaggugggccugcagaccgccagcaucgacggcgccuggggcagcggcgugggcuucacccugaccugccagaucagccugaccgagugcagcagauuccugaccagcaucaaggccugcgacauggccaucugcuacggcgcccagagcgugacccuggugagaggccagaacaccgugagagugagcggcaagggcggccacagcggcagcagcuucaagugcugccacggcaccgacugcagccaccagggccugcaggccagcgccccccaccuggacaaggugaacggcaucguggagcaggagagcacccagguguacgacgacggcgccccccagugcggcaucagcugcugguucgugaagagcggcgaguggaucaagggcaucuucagcggcaacuggaucgugaucguggugcugaucuuccuguuccugcugagccugauccugcugagcuuccugugccccaucagaaagcacaagagaagcuga

SEQ ID NO: 8385 - RNA, 3408 nt, Artificial Sequence
  derived and/or modified CDS sequence (opt4) from DOBV(GRW/Aa)__JQ026205.1__GP
augaucauguggggccugcugcugacccugagccugaucaaccugggcgccagccugagaaacguguacgacaugaagaucgagugcccccacagcaucaacuucggcgagagcagcgugaccggcaagggcgagcugcccccccugcugcugaccgacgccgagacccuggugcccgagagcagcugcaacauggacaaccaccagagccugagcaucacccagaaggugaccaaggugagcuggagaaagaaggccgacaaggugcaggccgccaaggacagcuucgagaccaccagcagcgaggugaaccugaagggcaccugcacccugacccacagaaugguggaggagagcuacagaagcagaaagagcgugaucugcuacgaccugagcugcaacagcacccacugcaagcccaccaugcacaugaucgugcccgugcacagcugcaacaugaugaagagcugccuggugggccugggccccuacagaauccaggugguguacgagagaaccuacugcaccaccggcauccugaccgagggcaagugcuucgugcccgaccagagcaucaucagcgugaucaagaacggcguguucgacaucgccagcgugagcaucgugugcuucuucaucagaaucaagggcaccagcuacaagaucaugaccagcaucaaggagagcaaccccaacaacugcaacgacaccgacaacaaggugcagggcuacuaccugugcaucgugggcgccaacagcagccccguguacgcccccagcaccaccgacuucagaagcguggaggcccuggccagccugcugagaagccccuacggcgaggaccacgaccuggccggcgaggagguggccaccuacagcaucgccggccagguggagggcaaggugccccacaccgccaacgccgccaacaugcuguucaccgccuucagcggcauccccagcuacagcagcuucagcguguucaccggcaaccaggacggcaacgugaucuacagccccggccuguuccccaagcugaaccagagcagcugcgagaagguggcccugccccugaucugggagggcuacaucgaccugcccggcuacuacgagaccgugcaccccugcaacguguucugcgugagcagcggccccggcgccagcugcgaggccuucagcgagggcggcaucuucaacaucaccagccccaccugccuggugagcaagcagaacagauucagagccgccgagcagcagaucaacuucgugugccagagaguggaccaggacaucgugaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccccagcaucacccuggccauccugaucgugcugaaguucuucgccgcccugcugcacaacagcagccaggagaacagauucaagaucauccugaagaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcugaccgagagcgccuuccaggcccacuacagagugugccaggccacccacagauucagagacgaccugaagaagaccaucaccccccagagcaccagccccggcugcuacagaacccugaaccuguucagauacaagagcagaugcuacaucuucaccgugugggugauccugcugaucaucgagagcauccugugggccgccagcgccagcgagaucgugcuggagcccagcuggaacgacaacgcccacggcgugggcguggugcccaugcacaccgaccuggagcuggacuucagccugcccagcagcagcaaguacaccuacaagagaaagcugaccagccccaucaaccaggagcagagcguggaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccaagugccacuucgagagagacuucgaguacgagaacagcuggagcugcaaccccgccgacugccccggcaucggcaccggcugcaccgccugcggccuguaccuggaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggagggcggcggccugaucuucaaggacuggugcaccaccaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccaggccuucaacaccagcaacauccacuacaccgacgagagaaucgaguggaaggaccccgacggcaugcugaaggaccaccugaacauccuggugaccaaggacaucgacuucgagaaccugggcgagaaccccugcaaggugggccugcagaccgccagcaucgacggcgccuggggcagcggcgugggcuucacccugaccugccagaucagccugaccgagugcagcagauuccugaccagcaucaaggccugcgacauggccaucugcuacggcgcccagagcgugacccuggugagaggccagaacaccgugagagugagcggcaagggcggccacagcggcagcagcuucaagugcugccacggcaccgacugcagccaccagggccugcaggccagcgccccccaccuggacaaggugaacggcaucguggagcaggagagcacccagguguacgacgacggcgccccccagugcggcaucagcugcugguucaucaagagcggcgaguggaucaagggcaucuucagcggcaacuggaucgugaucguggugcugaucuuccuguuccugcugagccugauccugcugagcuuccugugccccaucagaaagcacaagagaagcuga

SEQ ID NO: 8386 - RNA, 3408 nt, Artificial Sequence
  derived and/or modified CDS sequence (opt4) from DOBV(Slo/Af-BER)__GU904035.1__GP
augaucauguggggccugcugcugaccaugauccugaucgacuucggcgccagccugagaaacguguacgacaugaagaucgagugcccccacagcaucaacuucggcgagagcagcgugaccggcaagguggagcugcccccccugcugcugaccgacgccgaggcccuggugcccgagagcagcugcaacauggacaaccaccagagcaugagcaucauccagaaggugaccaaggugagcuggagaaagaaggccgacaaggcccaggccgccaaggacagcuucgagaccaccagcagcgaggugaaccugaagggcaccugcacccugagccacagaaugguggaggagagcuacagaaacagaagaagcgugaucugcuacgaccugagcugcaacagcacccacugcaagcccaccaugcacaugaucgugcccgugcacagcugcaacaugaugaagagcugccuggugggccugggccccuacagaauccaggugguguacgagagaaccuacugcaccaccggcauccugaccgagggcaagugcuucgugcccgaccagagcaucgugagcgugaucaagaacggcguguucgacaucgccagcgugagcaucgugugcuucuucaucagagugaagggcaccaacuacaagaucauggccagcaucaagaccgccaccgccaacaacugcaacgacaccgacaacaaggugcagggcuacuaccugugcaucgugggcggcaacagcagccccguguacgcccccagcaccaccgacuucagaagcauggaggcccuggccagccugcugagagccccccacggcgaggaccacgaccugagcggcgaggagguggccaccuacagcaucgccggccagaucgagggcaagaucccccacaccgccaacgccgccaacaugcuguucaccgccuucagcggcauccccagcuacagcagccugagcguguucaucggcagccaggacggccccaucaucuacagccccggccuguuccccaagcugaaccagagcagcugcgacaagguggcccugccccugaucugggagggcuacaucgaccugcccggcuacuacgagaccgugcaccccugcaacguguucugcgugcugagcggccccggcgccagcugcgaggccuucagcgagggcggcaucuucaacaucaccagccccaccugccuggugagcaagcagaacagauucagagccgccgagcagcaggugaacuucgugugccagagaguggaccaggacaucaucaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccccagcaucacccuggccgugcugguggugcugaaguucuucgccgccauccugcacaacagcagccaggagaacagauucaagaucauccugagaaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcccaccgagagcgccuuccaggcccacuacaaggugugccaggccacccacagauucagagacgaccugaagaagaccaucaccccccagagcaccagccccggcugcuacagaacccugaaccuguucagauacaagagcagaugcuacaucuucaccgugugggugacccugcugaucaucgagagcaucaugugggccgccagcgccagcgagaacgugcuggagcccagcuggaacgacaacgcccacggcgugggcguggugcccaugcacaccgaccuggagcuggacuucagccugcccagcagcagcaaguacaccuacaagagaaagcugaccagcccccugaaccaggagcagagcguggaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccaagugccacuucgagagagacuucgaguacgagaacagcuggggcugcaaccccgccgacugccccggcaucggcaccggcugcaccgccugcggccuguacaucgaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggagggcggcggccugaucuucaaggacuggugcaccagcaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccagagcuucaacaccagcagcauccacuacaccgacgagagaaucgaguggaaggaccccgacggcaugcugaaggaccaccugaacauccuggugaccaaggacaucgacuucgagaaccugggcgagaaccccugcaaggugggccugcagaccagcagcaucgagggcgccuggggcagcggcgugggcuucacccugaccugccagaucagccugaccgagugcagcagauuccugaccagcaucaaggccugcgacauggccaucugcuacggcgcccagagcgugacccugaucagaggccagaacaccgugaaggugagcggcaagggcggccacagcggcagcagcuucaagugcugccacggcaccgacugcagccagcagggccugcaggccagcgccccccaccuggacaaggugaacggcaucguggagcaggacagcgagaagguguacgacgacggcgccccccagugcggcaucagcugcugguucgugaagagcggcgaguggaucaccggcaucuucaacggcaacuggaucgugaucguggugcugguguucuucuucauccugagccugauccugcugagccugcugugccccaucagaaagcacaagagaagcuga

SEQ ID NO: 8387 - RNA, 3408 nt, Artificial Sequence
  derived and/or modified CDS sequence (opt4) from HTNV(76-118/POR)__KT885048.1__GP
augggcaucuggaaguggcuggugauggccagccugguguggcccgugcugacccugagaaacguguacgacaugaagaucgagugcccccacaccgugagcuucggcggcaacagcgugaucggcuacguggagcugccccccgugccccuggccgacaccgcccagauggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcgugaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaucgccagcuacagcaucgugggccccgccaacgccaaggugccccacagcgccagcagcgacacccugagacugaucgccuacagcggcauccccagcuacagcagccugagcauccugaccagcagcaccgaggccaagcacguguucagccccggccuguuccccaagcugaaccacaccaacugcgacaagagcgccaucccccugaucuggaccggcaugaucgaccugcccggcuacuacgaggccgugcaccccugcaccguguucugcgugcugagcggccccggcgccagcugcgaggccuucagcgagggcggcaucuucaacaucaccagcagcaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8388 - RNA, 3408 nt, Artificial Sequence
  derived and/or modified CDS sequence (opt4) from HTNV(76-118)__Y00386.1__GP
augggcaucuggaaguggcuggugauggccagccugguguggcccgugcugacccugagaaacguguacgacaugaagaucgagugcccccacaccgugagcuucggcggcaacagcgugaucggcuacguggagcugccccccgugccccuggccgacaccgcccagauggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcgugaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccugaccagcagcaccgaggccaagcacguguucagccccggccuguuccccaagcugaaccacaccaacugcgacaagagcgccaucccccugaucuggaccggcaugaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucagaugcugccacggcgaggacugcagccagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8389 - RNA, 3408 nt, Artificial Sequence
  derived and/or modified CDS sequence (opt4) from HTNV(A16)__AF288645.1__GP
augggccuguggaaguggcugaucauggccgugcugguguggcccugcuucgcccugagaaacguguacgacaugaagaucgagugcccccacaccgugaacuucggcgagaacagcguggugggcuacguggagcugccccccaugcccaucgccgacaucacccagaugaugcccgagagcagcugcagcauggacaaccaccagagccugaacaccaucaccaaguacacccaggugagcuggagaaagaaggccgaccaggcccagagcagccagaccagcuucgagaccgugagcagcgagguggacuucaagggcaccugcgugcugaagcacaagaugaucgaggacagcuacagaagcagaagaagcaucaucugcuacgaccugagcugcaacagcaccuucugcaagcccacccuguaccugaucgugcccgugcacgccugcaacaugaugaagagcugccugaucgcccugggccccuacagagugcaggugguguacgagagaaccuacugcaugagcggcgugcugcuggagggcaagugcuucgugcccgaccagagcguggugagcaucaucaagcacggcaucuucgacaucgccagcgugcacaucgugugcuucuucguggccaucaagggcagcaccuacaagauccuggagcaggugaagaagagcuucgagcugaccugcaacgacaccgacaacaagauccagggcuacuacaucugccuggugggcggcaacagcgcccccaucuacgugcccacccuggacgacuucagaagcauggaggccuucgccggcaucuucaagagcccccacggcgaggaccacgaccuggccggcgaggagguggccagcuacagcaucgugggccccgccaacgccaaggugccccacagcgccagcgccgacacccugggccugguggccuucagcggcauccccagcuacagcagcuucagcgugcugaccggcagcaccgacgccagacacguguucagccccggcuucuucccccagcugaaccagaccagaugcgacaagaccgccaucccccugaccuggaccggcaugaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagaagcagcaagcagcaggugaacuucgugugccagagaguggacauggacaucgugguguacugcaacggccagaagaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccgugacccuggugauccugaccauccugaaguucaucgccaacaucuuccacaccagcaaccaggagaacagacugaagagcgugcugaagaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggguguuccugcugauccuggagagcauccugugggccgccagcgccagcgagaccccccugacccccaucuggaacgacaacgcccacggcgugggcagcauccccaugcacaccgaccuggagcuggacuucagccugaccagcagcagcaaguacaccuacagaagaaagcugaccaacccccuggaggagacccaggccguggaccugcacaucgagcuggccgagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaaggugaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacaugaucagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaccggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8390 - RNA, 3408 nt, Artificial Sequence
  derived and/or modified CDS sequence (opt4) from HTNV(A9)__AF035831.1__GP
augggcaucuggaaguggcuggugauggccagccugguguggcccgccuacacccugagaaacgccuacgacaugaagaucgagugcccccacaccgugagcuucggcgagaacagcgugaucggcuacguggagcugccccccaucccccuggccgacaccacccagauggugcccgagagcagcugcagcauggacaaccaccagagccugaacaccaucaccaaguacacccaggugagcuggagaggcaaggccgaccacgcccaggccagccagaacagcuucgaggccgugagcgccgagguggaccugaagggcaccugcgugcugaagcacaagaugcuggaggagagcuacagaagcagaaagagcaucgccugcuacgaccugagcugcaacagcaccuacugcaagcccacccuguacaugaucgugcccauccacgccugcaacaugaugaagagcugccugaucgcccugggcccccacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcagaucaagaagagcuucgagagcaccugcaacgacaccaagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaccgccuacagcggcauccccagcuacagcagccugagcauccuggccggcagcgccgaggccaagcacguguucagccccggcuucuucccccagcugaaccacaccaagugcgacaagaccgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaugaccuucaucgugcugaccauccugaaguucaucgccaacaucuuccacaccagcaaccaggagaacaagcugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccauguggguguuccugcuggugcuggagagcauccugugggccgccagcgccagcgagaucccccugaaccccguguggaacgacaacgcccacggcgugggcagcgugcccaugcccaccgaccuggagcuggacuucagccugaccagcagcagcaaguacaccuacagaagaaagcugaccaacccccuggaggagagccaggccaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugagagccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcagcagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgagaaccugggcggcaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcaucaagugcugguucgugaagagcggcgaguggaucagcggcaucuucagcggcaacuggaucgugcugaucgugcugugcguguuccugcuguucagccugauccugcugagcauccugugccccgugagaaagcacaagaagagcuga

SEQ ID NO: 8391 - RNA, 3408 nt, Artificial Sequence
  derived and/or modified CDS sequence (opt4) from HTNV(84FLi)__AF345636.2__GP
augggcguguggaaguggcuggugauggccagccugguguggcccgccugcacccugagaaacguguacgacaugaagaucgagugcccccacaccgugagcuucggcgagaacagcgugaucggcuacguggagcugccccccaugccccuggccgacaccacccagcuggugcccgagagcagcugcagcauggacaaccaccagagccugaacaccaucaccaaguacacccaggugagcuggagaaagaaggccgaccaggcccagagcagccagaacagcuucgagaccgugagcguggagguggaccugaagggcaccugcgugcugaagcacaagaugaucgaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugaagaucgugugcuucuucguggccgugaagggcaacaccuacaagcuguucgagcaggugaagaagagcuucgacagcaccugcaacgacaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagguggccagcuacagcaucgugggccccgccaacgccaaggugccccacagcgccagcagcgacacccugagccugaucgccuacagcggcauccccagcuacagcagccugagcauccugaccagcagcaccgaggccaagcacguguucagccccggcuucuucccccagcugaaccacaccaagugcgacaagaccgccaucccccugaccuggaccggcaugaucgaccugcccggcuacuacgaggccauccaccugugcaccguguucugcgugcugagcggccccggcgccagcugcgaggccuucagcgagggcggcaucuucaacaucaccagccccaugugccuggugagcaagcagaaccaguucagacugaccaagcagcaggugaacuucgugugccagagaguggacauggacaucgugguguacugcaacggccagagaaaggugauccugaccaagaccauggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccgugaccuucaucauccugaccgugcugaaguucguggccaacaucuuccacaccagcaaccaggagaacagacugaagagcgugcugagaaagaucaaggaggaguucgagaagaccaagggcagcauggugugcgacgugugcaaguacgagugcgagaccuacagagagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccauguggguguuccugcuggugcuggagagcauccugugggccgccagcgccagcgaggugccccugaaccccaucuggaacgacaacgcccacggcgugggcagcgugcccaugcacaccgaccuggagcuggacuucagccugaccagcagcagcaaguacaccuacagaagaaagcugaccaacccccuggaggagacccaggccaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaaggugaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacaugaucagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaccggccugcacgccgccgccccccaccuggacaaggugaacggcaucagcgagaucgagaacagcaagguguacgacgacggcgccccccagugcggcaucaagugcugguucgugaccagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8392 - RNA, 3408 nt, Artificial Sequence
  derived and/or modified CDS sequence (opt4) from HTNV(Aa03-161)__KT934990.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacagaaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8393 - RNA, 3408 nt, Artificial Sequence
  derived and/or modified CDS sequence (opt4) from HTNV(Aa03-386)__KT934991.1__GP
augggcaucuggaaguggcuggugauggccagccugguguggcccgugcugacccugagaaacguguacgacaugaagaucgagugcccccacaccaucagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcaucuuccugcuguucagccuggugcugcugagcauccugugccccgugagaaagcacaagaagagcuga

SEQ ID NO: 8394 - RNA, 3408 nt, Artificial Sequence
  derived and/or modified CDS sequence (opt4) from HTNV(Aa04-722)__KU207182.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaucaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8395 - RNA, 3408 nt, Artificial Sequence
  derived and/or modified CDS sequence (opt4) from HTNV(Aa05-190)__KT934993.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccugaccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugaucgaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8396 - RNA, 3408 nt, Artificial Sequence
  derived and/or modified CDS sequence (opt4) from HTNV(Aa09-1000)__KT935001.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8397 - RNA, 3408 nt, Artificial Sequence
  derived and/or modified CDS sequence (opt4) from HTNV(Aa09-948)__KT935000.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccugaucagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8398 - RNA, 3408 nt, Artificial Sequence
  derived and/or modified CDS sequence (opt4) from HTNV(Aa10-434)__KT935004.1__GP
augggcaucuggaaguggcuggugauggccagccugguguggcccgugcugacccugagaaacguguacgacaugaagaucgagugcccccacaccgugagcuucggcggcaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaucagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccaucagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcaggccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8399 - RNA, 3408 nt, Artificial Sequence
  derived and/or modified CDS sequence (opt4) from HTNV(Aa10-518)__KT935005.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccaagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucguggacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8400 - RNA, 3408 nt, Artificial Sequence
  derived and/or modified CDS sequence (opt4) from HTNV(Aa10-561)__KT935006.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaucagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccaucagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcaggccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8401 - RNA, 3408 nt, Artificial Sequence
  derived and/or modified CDS sequence (opt4) from HTNV(Aa14-172)__KT935008.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccugaccgacaccgcccagcuggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugaucgaggagagcuacagaagcagaaagagcaucaccugcuacgaccugagcugcaacaacaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagguggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8402 - RNA, 3408 nt, Artificial Sequence
  derived and/or modified CDS sequence (opt4) from HTNV(Aa14-266)__KT935013.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagauggugcccgagagcagcugcagcauggacaaccaccagagccugaacaccaucaccaaguacacccaggugagcuggagaggcaaggccgaccagagccagagcaaccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaucgccaccuacagcaucgugggccccgccaacgccaaggugccccacagcgccagcagcgacacccugagccugaucgccuacagcggcauccccagcuacagcagccugagcauccugaccagcagcaccgaggccaagcacguguucagccccggccuguuccccaagcugaaccacaccaacugcgacaagagcgccaucccccugauguggaccggcaugaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaccaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8403 - RNA, 3408 nt, Artificial Sequence
  derived and/or modified CDS sequence (opt4) from HTNV(Aa14-272)__KT935014.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagauggugcccgagagcagcugcagcauggacaaccaccagagccugaacaccaucaccaaguacacccaggugagcuggagaggcaaggccgaccagagccagagcaaccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaucgccaccuacagcaucgugggccccgccaacgccaaggugccccacagcgccagcagcgacacccugagccugaucgccuacagcggcauccccagcuacagcagccugagcauccugaccagcagcaccgaggccaagcacguguucagccccggccuguuccccaagcugaaccacaccaacugcgacaagagcgccaucccccugauguggaccggcaugaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8404 - RNA, 3408 nt, Artificial Sequence
  derived and/or modified CDS sequence (opt4) from HTNV(Aa14-362)__KT935015.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaggcaaggccgaccagagccagagcagccagaacagcuucgaggccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8405 - RNA, 3408 nt, Artificial Sequence
  derived and/or modified CDS sequence (opt4) from HTNV(Aa14-404)__KT935018.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagauggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaucgccaccuacagcaucgugggccccgccaacgccaaggugccccacagcgccagcagcgacacccugagccugaucgccuacagcggcauccccagcuacagcagccugagcauccugaccagcagcaccgaggccaagcacguguucagccccggccuguuccccaagcugaaccacaccaacugcgacaagagcgccaucccccugauguggaccggcaugaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccaccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8406 - RNA, 3408 nt, Artificial Sequence
  derived and/or modified CDS sequence (opt4) from HTNV(Aa14-423)__KT935022.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagauggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaucgccaccuacagcaucgugggccccgccaacgccaaggugccccacagcgccagcagcgacacccugagccugaucgccuacagcggcauccccagcuacagcagccugagcauccugaccagcagcaccgaggccaagcacguguucagccccggccuguuccccaagcugaaccacaccaacugcgacaagagcgccaucccccugauguggaccggcaugaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccaccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8407 - RNA, 3408 nt, Artificial Sequence
  derived and/or modified CDS sequence (opt4) from HTNV(Aa15-56)__KU207187.1__GP
augggcaucuggaaguggcuggugauggccagccugguguggcccgugcugacccugagaaacguguacgacaugaagaucgagugcccccacaccgugagcuucggcgagaacagcgugaucggcuacguggagcugccccccaugccccuggccgacaccgcccagcuggugcccgagagcagcugcagcauggacaaccaccagagccugaacaccaucaccaaguacacccaggugagcuggagaagaaaggccgaccagagccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgcccugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaccgccaccuacagcaucgugggccccgccaacgccaaggugccccacagcgccagcagcgacacccugagccugaucgccuucagcggcauccccagcuacagcagccugagcauccugaccagcagcaccgaggccaagcacguguucagccccggccuguuccccaagcugaaccacaccaacugcgacaagggcgccaucccccugauguggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggacagacugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagauggagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8408 - RNA, 3408 nt, Artificial Sequence
  derived and/or modified CDS sequence (opt4) from HTNV(CBAa11-106)__KC576787.1__GP
augggcauguggaaguggcuggugaucgccagccugguguggcccgcccugacccugagaaacguguacgacaugaagaucgagugcccccacaccgugagcuucggcgagaacagcgugaucggcuacguggagcugccccccaugccccuggccgacaccgcccagauggugcccgagagcagcugcagcauggacaaccaccagagcaugaacaccaucaccaaguacacccaggugaucuggagaggcaaggccgaccccggccagagcagccagaacagcuucgagaccgugagcaccgagaucgaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuucgagagcaccugcaacgacaccgagaacaaggugcagggcuacuacaucugcaucgugggcggcaacuucgcccccaucuacgugcccacccuggacgacuucagaagcauggaggccuucaccggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccugaccagcagcaccgaggccaagcacguguucagccccggccuguuccccaagcugaaccacaccaacugcgacaagagcgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucguggccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggguguuccugcugauccuggagagcgugcugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8409 - RNA, 3408 nt, Artificial Sequence
  derived and/or modified CDS sequence (opt4) from HTNV(CBAa11-26)__KC576786.1__GP
augggcauguggaaguggcuggugaucgccagccugguguggcccgcccugacccugagaaacguguacgacaugaagaucgagugcccccacaccgugagcuucggcgagaacagcgugaucggcuacguggagcugccccccaugccccuggccgacaccgcccagauggugcccgagagcagcugcagcauggacaaccaccagagcaugaacaccaucaccaaguacacccaggugaucuggagaggcaaggccgaccccggccagagcagccagaacagcuucgagaccgugagcaccgagaucgaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccugaccagcagcaccgaggccaagcacguguucagccccggccuguuccccaagcugaaccacaccaacugcgacaagagcgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucguggccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggguguuccugcugauccuggagagcgugcugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8410 - RNA, 3408 nt, Artificial Sequence
  derived and/or modified CDS sequence (opt4) from HTNV(Fuyuan-Aa-145)__KJ857336.1__GP
augggcauguggaaguggcuggugaucgccagccugguguggcccgcccugagccugagaaacguguacgacaugaagaucgagugcccccacaccgugagcuucggcgagaacagcgugaucggcuacguggagcugccccccaugccccuggccgacaccgcccagauggugcccgagagcagcugcagcauggacaaccaccagagcaucaacaccaucaccaaguacacccaggugaucuggagaggcaaggccgaccccggccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuucugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacguggugugcuucuucguggccgugaagggcaacaccuacaagcuguucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucaagagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccugaccagcagcaccgacgccaagcacguguucagccccggccuguuccccaagcugaaccacaccaacugcgacaagagcgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccgugaccuucaucauccugaccgugcugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggguguuccugcugauccuggagagcgugcugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagcaagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8411 - RNA, 3408 nt, Artificial Sequence
  derived and/or modified CDS sequence (opt4) from HTNV(Fuyuan-Aa-26)__KJ857334.1__GP
augggcauguggaaguggcuggugaucgccagccugguguggcccgcccugagccugagaaacguguacgacaugaagaucgagugcccccacaccgugagcuucggcgagaacagcgugaucggcuacguggagcugccccccaugccccuggccgacaccgcccagauggugcccgagagcagcugcagcauggacaaccaccagagcaucaacaccaucaccaaguacacccaggugaucuggagaggcaaggccgaccccggccagagcagccagaacagcuucgagaccgugagcaccgagguggaccugaagggcaccugcgugcugaagcacaagaugguggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucaagagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccugaccagcagcaccgacgccaagcacguguucagccccggccuguuccccaagcugaaccacaccaacugcgacaagagcgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccgugaccuucaucauccugaccgugcugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggguguuccugcugauccuggagagcgugcugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagcaagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8412 - RNA, 3408 nt, Artificial Sequence
  derived and/or modified CDS sequence (opt4) from HTNV(JS1)__KP970560.1__GP
augggcaucuggaaguggcuggugauggccagccugguguggcccgugcugacccugagaaacguguacgacaugaagaucgagugcccccacaccgugagcuucggcggcaacagcgugaucggcuacguggagcugccccccgugccccuggccgacaccgcccagauggugcccgagagcagcugcagcauggacaaccaccagagccugaacaccaucgccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcgugaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccugaccagcagcaccgaggccaagcacguguucagccccggccuguuccccaagcugaaccacaccaacugcgacaagagcgccaucccccugaucuggaccggcaugaucgaccugcccggcuacuacgaggccgugcaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgagggcaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 8413 - RNA, 3408 nt, Artificial Sequence
  derived and/or modified CDS sequence (opt4) from HTNV(LongquanAa-08-150)__JQ912803.1__GP
augggcaucuggaaguggcuggugauggccagccugguguggcccgccuucacccugagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaucugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugcuggagggcaagugcuucgugcccgaccagagcguggugagcaucaucaagcacggcaucuucgacaucgccagcgugcacaucgugugcuucuucguggccgugaagggcaacaccuacaagcugcuggagcaggugaagaagagcuuccagagcaccugcaacgacaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaucuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacguggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccugcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8414 - RNA, 3408 nt, Artificial Sequence
  derived and/or modified CDS sequence (opt4) from HTNV(LongquanAa-08-157)__JQ912804.1__GP
auggagaucuggaaguggcuggugauggccagccugguguggcccgccuucacccugagaaacguguacgacaugaagaucgagugcccccacaccgugagcuucggcgagaacagcgugaucggcuacguggagcugagccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacggcaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaaccuguuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8415 - RNA, 3408 nt, Artificial Sequence
  derived and/or modified CDS sequence (opt4) from HTNV(LongquanAa-08-196)__JQ912805.1__GP
auggagaucuggaaguggcuggugauggccagccugguguggcccgccuucacccugagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacggcaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8416 - RNA, 3408 nt, Artificial Sequence
  derived and/or modified CDS sequence (opt4) from HTNV(LongquanAa-08-235)__JQ912810.1__GP
auggagaucuggaaguggcuggugauggccagccugguguggcccgccuucacccugagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacggcaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcugguguucgagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcgugaacuggaucgugcugaucgugcugugcguguuccugcuguucagccuggugcugcugagcgugcugugccccgugagaaagcacaagaagagcuga

SEQ ID NO: 8417 - RNA, 3408 nt, Artificial Sequence
  derived and/or modified CDS sequence (opt4) from HTNV(LongquanAa-09-171)__JQ912824.1__GP
auggagaucuggaaguggcuggugauggccagccugguguggcccgccuucacccugagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacggcaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccaacaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8418 - RNA, 3408 nt, Artificial Sequence
  derived and/or modified CDS sequence (opt4) from HTNV(LongquanAa-09-191)__JQ912825.1__GP
auggagaucuggaaguggcuggugauggccagccugguguggcccgccuucacccugagaaacguguacgacaugaagaucgagugcccccacaccgugagcuucggcgagaacagcgugaucggcuacguggagcugcccagaaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacggcaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8419 - RNA, 3408 nt, Artificial Sequence
  derived and/or modified CDS sequence (opt4) from HTNV(LongquanAa-09-350)__JQ912835.1__GP
auggagaucuggaaguggcuggugauggccagccugguguggcccgccuucaccagaagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacggcaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgagaagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8420 - RNA, 3408 nt, Artificial Sequence
  derived and/or modified CDS sequence (opt4) from HTNV(LongquanAa-09-489)__JQ912844.1__GP
auggagaucuggaaguggcuggugauggccagccugguguggcccgccuucacccugagaaacguguacgacaugaagaucgagugcccccacaccgugagcuucggcgagaacagcgugaucggcuacguggagcugcccagaaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacggcaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccugcagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8421 - RNA, 3408 nt, Artificial Sequence
  derived and/or modified CDS sequence (opt4) from HTNV(LongquanAa-09-541)__JQ912850.1__GP
augggcaucuggaaguggcuggugauggccagccugguguggcccgccuucacccugagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaucugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugcuggagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacggcaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8422 - RNA, 3408 nt, Artificial Sequence
  derived and/or modified CDS sequence (opt4) from HTNV(LongquanAa-09-698)__JQ912854.1__GP
auggagaucuggaaguggcuggugauggccagccugguguggcccgccuucacccugagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaccugcauccugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacggcaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgcccugacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga

SEQ ID NO: 8423 - RNA, 3408 nt, Artificial Sequence
  derived and/or modified CDS sequence (opt4) from HTNV(LongquanAa-10-393)__JQ912859.1__GP
auggagaucuggaaguggcuggugauggccagccugguguggcccgccuucacccugagaaacguguacgacaugaagaucgagugcccccacaccgugagcuucggcgagaacagcgugaucggcuacguggagcugccccccaugccccuggccgacaccgcccagauggugcccgagagcagcugcaacauggacaaccaccagagcaugaacaccaucaccaaguacacccaggugagcuggagaggcaaggccgaccaggcccaggccagccagaacagcuucgaggccgugagcgccgagguggaccugaagggcaccugcgugcugaagcacaagaugcuggaggagagcuacagaagcagaaagagcaucaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagcuguucgagcaggugaagaagagcuuccagagcaccugcaacggcaccgagaacaaggugcagggcuacuacaucugcaucgugggcggcaacagcgcccccaucuacgugcccacccuggacgacuucagaagcauggaggccuucagcggcaucuucagaagcccccacggcgaggaccacgaccuggccggcgaggagaucgccagcuacagcaucgugggccccgccaacgccaaggugccccacagcgccagcagcgacacccugagccugaucgccuacagcggcauccccagcuacagcagccugagcauccuggccagcagcaccgaggccaagcacguguucagccccggcuucuucccccagcugaaccacaccaagugcgacaagaccgccaucccccugaccuggaccggcaugaucgaccugcccggcuacuacgaggccauccaccccugcaccguguucugcgugcugagcggccccggcgccagcugcgaggccuucagcgagggcggcaucuucaacaucaccagccccaugugccuggugagcaagcagaacagauucagacugaccgagcagcaggugaacuucgugugccagagaguggacauggacaucaucguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcagagugcugauccccgcccugacccugaucauccugaccauccugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacagagugugccaggugacccacagauucagagacgaccugaagaagaccgugaccccccagaacuucacccccggcugcuacagaacccugaaccuguucagauacaagagcagaugcuacaucuucaccaugugggugugccugcuggugcuggagagcauccugugggccgccagcgccagcgaggugccccugaaccccguguggaacgacaacgcccacggcgugggcagcgugcccaugcacaccgaccuggagcuggacuucagccugaccagcagcagcaaguacaccuacagaagaagacugaccaacccccuggaggagacccagagcaucaaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccgccgacugccccggcgugggcaccggcugcaccgccugcggccuguaccuggaccagcugaagcccgugggcagcgccuacaagaucaucaccaucagauacagcagaaaggugugcgugcaguucggcgaggagaaccugugcaaggugaucgacaugaacgacugcuucgugaccagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccaccccccugugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccugaucagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggagugcagccagaucggccugcacgccgccgccccccaccuggacaaggugaacggcaucagcgagaucgagaacaacaagguguacgacgacggcgccccccagugcggcgugaagugcugguucgugaagagcggcgaguggaucagcggcaucuucagcggcaacuggaucgugcugaucgugcugugcguguuccugcuguucagccuggugcugcugagcgugcugugccccgugagaaagcacaagaagagcuga
